United States Patent 12,394,502 (METHOD FOR PREDICTING HLA-BINDING PEPTIDES USING PROTEIN STRUCTURAL FEATURES) - sequence listing, part 4

SEQ ID NO: 130102 - protein, 11 aa, Homo Sapiens
HSQPIVSIRVW

SEQ ID NO: 130103 - protein, 11 aa, Homo Sapiens
HSSEELRNLGW

SEQ ID NO: 130104 - protein, 11 aa, Homo Sapiens
HSWMEGQVTVW

SEQ ID NO: 130105 - protein, 11 aa, Homo Sapiens
HTFFDHQDQVW

SEQ ID NO: 130106 - protein, 11 aa, Homo Sapiens
HTITPVIPLLW

SEQ ID NO: 130107 - protein, 11 aa, Homo Sapiens
HTNQDHVHAVW

SEQ ID NO: 130108 - protein, 11 aa, Homo Sapiens
HTWNGIRHLMW

SEQ ID NO: 130109 - protein, 11 aa, Homo Sapiens
IATKVLGTVKW

SEQ ID NO: 130110 - protein, 11 aa, Homo Sapiens
IGAQVLGKILW

SEQ ID NO: 130111 - protein, 11 aa, Homo Sapiens
IGLPGAGKTTW

SEQ ID NO: 130112 - protein, 11 aa, Homo Sapiens
ISAPDKRIYQF

SEQ ID NO: 130113 - protein, 11 aa, Homo Sapiens
ISDHEATLRCW

SEQ ID NO: 130114 - protein, 11 aa, Homo Sapiens
ISFIEDPERKY

SEQ ID NO: 130115 - protein, 11 aa, Homo Sapiens
ISKFDTVEDFW

SEQ ID NO: 130116 - protein, 11 aa, Homo Sapiens
ISKPVGFGEEF

SEQ ID NO: 130117 - protein, 11 aa, Homo Sapiens
ISLPDDVRRRL

SEQ ID NO: 130118 - protein, 11 aa, Homo Sapiens
ISMANDLKEVW

SEQ ID NO: 130119 - protein, 11 aa, Homo Sapiens
ISNPVTKEMLF

SEQ ID NO: 130120 - protein, 11 aa, Homo Sapiens
ISNTASYLRLW

SEQ ID NO: 130121 - protein, 11 aa, Homo Sapiens
ISYPQEVIPTF

SEQ ID NO: 130122 - protein, 11 aa, Homo Sapiens
ITIPDIKKDRW

SEQ ID NO: 130123 - protein, 11 aa, Homo Sapiens
ITREEGVLTLW

SEQ ID NO: 130124 - protein, 11 aa, Homo Sapiens
ITSQVTGQIGW

SEQ ID NO: 130125 - protein, 11 aa, Homo Sapiens
ITSSAKVDMTF

SEQ ID NO: 130126 - protein, 11 aa, Homo Sapiens
ITSSIHSKETF

SEQ ID NO: 130127 - protein, 11 aa, Homo Sapiens
ITYDDPIKTSW

SEQ ID NO: 130128 - protein, 11 aa, Homo Sapiens
IVDPNGLARLW

SEQ ID NO: 130129 - protein, 11 aa, Homo Sapiens
IVRPSIVGASW

SEQ ID NO: 130130 - protein, 11 aa, Homo Sapiens
KAFAETHIKGF

SEQ ID NO: 130131 - protein, 11 aa, Homo Sapiens
KAIEEGVNHMW

SEQ ID NO: 130132 - protein, 11 aa, Homo Sapiens
KAKYPDYEVTW

SEQ ID NO: 130133 - protein, 11 aa, Homo Sapiens
KAVDCLLDSKW

SEQ ID NO: 130134 - protein, 11 aa, Homo Sapiens
KIQPDTIIQVW

SEQ ID NO: 130135 - protein, 11 aa, Homo Sapiens
KLKPFIDREWW

SEQ ID NO: 130136 - protein, 11 aa, Homo Sapiens
KLSPEELLLRW

SEQ ID NO: 130137 - protein, 11 aa, Homo Sapiens
KSFETDTNLNF

SEQ ID NO: 130138 - protein, 11 aa, Homo Sapiens
KSFGSAQEFAW

SEQ ID NO: 130139 - protein, 11 aa, Homo Sapiens
KSFGWPSFITY

SEQ ID NO: 130140 - protein, 11 aa, Homo Sapiens
KSFPDTGSLNL

SEQ ID NO: 130141 - protein, 11 aa, Homo Sapiens
KSFSDTLKTYF

SEQ ID NO: 130142 - protein, 11 aa, Homo Sapiens
KSFSKSDLVNW

SEQ ID NO: 130143 - protein, 11 aa, Homo Sapiens
KSIDAGPVDAW

SEQ ID NO: 130144 - protein, 11 aa, Homo Sapiens
KSKAMTGVEQW

SEQ ID NO: 130145 - protein, 11 aa, Homo Sapiens
KSKEDLVSQGF

SEQ ID NO: 130146 - protein, 11 aa, Homo Sapiens
KSKLDAEVSKW

SEQ ID NO: 130147 - protein, 11 aa, Homo Sapiens
KSLESLDTSLF

SEQ ID NO: 130148 - protein, 11 aa, Homo Sapiens
KSLGVQDLLQF

SEQ ID NO: 130149 - protein, 11 aa, Homo Sapiens
KSLPEEDVAEI

SEQ ID NO: 130150 - protein, 11 aa, Homo Sapiens
KSRDLFVSTSW

SEQ ID NO: 130151 - protein, 11 aa, Homo Sapiens
KSVSAAEQQLW

SEQ ID NO: 130152 - protein, 11 aa, Homo Sapiens
KSYELPDGQVI

SEQ ID NO: 130153 - protein, 11 aa, Homo Sapiens
KSYLGSEADVW

SEQ ID NO: 130154 - protein, 11 aa, Homo Sapiens
KSYPGSQSQLF

SEQ ID NO: 130155 - protein, 11 aa, Homo Sapiens
KTATELSTVYL

SEQ ID NO: 130156 - protein, 11 aa, Homo Sapiens
KTAVICQLDYW

SEQ ID NO: 130157 - protein, 11 aa, Homo Sapiens
KTFLHDPLVEW

SEQ ID NO: 130158 - protein, 11 aa, Homo Sapiens
KTIPSQILEVM

SEQ ID NO: 130159 - protein, 11 aa, Homo Sapiens
KTIQTIALITY

SEQ ID NO: 130160 - protein, 11 aa, Homo Sapiens
KTLEEKLRSLF

SEQ ID NO: 130161 - protein, 11 aa, Homo Sapiens
KTLGFNLESGW

SEQ ID NO: 130162 - protein, 11 aa, Homo Sapiens
KTLPADVQNYY

SEQ ID NO: 130163 - protein, 11 aa, Homo Sapiens
KTLVNPANVTF

SEQ ID NO: 130164 - protein, 11 aa, Homo Sapiens
KTVDGPSGKLW

SEQ ID NO: 130165 - protein, 11 aa, Homo Sapiens
KTVYTGIDHHW

SEQ ID NO: 130166 - protein, 11 aa, Homo Sapiens
KTYNEPGSQVF

SEQ ID NO: 130167 - protein, 11 aa, Homo Sapiens
KTYSYLTPDLW

SEQ ID NO: 130168 - protein, 11 aa, Homo Sapiens
KVDEVKSTIKF

SEQ ID NO: 130169 - protein, 11 aa, Homo Sapiens
KVIHEQVNHRW

SEQ ID NO: 130170 - protein, 11 aa, Homo Sapiens
KVLKEIVERVF

SEQ ID NO: 130171 - protein, 11 aa, Homo Sapiens
LALDPSLVPTF

SEQ ID NO: 130172 - protein, 11 aa, Homo Sapiens
LARPSSTITYL

SEQ ID NO: 130173 - protein, 11 aa, Homo Sapiens
LGITAGAHRLW

SEQ ID NO: 130174 - protein, 11 aa, Homo Sapiens
LGTLPPEIQAW

SEQ ID NO: 130175 - protein, 11 aa, Homo Sapiens
LSALPADTQAW

SEQ ID NO: 130176 - protein, 11 aa, Homo Sapiens
LSDPDEVARRW

SEQ ID NO: 130177 - protein, 11 aa, Homo Sapiens
LSKRNPRQINW

SEQ ID NO: 130178 - protein, 11 aa, Homo Sapiens
LSLGVAALYKF

SEQ ID NO: 130179 - protein, 11 aa, Homo Sapiens
LTKQGGLVKTW

SEQ ID NO: 130180 - protein, 11 aa, Homo Sapiens
LTTNEDIKGSW

SEQ ID NO: 130181 - protein, 11 aa, Homo Sapiens
LTVKLPDGYEF

SEQ ID NO: 130182 - protein, 11 aa, Homo Sapiens
NSIKPQELLEW

SEQ ID NO: 130183 - protein, 11 aa, Homo Sapiens
QSDPSGAYFAW

SEQ ID NO: 130184 - protein, 11 aa, Homo Sapiens
QSLPSKTKVAW

SEQ ID NO: 130185 - protein, 11 aa, Homo Sapiens
QSLPSSVLHII

SEQ ID NO: 130186 - protein, 11 aa, Homo Sapiens
QTDPSGTYHAW

SEQ ID NO: 130187 - protein, 11 aa, Homo Sapiens
QTIRLPAQSIW

SEQ ID NO: 130188 - protein, 11 aa, Homo Sapiens
QTLTDYDIRFY

SEQ ID NO: 130189 - protein, 11 aa, Homo Sapiens
RAAEEFVNVYY

SEQ ID NO: 130190 - protein, 11 aa, Homo Sapiens
RAAGALSKRYW

SEQ ID NO: 130191 - protein, 11 aa, Homo Sapiens
RAALSDTVALW

SEQ ID NO: 130192 - protein, 11 aa, Homo Sapiens
RAFTCDDLFRF

SEQ ID NO: 130193 - protein, 11 aa, Homo Sapiens
RALDIPLVKNW

SEQ ID NO: 130194 - protein, 11 aa, Homo Sapiens
RALEAEKRALW

SEQ ID NO: 130195 - protein, 11 aa, Homo Sapiens
RALGTEVIQLF

SEQ ID NO: 130196 - protein, 11 aa, Homo Sapiens
RARLEESRRLW

SEQ ID NO: 130197 - protein, 11 aa, Homo Sapiens
RASITPGTILI

SEQ ID NO: 130198 - protein, 11 aa, Homo Sapiens
RASTLLSKVFL

SEQ ID NO: 130199 - protein, 11 aa, Homo Sapiens
RMLDPSIKGTF

SEQ ID NO: 130200 - protein, 11 aa, Homo Sapiens
RSDESVGNVTF

SEQ ID NO: 130201 - protein, 11 aa, Homo Sapiens
RSFDKGPFATF

SEQ ID NO: 130202 - protein, 11 aa, Homo Sapiens
RSFIFKGEDNW

SEQ ID NO: 130203 - protein, 11 aa, Homo Sapiens
RSIPAITRYWF

SEQ ID NO: 130204 - protein, 11 aa, Homo Sapiens
RSLEVLIGSGY

SEQ ID NO: 130205 - protein, 11 aa, Homo Sapiens
RSLPDPNLITF

SEQ ID NO: 130206 - protein, 11 aa, Homo Sapiens
RSLPHITDVSW

SEQ ID NO: 130207 - protein, 11 aa, Homo Sapiens
RSSSYLDNLVW

SEQ ID NO: 130208 - protein, 11 aa, Homo Sapiens
RSWLTAASTSW

SEQ ID NO: 130209 - protein, 11 aa, Homo Sapiens
RTIADSLINSF

SEQ ID NO: 130210 - protein, 11 aa, Homo Sapiens
RTIQTPIGSTW

SEQ ID NO: 130211 - protein, 11 aa, Homo Sapiens
RTKDLIIEQRF

SEQ ID NO: 130212 - protein, 11 aa, Homo Sapiens
RTLGTPDEVVW

SEQ ID NO: 130213 - protein, 11 aa, Homo Sapiens
RTLPTNTLMGF

SEQ ID NO: 130214 - protein, 11 aa, Homo Sapiens
RTNPNSGDFRF

SEQ ID NO: 130215 - protein, 11 aa, Homo Sapiens
RTRNEELAQTW

SEQ ID NO: 130216 - protein, 11 aa, Homo Sapiens
RTRPAANPIQF

SEQ ID NO: 130217 - protein, 11 aa, Homo Sapiens
RTVENMSIIGW

SEQ ID NO: 130218 - protein, 11 aa, Homo Sapiens
RVDPAKGLFYF

SEQ ID NO: 130219 - protein, 11 aa, Homo Sapiens
RVDPNGFFLYW

SEQ ID NO: 130220 - protein, 11 aa, Homo Sapiens
RVDPNGSRYLL

SEQ ID NO: 130221 - protein, 11 aa, Homo Sapiens
RVFEDESGKHW

SEQ ID NO: 130222 - protein, 11 aa, Homo Sapiens
RVIPHDVLPDW

SEQ ID NO: 130223 - protein, 11 aa, Homo Sapiens
RVIPYDVLPDW

SEQ ID NO: 130224 - protein, 11 aa, Homo Sapiens
RVLPPSHRVTW

SEQ ID NO: 130225 - protein, 11 aa, Homo Sapiens
RVLPYPFTHHW

SEQ ID NO: 130226 - protein, 11 aa, Homo Sapiens
RVYPESIPRKF

SEQ ID NO: 130227 - protein, 11 aa, Homo Sapiens
SAAADSAVRLW

SEQ ID NO: 130228 - protein, 11 aa, Homo Sapiens
SANEILGSLRW

SEQ ID NO: 130229 - protein, 11 aa, Homo Sapiens
SASPDATIRIW

SEQ ID NO: 130230 - protein, 11 aa, Homo Sapiens
SASRDKTIIMW

SEQ ID NO: 130231 - protein, 11 aa, Homo Sapiens
SGSSDGTIRLW

SEQ ID NO: 130232 - protein, 11 aa, Homo Sapiens
SIQGQHTISPL

SEQ ID NO: 130233 - protein, 11 aa, Homo Sapiens
SSATDAAIRVW

SEQ ID NO: 130234 - protein, 11 aa, Homo Sapiens
SSKPVLPTSGW

SEQ ID NO: 130235 - protein, 11 aa, Homo Sapiens
SSLPSPLQPSW

SEQ ID NO: 130236 - protein, 11 aa, Homo Sapiens
SSREGAITFTW

SEQ ID NO: 130237 - protein, 11 aa, Homo Sapiens
SSSAAVKDTLW

SEQ ID NO: 130238 - protein, 11 aa, Homo Sapiens
SSSLDAHIRLW

SEQ ID NO: 130239 - protein, 11 aa, Homo Sapiens
SSSPTHSLYVF

SEQ ID NO: 130240 - protein, 11 aa, Homo Sapiens
SSSQLVSHLLF

SEQ ID NO: 130241 - protein, 11 aa, Homo Sapiens
STFLEDGIRMW

SEQ ID NO: 130242 - protein, 11 aa, Homo Sapiens
STLKDTRLLTF

SEQ ID NO: 130243 - protein, 11 aa, Homo Sapiens
STSGIHAITVF

SEQ ID NO: 130244 - protein, 11 aa, Homo Sapiens
STSTFLSQTTY

SEQ ID NO: 130245 - protein, 11 aa, Homo Sapiens
SVIPARIIHNW

SEQ ID NO: 130246 - protein, 11 aa, Homo Sapiens
SVSKDHALRLW

SEQ ID NO: 130247 - protein, 11 aa, Homo Sapiens
SVTVPANVQRW

SEQ ID NO: 130248 - protein, 11 aa, Homo Sapiens
TGSTDKTVRLW

SEQ ID NO: 130249 - protein, 11 aa, Homo Sapiens
TPDETYVPKAF

SEQ ID NO: 130250 - protein, 11 aa, Homo Sapiens
TSASLDISRKW

SEQ ID NO: 130251 - protein, 11 aa, Homo Sapiens
TSYRDFLGTNW

SEQ ID NO: 130252 - protein, 11 aa, Homo Sapiens
TTKGSSISIQW

SEQ ID NO: 130253 - protein, 11 aa, Homo Sapiens
TTRILSDTTLW

SEQ ID NO: 130254 - protein, 11 aa, Homo Sapiens
TTVPNTIVVSW

SEQ ID NO: 130255 - protein, 11 aa, Homo Sapiens
TVSQLDSVRVW

SEQ ID NO: 130256 - protein, 11 aa, Homo Sapiens
VGLPAAGKTTW

SEQ ID NO: 130257 - protein, 11 aa, Homo Sapiens
VSAAIGTNLRR

SEQ ID NO: 130258 - protein, 11 aa, Homo Sapiens
VSAPLSTIINW

SEQ ID NO: 130259 - protein, 11 aa, Homo Sapiens
VSFEEDDKIRW

SEQ ID NO: 130260 - protein, 11 aa, Homo Sapiens
VSFPDVEKAEW

SEQ ID NO: 130261 - protein, 11 aa, Homo Sapiens
VSIPGNLFSLW

SEQ ID NO: 130262 - protein, 11 aa, Homo Sapiens
VSLPAPGVPAW

SEQ ID NO: 130263 - protein, 11 aa, Homo Sapiens
VSLPSHLNISY

SEQ ID NO: 130264 - protein, 11 aa, Homo Sapiens
VSNTASYLRLW

SEQ ID NO: 130265 - protein, 11 aa, Homo Sapiens
VTFPIPDLQKY

SEQ ID NO: 130266 - protein, 11 aa, Homo Sapiens
VTKPNNIKSMF

SEQ ID NO: 130267 - protein, 11 aa, Homo Sapiens
VTLHDQGTAQW

SEQ ID NO: 130268 - protein, 11 aa, Homo Sapiens
VTRSMEDFVTW

SEQ ID NO: 130269 - protein, 11 aa, Homo Sapiens
VTSIGTAIRYW

SEQ ID NO: 130270 - protein, 11 aa, Homo Sapiens
VVDPVHGFMYW

SEQ ID NO: 130271 - protein, 11 aa, Homo Sapiens
VVIPDPDILTF

SEQ ID NO: 130272 - protein, 11 aa, Homo Sapiens
VVSPHEDMRTW

SEQ ID NO: 130273 - protein, 11 aa, Homo Sapiens
VVVPAEWIKNW

SEQ ID NO: 130274 - protein, 11 aa, Homo Sapiens
YRVSLQENVPW

SEQ ID NO: 130275 - protein, 8 aa, Homo Sapiens
AKEIIQHF

SEQ ID NO: 130276 - protein, 8 aa, Homo Sapiens
ALQQAKED

SEQ ID NO: 130277 - protein, 8 aa, Homo Sapiens
ATGPSIKI

SEQ ID NO: 130278 - protein, 8 aa, Homo Sapiens
FNEKSKEL

SEQ ID NO: 130279 - protein, 8 aa, Homo Sapiens
HSGPFFTF

SEQ ID NO: 130280 - protein, 8 aa, Homo Sapiens
HSVEVHKW

SEQ ID NO: 130281 - protein, 8 aa, Homo Sapiens
ISAKPLEM

SEQ ID NO: 130282 - protein, 8 aa, Homo Sapiens
ISISAVQW

SEQ ID NO: 130283 - protein, 8 aa, Homo Sapiens
ISQEPVLF

SEQ ID NO: 130284 - protein, 8 aa, Homo Sapiens
ITAGAHRL

SEQ ID NO: 130285 - protein, 8 aa, Homo Sapiens
ITAHPERW

SEQ ID NO: 130286 - protein, 8 aa, Homo Sapiens
ITDKAREF

SEQ ID NO: 130287 - protein, 8 aa, Homo Sapiens
KSFVLPSW

SEQ ID NO: 130288 - protein, 8 aa, Homo Sapiens
KSNSAVAW

SEQ ID NO: 130289 - protein, 8 aa, Homo Sapiens
KSWHPQTL

SEQ ID NO: 130290 - protein, 8 aa, Homo Sapiens
KTFKPIDL

SEQ ID NO: 130291 - protein, 8 aa, Homo Sapiens
KTKKPLLI

SEQ ID NO: 130292 - protein, 8 aa, Homo Sapiens
KTNVPVKL

SEQ ID NO: 130293 - protein, 8 aa, Homo Sapiens
KTTILYKL

SEQ ID NO: 130294 - protein, 8 aa, Homo Sapiens
KTYKPMGF

SEQ ID NO: 130295 - protein, 8 aa, Homo Sapiens
KTYRPELI

SEQ ID NO: 130296 - protein, 8 aa, Homo Sapiens
LNNMRSQY

SEQ ID NO: 130297 - protein, 8 aa, Homo Sapiens
LQQAKEDL

SEQ ID NO: 130298 - protein, 8 aa, Homo Sapiens
LTGPALQW

SEQ ID NO: 130299 - protein, 8 aa, Homo Sapiens
LTLKPVKF

SEQ ID NO: 130300 - protein, 8 aa, Homo Sapiens
MSGPAWQL

SEQ ID NO: 130301 - protein, 8 aa, Homo Sapiens
NNRSLDLD

SEQ ID NO: 130302 - protein, 8 aa, Homo Sapiens
PDLLVNVL

SEQ ID NO: 130303 - protein, 8 aa, Homo Sapiens
PTKQTQTF

SEQ ID NO: 130304 - protein, 8 aa, Homo Sapiens
QAPKPRKQ

SEQ ID NO: 130305 - protein, 8 aa, Homo Sapiens
QRVKEKEA

SEQ ID NO: 130306 - protein, 8 aa, Homo Sapiens
QSLKELYI

SEQ ID NO: 130307 - protein, 8 aa, Homo Sapiens
RSDKPKLF

SEQ ID NO: 130308 - protein, 8 aa, Homo Sapiens
RSFKAQVF

SEQ ID NO: 130309 - protein, 8 aa, Homo Sapiens
RSFKATKF

SEQ ID NO: 130310 - protein, 8 aa, Homo Sapiens
RSFRPLLF

SEQ ID NO: 130311 - protein, 8 aa, Homo Sapiens
RSMKGLRW

SEQ ID NO: 130312 - protein, 8 aa, Homo Sapiens
RTAKALAM

SEQ ID NO: 130313 - protein, 8 aa, Homo Sapiens
RTFDPLLF

SEQ ID NO: 130314 - protein, 8 aa, Homo Sapiens
RTSRPLKI

SEQ ID NO: 130315 - protein, 8 aa, Homo Sapiens
SELKNMQD

SEQ ID NO: 130316 - protein, 8 aa, Homo Sapiens
SISAVQWL

SEQ ID NO: 130317 - protein, 8 aa, Homo Sapiens
STVRLYEW

SEQ ID NO: 130318 - protein, 8 aa, Homo Sapiens
TNHIHVRI

SEQ ID NO: 130319 - protein, 8 aa, Homo Sapiens
TTKAISRW

SEQ ID NO: 130320 - protein, 8 aa, Homo Sapiens
TVGNNKTL

SEQ ID NO: 130321 - protein, 8 aa, Homo Sapiens
VSFIPLNI

SEQ ID NO: 130322 - protein, 8 aa, Homo Sapiens
YTLLLHTW

SEQ ID NO: 130323 - protein, 8 aa, Homo Sapiens
YTQPPLKF

SEQ ID NO: 130324 - protein, 9 aa, Homo Sapiens
AAAKIQASF

SEQ ID NO: 130325 - protein, 9 aa, Homo Sapiens
AACKVLIEF

SEQ ID NO: 130326 - protein, 9 aa, Homo Sapiens
AACRVIARL

SEQ ID NO: 130327 - protein, 9 aa, Homo Sapiens
AAIREQVRF

SEQ ID NO: 130328 - protein, 9 aa, Homo Sapiens
AALPAAALW

SEQ ID NO: 130329 - protein, 9 aa, Homo Sapiens
AANPHSFVF

SEQ ID NO: 130330 - protein, 9 aa, Homo Sapiens
ASAIIIQRW

SEQ ID NO: 130331 - protein, 9 aa, Homo Sapiens
ASAPLGARW

SEQ ID NO: 130332 - protein, 9 aa, Homo Sapiens
ASAQIHCQF

SEQ ID NO: 130333 - protein, 9 aa, Homo Sapiens
ASAVLSWKL

SEQ ID NO: 130334 - protein, 9 aa, Homo Sapiens
ASCVFQVKF

SEQ ID NO: 130335 - protein, 9 aa, Homo Sapiens
ASFGSFHLI

SEQ ID NO: 130336 - protein, 9 aa, Homo Sapiens
ASFIGGIRW

SEQ ID NO: 130337 - protein, 9 aa, Homo Sapiens
ASFPGANII

SEQ ID NO: 130338 - protein, 9 aa, Homo Sapiens
ASFPLNASF

SEQ ID NO: 130339 - protein, 9 aa, Homo Sapiens
ASFTRAYLL

SEQ ID NO: 130340 - protein, 9 aa, Homo Sapiens
ASHKGQKLW

SEQ ID NO: 130341 - protein, 9 aa, Homo Sapiens
ASHLHIHVF

SEQ ID NO: 130342 - protein, 9 aa, Homo Sapiens
ASKEEATTF

SEQ ID NO: 130343 - protein, 9 aa, Homo Sapiens
ASLAIKPVF

SEQ ID NO: 130344 - protein, 9 aa, Homo Sapiens
ASLKNLETI

SEQ ID NO: 130345 - protein, 9 aa, Homo Sapiens
ASLKSNYNL

SEQ ID NO: 130346 - protein, 9 aa, Homo Sapiens
ASLLLHNKF

SEQ ID NO: 130347 - protein, 9 aa, Homo Sapiens
ASLPEAQVW

SEQ ID NO: 130348 - protein, 9 aa, Homo Sapiens
ASLPFFEVF

SEQ ID NO: 130349 - protein, 9 aa, Homo Sapiens
ASLPLRVSF

SEQ ID NO: 130350 - protein, 9 aa, Homo Sapiens
ASLPQAATF

SEQ ID NO: 130351 - protein, 9 aa, Homo Sapiens
ASNGDVYAW

SEQ ID NO: 130352 - protein, 9 aa, Homo Sapiens
ASNKLQIVF

SEQ ID NO: 130353 - protein, 9 aa, Homo Sapiens
ASNKYLVEF

SEQ ID NO: 130354 - protein, 9 aa, Homo Sapiens
ASNPRVTRF

SEQ ID NO: 130355 - protein, 9 aa, Homo Sapiens
ASPPSPARW

SEQ ID NO: 130356 - protein, 9 aa, Homo Sapiens
ASRDTVIVW

SEQ ID NO: 130357 - protein, 9 aa, Homo Sapiens
ASSQLKEHF

SEQ ID NO: 130358 - protein, 9 aa, Homo Sapiens
ASTKMLDRW

SEQ ID NO: 130359 - protein, 9 aa, Homo Sapiens
ASVEQFWRF

SEQ ID NO: 130360 - protein, 9 aa, Homo Sapiens
ASVKVVSKF

SEQ ID NO: 130361 - protein, 9 aa, Homo Sapiens
ASVPIMYSW

SEQ ID NO: 130362 - protein, 9 aa, Homo Sapiens
ASYFLISMF

SEQ ID NO: 130363 - protein, 9 aa, Homo Sapiens
ASYRQVASF

SEQ ID NO: 130364 - protein, 9 aa, Homo Sapiens
ASYVNLPTI

SEQ ID NO: 130365 - protein, 9 aa, Homo Sapiens
ATADISDVW

SEQ ID NO: 130366 - protein, 9 aa, Homo Sapiens
ATADVEWRW

SEQ ID NO: 130367 - protein, 9 aa, Homo Sapiens
ATALIEDIF

SEQ ID NO: 130368 - protein, 9 aa, Homo Sapiens
ATANLEAKW

SEQ ID NO: 130369 - protein, 9 aa, Homo Sapiens
ATAPLTELL

SEQ ID NO: 130370 - protein, 9 aa, Homo Sapiens
ATAPVVALF

SEQ ID NO: 130371 - protein, 9 aa, Homo Sapiens
ATCKDLVMF

SEQ ID NO: 130372 - protein, 9 aa, Homo Sapiens
ATCNVEQSF

SEQ ID NO: 130373 - protein, 9 aa, Homo Sapiens
ATDGKVLLW

SEQ ID NO: 130374 - protein, 9 aa, Homo Sapiens
ATHRIPIIW

SEQ ID NO: 130375 - protein, 9 aa, Homo Sapiens
ATIGHVEKF

SEQ ID NO: 130376 - protein, 9 aa, Homo Sapiens
ATIKEIVVW

SEQ ID NO: 130377 - protein, 9 aa, Homo Sapiens
ATIRFHDLL

SEQ ID NO: 130378 - protein, 9 aa, Homo Sapiens
ATIRLLDVL

SEQ ID NO: 130379 - protein, 9 aa, Homo Sapiens
ATKIEKELF

SEQ ID NO: 130380 - protein, 9 aa, Homo Sapiens
ATKKEITFF

SEQ ID NO: 130381 - protein, 9 aa, Homo Sapiens
ATKNAEPLI

SEQ ID NO: 130382 - protein, 9 aa, Homo Sapiens
ATLELTHNW

SEQ ID NO: 130383 - protein, 9 aa, Homo Sapiens
ATLKGNAAW

SEQ ID NO: 130384 - protein, 9 aa, Homo Sapiens
ATLKINNEI

SEQ ID NO: 130385 - protein, 9 aa, Homo Sapiens
ATLKNPILW

SEQ ID NO: 130386 - protein, 9 aa, Homo Sapiens
ATLPDNIKF

SEQ ID NO: 130387 - protein, 9 aa, Homo Sapiens
ATLSVVPQL

SEQ ID NO: 130388 - protein, 9 aa, Homo Sapiens
ATNPESKVF

SEQ ID NO: 130389 - protein, 9 aa, Homo Sapiens
ATNRIISHF

SEQ ID NO: 130390 - protein, 9 aa, Homo Sapiens
ATNRITVTW

SEQ ID NO: 130391 - protein, 9 aa, Homo Sapiens
ATNVNNWHW

SEQ ID NO: 130392 - protein, 9 aa, Homo Sapiens
ATRPDYISW

SEQ ID NO: 130393 - protein, 9 aa, Homo Sapiens
ATSKTQTRL

SEQ ID NO: 130394 - protein, 9 aa, Homo Sapiens
ATSKYLIGW

SEQ ID NO: 130395 - protein, 9 aa, Homo Sapiens
ATSNVFAMF

SEQ ID NO: 130396 - protein, 9 aa, Homo Sapiens
ATSQAQAGW

SEQ ID NO: 130397 - protein, 9 aa, Homo Sapiens
ATVATQTQF

SEQ ID NO: 130398 - protein, 9 aa, Homo Sapiens
ATWKSNYFL

SEQ ID NO: 130399 - protein, 9 aa, Homo Sapiens
ATYAAAVLF

SEQ ID NO: 130400 - protein, 9 aa, Homo Sapiens
ATYDKGYQF

SEQ ID NO: 130401 - protein, 9 aa, Homo Sapiens
ATYIFLQTF

SEQ ID NO: 130402 - protein, 9 aa, Homo Sapiens
ATYMKPEMW

SEQ ID NO: 130403 - protein, 9 aa, Homo Sapiens
ATYNEIVTF

SEQ ID NO: 130404 - protein, 9 aa, Homo Sapiens
ATYVFLHTV

SEQ ID NO: 130405 - protein, 9 aa, Homo Sapiens
AVCEVVTQF

SEQ ID NO: 130406 - protein, 9 aa, Homo Sapiens
AVCRLSVKF

SEQ ID NO: 130407 - protein, 9 aa, Homo Sapiens
AVIAIVPVF

SEQ ID NO: 130408 - protein, 9 aa, Homo Sapiens
AVIILNHNF

SEQ ID NO: 130409 - protein, 9 aa, Homo Sapiens
AVLQKVALW

SEQ ID NO: 130410 - protein, 9 aa, Homo Sapiens
AVWTRAYGW

SEQ ID NO: 130411 - protein, 9 aa, Homo Sapiens
CTITDVQLF

SEQ ID NO: 130412 - protein, 9 aa, Homo Sapiens
CTYGKPVTF

SEQ ID NO: 130413 - protein, 9 aa, Homo Sapiens
EALALTQTW

SEQ ID NO: 130414 - protein, 9 aa, Homo Sapiens
EALKQLAEW

SEQ ID NO: 130415 - protein, 9 aa, Homo Sapiens
ESWKTKVNW

SEQ ID NO: 130416 - protein, 9 aa, Homo Sapiens
ETIKCRTLF

SEQ ID NO: 130417 - protein, 9 aa, Homo Sapiens
ETLKLISGW

SEQ ID NO: 130418 - protein, 9 aa, Homo Sapiens
FGLRTPPLI

SEQ ID NO: 130419 - protein, 9 aa, Homo Sapiens
FSFKKPFKL

SEQ ID NO: 130420 - protein, 9 aa, Homo Sapiens
FSFKKSFKL

SEQ ID NO: 130421 - protein, 9 aa, Homo Sapiens
FSHRIYVAY

SEQ ID NO: 130422 - protein, 9 aa, Homo Sapiens
FSKKCSERW

SEQ ID NO: 130423 - protein, 9 aa, Homo Sapiens
FSLPAQPLW

SEQ ID NO: 130424 - protein, 9 aa, Homo Sapiens
FSLPLKPVI

SEQ ID NO: 130425 - protein, 9 aa, Homo Sapiens
FSLPNIPRW

SEQ ID NO: 130426 - protein, 9 aa, Homo Sapiens
FSSREQPKL

SEQ ID NO: 130427 - protein, 9 aa, Homo Sapiens
FSYRDVNSW

SEQ ID NO: 130428 - protein, 9 aa, Homo Sapiens
FTVPVRPFF

SEQ ID NO: 130429 - protein, 9 aa, Homo Sapiens
GAVALTETW

SEQ ID NO: 130430 - protein, 9 aa, Homo Sapiens
GAVRENYTW

SEQ ID NO: 130431 - protein, 9 aa, Homo Sapiens
GPASSLPQS

SEQ ID NO: 130432 - protein, 9 aa, Homo Sapiens
GSASVNSRW

SEQ ID NO: 130433 - protein, 9 aa, Homo Sapiens
GSDKLYHQW

SEQ ID NO: 130434 - protein, 9 aa, Homo Sapiens
GSFKNPSSF

SEQ ID NO: 130435 - protein, 9 aa, Homo Sapiens
GSIALIVLY

SEQ ID NO: 130436 - protein, 9 aa, Homo Sapiens
GSIPVTLTF

SEQ ID NO: 130437 - protein, 9 aa, Homo Sapiens
GSLSTTSHF

SEQ ID NO: 130438 - protein, 9 aa, Homo Sapiens
GSMGLRSLW

SEQ ID NO: 130439 - protein, 9 aa, Homo Sapiens
GSMPLKNSF

SEQ ID NO: 130440 - protein, 9 aa, Homo Sapiens
GSNPHLQTF

SEQ ID NO: 130441 - protein, 9 aa, Homo Sapiens
GSQGRAYLF

SEQ ID NO: 130442 - protein, 9 aa, Homo Sapiens
GSSEVQPQF

SEQ ID NO: 130443 - protein, 9 aa, Homo Sapiens
GSVLLDKRF

SEQ ID NO: 130444 - protein, 9 aa, Homo Sapiens
GSWDKTLKF

SEQ ID NO: 130445 - protein, 9 aa, Homo Sapiens
GSYAVQAKF

SEQ ID NO: 130446 - protein, 9 aa, Homo Sapiens
GSYGSLARF

SEQ ID NO: 130447 - protein, 9 aa, Homo Sapiens
GTAMIFTCF

SEQ ID NO: 130448 - protein, 9 aa, Homo Sapiens
GTCKALYTF

SEQ ID NO: 130449 - protein, 9 aa, Homo Sapiens
GTDRNAYVW

SEQ ID NO: 130450 - protein, 9 aa, Homo Sapiens
GTFNPVSLW

SEQ ID NO: 130451 - protein, 9 aa, Homo Sapiens
GTGKLFWVF

SEQ ID NO: 130452 - protein, 9 aa, Homo Sapiens
GTHKVTVLF

SEQ ID NO: 130453 - protein, 9 aa, Homo Sapiens
GTHSLDIKW

SEQ ID NO: 130454 - protein, 9 aa, Homo Sapiens
GTHTVSVKY

SEQ ID NO: 130455 - protein, 9 aa, Homo Sapiens
GTIAIKHYF

SEQ ID NO: 130456 - protein, 9 aa, Homo Sapiens
GTIPELPTF

SEQ ID NO: 130457 - protein, 9 aa, Homo Sapiens
GTISREHPW

SEQ ID NO: 130458 - protein, 9 aa, Homo Sapiens
GTLETKYKW

SEQ ID NO: 130459 - protein, 9 aa, Homo Sapiens
GTLKERVQW

SEQ ID NO: 130460 - protein, 9 aa, Homo Sapiens
GTLKGHNGW

SEQ ID NO: 130461 - protein, 9 aa, Homo Sapiens
GTLSGHASW

SEQ ID NO: 130462 - protein, 9 aa, Homo Sapiens
GTLVSHVTL

SEQ ID NO: 130463 - protein, 9 aa, Homo Sapiens
GTLVSKITF

SEQ ID NO: 130464 - protein, 9 aa, Homo Sapiens
GTMDIRHFF

SEQ ID NO: 130465 - protein, 9 aa, Homo Sapiens
GTMPLRNIF

SEQ ID NO: 130466 - protein, 9 aa, Homo Sapiens
GTRQAEPEL

SEQ ID NO: 130467 - protein, 9 aa, Homo Sapiens
GTSKVLVLL

SEQ ID NO: 130468 - protein, 9 aa, Homo Sapiens
GTTTLAFKF

SEQ ID NO: 130469 - protein, 9 aa, Homo Sapiens
GTTVIQTRF

SEQ ID NO: 130470 - protein, 9 aa, Homo Sapiens
GTVITPDTW

SEQ ID NO: 130471 - protein, 9 aa, Homo Sapiens
GTYAGPVLW

SEQ ID NO: 130472 - protein, 9 aa, Homo Sapiens
GTYGVRAAW

SEQ ID NO: 130473 - protein, 9 aa, Homo Sapiens
GTYIGGVTF

SEQ ID NO: 130474 - protein, 9 aa, Homo Sapiens
GTYSPEISW

SEQ ID NO: 130475 - protein, 9 aa, Homo Sapiens
GTYYFTEYF

SEQ ID NO: 130476 - protein, 9 aa, Homo Sapiens
GVHTIDVKF

SEQ ID NO: 130477 - protein, 9 aa, Homo Sapiens
GVHTVHVTF

SEQ ID NO: 130478 - protein, 9 aa, Homo Sapiens
HACGVIATI

SEQ ID NO: 130479 - protein, 9 aa, Homo Sapiens
HAGNINFKW

SEQ ID NO: 130480 - protein, 9 aa, Homo Sapiens
HAGPIVSVW

SEQ ID NO: 130481 - protein, 9 aa, Homo Sapiens
HAIPLRSSW

SEQ ID NO: 130482 - protein, 9 aa, Homo Sapiens
HAIQYVVEF

SEQ ID NO: 130483 - protein, 9 aa, Homo Sapiens
HALALAWTF

SEQ ID NO: 130484 - protein, 9 aa, Homo Sapiens
HALEALIHF

SEQ ID NO: 130485 - protein, 9 aa, Homo Sapiens
HALICISHW

SEQ ID NO: 130486 - protein, 9 aa, Homo Sapiens
HAMEEVKKF

SEQ ID NO: 130487 - protein, 9 aa, Homo Sapiens
HARAAEPLL

SEQ ID NO: 130488 - protein, 9 aa, Homo Sapiens
HARPEEPSW

SEQ ID NO: 130489 - protein, 9 aa, Homo Sapiens
HATKAIYRW

SEQ ID NO: 130490 - protein, 9 aa, Homo Sapiens
HIAKLQELW

SEQ ID NO: 130491 - protein, 9 aa, Homo Sapiens
HSAEILAEI

SEQ ID NO: 130492 - protein, 9 aa, Homo Sapiens
HSAILDQKL

SEQ ID NO: 130493 - protein, 9 aa, Homo Sapiens
HSCDALNRW

SEQ ID NO: 130494 - protein, 9 aa, Homo Sapiens
HSCLFRHSW

SEQ ID NO: 130495 - protein, 9 aa, Homo Sapiens
HSFLYQPDW

SEQ ID NO: 130496 - protein, 9 aa, Homo Sapiens
HSFPLQFTL

SEQ ID NO: 130497 - protein, 9 aa, Homo Sapiens
HSFQISLHF

SEQ ID NO: 130498 - protein, 9 aa, Homo Sapiens
HSGPFESKF

SEQ ID NO: 130499 - protein, 9 aa, Homo Sapiens
HSGPSKWNW

SEQ ID NO: 130500 - protein, 9 aa, Homo Sapiens
HSHFQNIFW

SEQ ID NO: 130501 - protein, 9 aa, Homo Sapiens
HSHPGFGCW

SEQ ID NO: 130502 - protein, 9 aa, Homo Sapiens
HSIPSLPRF

SEQ ID NO: 130503 - protein, 9 aa, Homo Sapiens
HSKELITAW

SEQ ID NO: 130504 - protein, 9 aa, Homo Sapiens
HSLAITNNF

SEQ ID NO: 130505 - protein, 9 aa, Homo Sapiens
HSLESQVTF

SEQ ID NO: 130506 - protein, 9 aa, Homo Sapiens
HSLPALIQI

SEQ ID NO: 130507 - protein, 9 aa, Homo Sapiens
HSLVIDVTM

SEQ ID NO: 130508 - protein, 9 aa, Homo Sapiens
HSNGTVSLW

SEQ ID NO: 130509 - protein, 9 aa, Homo Sapiens
HSNPSAYRM

SEQ ID NO: 130510 - protein, 9 aa, Homo Sapiens
HSQVCSILW

SEQ ID NO: 130511 - protein, 9 aa, Homo Sapiens
HSRPEIIFL

SEQ ID NO: 130512 - protein, 9 aa, Homo Sapiens
HSRPEQDKF

SEQ ID NO: 130513 - protein, 9 aa, Homo Sapiens
HSRSEPQYF

SEQ ID NO: 130514 - protein, 9 aa, Homo Sapiens
HSSELAPKF

SEQ ID NO: 130515 - protein, 9 aa, Homo Sapiens
HSSGILPKW

SEQ ID NO: 130516 - protein, 9 aa, Homo Sapiens
HSSNVKVVL

SEQ ID NO: 130517 - protein, 9 aa, Homo Sapiens
HSSVVNYEF

SEQ ID NO: 130518 - protein, 9 aa, Homo Sapiens
HSTQMQELF

SEQ ID NO: 130519 - protein, 9 aa, Homo Sapiens
HSTRFVTYF

SEQ ID NO: 130520 - protein, 9 aa, Homo Sapiens
HSVELRNMF

SEQ ID NO: 130521 - protein, 9 aa, Homo Sapiens
HSYFWPLEW

SEQ ID NO: 130522 - protein, 9 aa, Homo Sapiens
HSYPGASGW

SEQ ID NO: 130523 - protein, 9 aa, Homo Sapiens
HSYSVLERF

SEQ ID NO: 130524 - protein, 9 aa, Homo Sapiens
HTADISSHF

SEQ ID NO: 130525 - protein, 9 aa, Homo Sapiens
HTAHIACKF

SEQ ID NO: 130526 - protein, 9 aa, Homo Sapiens
HTANIQTLI

SEQ ID NO: 130527 - protein, 9 aa, Homo Sapiens
HTEMVAELW

SEQ ID NO: 130528 - protein, 9 aa, Homo Sapiens
HTFLPKIFF

SEQ ID NO: 130529 - protein, 9 aa, Homo Sapiens
HTFSPSPKL

SEQ ID NO: 130530 - protein, 9 aa, Homo Sapiens
HTGCFATIW

SEQ ID NO: 130531 - protein, 9 aa, Homo Sapiens
HTIQIRQDW

SEQ ID NO: 130532 - protein, 9 aa, Homo Sapiens
HTLEIEDTF

SEQ ID NO: 130533 - protein, 9 aa, Homo Sapiens
HTLTTKIKF

SEQ ID NO: 130534 - protein, 9 aa, Homo Sapiens
HTMDPQLRL

SEQ ID NO: 130535 - protein, 9 aa, Homo Sapiens
HTMTSQIVF

SEQ ID NO: 130536 - protein, 9 aa, Homo Sapiens
HTNPVGTEW

SEQ ID NO: 130537 - protein, 9 aa, Homo Sapiens
HTQENCETW

SEQ ID NO: 130538 - protein, 9 aa, Homo Sapiens
HTSSTTSAW

SEQ ID NO: 130539 - protein, 9 aa, Homo Sapiens
HTTGMDVLW

SEQ ID NO: 130540 - protein, 9 aa, Homo Sapiens
HTVGLSSTW

SEQ ID NO: 130541 - protein, 9 aa, Homo Sapiens
HTVPDMGKW

SEQ ID NO: 130542 - protein, 9 aa, Homo Sapiens
IAAIIVSQW

SEQ ID NO: 130543 - protein, 9 aa, Homo Sapiens
IAAQTGTRW

SEQ ID NO: 130544 - protein, 9 aa, Homo Sapiens
IAHLFNVEW

SEQ ID NO: 130545 - protein, 9 aa, Homo Sapiens
IAIPVTVAF

SEQ ID NO: 130546 - protein, 9 aa, Homo Sapiens
IALPPIAKW

SEQ ID NO: 130547 - protein, 9 aa, Homo Sapiens
IAPPKPASW

SEQ ID NO: 130548 - protein, 9 aa, Homo Sapiens
IAPRILTNF

SEQ ID NO: 130549 - protein, 9 aa, Homo Sapiens
IARAEVASF

SEQ ID NO: 130550 - protein, 9 aa, Homo Sapiens
IASPVQPVL

SEQ ID NO: 130551 - protein, 9 aa, Homo Sapiens
IGCRTIVYW

SEQ ID NO: 130552 - protein, 9 aa, Homo Sapiens
IGWDKHYGF

SEQ ID NO: 130553 - protein, 9 aa, Homo Sapiens
IIFVPVPQL

SEQ ID NO: 130554 - protein, 9 aa, Homo Sapiens
IIMKDVPDW

SEQ ID NO: 130555 - protein, 9 aa, Homo Sapiens
ILKGFDPLL

SEQ ID NO: 130556 - protein, 9 aa, Homo Sapiens
IMSRCIPLW

SEQ ID NO: 130557 - protein, 9 aa, Homo Sapiens
IQAPLVYHF

SEQ ID NO: 130558 - protein, 9 aa, Homo Sapiens
ISAEAPVLF

SEQ ID NO: 130559 - protein, 9 aa, Homo Sapiens
ISAGYAPVL

SEQ ID NO: 130560 - protein, 9 aa, Homo Sapiens
ISCKEELLL

SEQ ID NO: 130561 - protein, 9 aa, Homo Sapiens
ISCRIINTF

SEQ ID NO: 130562 - protein, 9 aa, Homo Sapiens
ISFHFTPVL

SEQ ID NO: 130563 - protein, 9 aa, Homo Sapiens
ISFPDPKML

SEQ ID NO: 130564 - protein, 9 aa, Homo Sapiens
ISFPLKEYF

SEQ ID NO: 130565 - protein, 9 aa, Homo Sapiens
ISGHHPETW

SEQ ID NO: 130566 - protein, 9 aa, Homo Sapiens
ISHQVDPEF

SEQ ID NO: 130567 - protein, 9 aa, Homo Sapiens
ISHVAHVTI

SEQ ID NO: 130568 - protein, 9 aa, Homo Sapiens
ISKALVAYY

SEQ ID NO: 130569 - protein, 9 aa, Homo Sapiens
ISKEEAMRW

SEQ ID NO: 130570 - protein, 9 aa, Homo Sapiens
ISKPDVITL

SEQ ID NO: 130571 - protein, 9 aa, Homo Sapiens
ISKQFHHQL

SEQ ID NO: 130572 - protein, 9 aa, Homo Sapiens
ISLHDPVSI

SEQ ID NO: 130573 - protein, 9 aa, Homo Sapiens
ISLKENRHW

SEQ ID NO: 130574 - protein, 9 aa, Homo Sapiens
ISLKFYKEL

SEQ ID NO: 130575 - protein, 9 aa, Homo Sapiens
ISLRPAQSF

SEQ ID NO: 130576 - protein, 9 aa, Homo Sapiens
ISMKILNSL

SEQ ID NO: 130577 - protein, 9 aa, Homo Sapiens
ISMRCMVQF

SEQ ID NO: 130578 - protein, 9 aa, Homo Sapiens
ISNPKTAEF

SEQ ID NO: 130579 - protein, 9 aa, Homo Sapiens
ISPGLDITF

SEQ ID NO: 130580 - protein, 9 aa, Homo Sapiens
ISPRFDVQL

SEQ ID NO: 130581 - protein, 9 aa, Homo Sapiens
ISPRSDATF

SEQ ID NO: 130582 - protein, 9 aa, Homo Sapiens
ISPSIPITF

SEQ ID NO: 130583 - protein, 9 aa, Homo Sapiens
ISPTIVQQF

SEQ ID NO: 130584 - protein, 9 aa, Homo Sapiens
ISQKIIPLL

SEQ ID NO: 130585 - protein, 9 aa, Homo Sapiens
ISRGEMDSF

SEQ ID NO: 130586 - protein, 9 aa, Homo Sapiens
ISRPIVNLF

SEQ ID NO: 130587 - protein, 9 aa, Homo Sapiens
ISSGVVSIW

SEQ ID NO: 130588 - protein, 9 aa, Homo Sapiens
ISSPVVTSL

SEQ ID NO: 130589 - protein, 9 aa, Homo Sapiens
ISSSAGARW

SEQ ID NO: 130590 - protein, 9 aa, Homo Sapiens
ISTEVNPKL

SEQ ID NO: 130591 - protein, 9 aa, Homo Sapiens
ISTPVIRTF

SEQ ID NO: 130592 - protein, 9 aa, Homo Sapiens
ISVAEVEKW

SEQ ID NO: 130593 - protein, 9 aa, Homo Sapiens
ISVILGDRW

SEQ ID NO: 130594 - protein, 9 aa, Homo Sapiens
ISVIQKEEF

SEQ ID NO: 130595 - protein, 9 aa, Homo Sapiens
ISVKGSNLF

SEQ ID NO: 130596 - protein, 9 aa, Homo Sapiens
ISVPIFKQF

SEQ ID NO: 130597 - protein, 9 aa, Homo Sapiens
ISVRQQVVL

SEQ ID NO: 130598 - protein, 9 aa, Homo Sapiens
ISWGPSPTF

SEQ ID NO: 130599 - protein, 9 aa, Homo Sapiens
ISWGQGHFW

SEQ ID NO: 130600 - protein, 9 aa, Homo Sapiens
ISYKGTPAM

SEQ ID NO: 130601 - protein, 9 aa, Homo Sapiens
ITAGAHRLW

SEQ ID NO: 130602 - protein, 9 aa, Homo Sapiens
ITAHVEPLL

SEQ ID NO: 130603 - protein, 9 aa, Homo Sapiens
ITCPKVNQF

SEQ ID NO: 130604 - protein, 9 aa, Homo Sapiens
ITFAPTYRF

SEQ ID NO: 130605 - protein, 9 aa, Homo Sapiens
ITFEGKVAF

SEQ ID NO: 130606 - protein, 9 aa, Homo Sapiens
ITFTKNNQF

SEQ ID NO: 130607 - protein, 9 aa, Homo Sapiens
ITHIVNQNF

SEQ ID NO: 130608 - protein, 9 aa, Homo Sapiens
ITIIGLICF

SEQ ID NO: 130609 - protein, 9 aa, Homo Sapiens
ITIPKNMHW

SEQ ID NO: 130610 - protein, 9 aa, Homo Sapiens
ITKGQTILL

SEQ ID NO: 130611 - protein, 9 aa, Homo Sapiens
ITKKQVSVW

SEQ ID NO: 130612 - protein, 9 aa, Homo Sapiens
ITKRKEVIF

SEQ ID NO: 130613 - protein, 9 aa, Homo Sapiens
ITLIPTCKF

SEQ ID NO: 130614 - protein, 9 aa, Homo Sapiens
ITLQEQVKL

SEQ ID NO: 130615 - protein, 9 aa, Homo Sapiens
ITNHIHVRI

SEQ ID NO: 130616 - protein, 9 aa, Homo Sapiens
ITNKYQLVF

SEQ ID NO: 130617 - protein, 9 aa, Homo Sapiens
ITQRAQVSL

SEQ ID NO: 130618 - protein, 9 aa, Homo Sapiens
ITRTKEEAL

SEQ ID NO: 130619 - protein, 9 aa, Homo Sapiens
ITRTQEEKL

SEQ ID NO: 130620 - protein, 9 aa, Homo Sapiens
ITSPTGETW

SEQ ID NO: 130621 - protein, 9 aa, Homo Sapiens
ITSPVHVSF

SEQ ID NO: 130622 - protein, 9 aa, Homo Sapiens
ITTDVLYTI

SEQ ID NO: 130623 - protein, 9 aa, Homo Sapiens
ITTKAISRW

SEQ ID NO: 130624 - protein, 9 aa, Homo Sapiens
ITTSLTTKW

SEQ ID NO: 130625 - protein, 9 aa, Homo Sapiens
ITTTINPRF

SEQ ID NO: 130626 - protein, 9 aa, Homo Sapiens
ITTVIQHVF

SEQ ID NO: 130627 - protein, 9 aa, Homo Sapiens
ITTVVLPTL

SEQ ID NO: 130628 - protein, 9 aa, Homo Sapiens
ITTVVVQTF

SEQ ID NO: 130629 - protein, 9 aa, Homo Sapiens
ITVKDGKTL

SEQ ID NO: 130630 - protein, 9 aa, Homo Sapiens
ITVKNPAVM

SEQ ID NO: 130631 - protein, 9 aa, Homo Sapiens
ITWQSVEYF

SEQ ID NO: 130632 - protein, 9 aa, Homo Sapiens
ITWTPPAIF

SEQ ID NO: 130633 - protein, 9 aa, Homo Sapiens
ITYDKLNKW

SEQ ID NO: 130634 - protein, 9 aa, Homo Sapiens
ITYPMLFKL

SEQ ID NO: 130635 - protein, 9 aa, Homo Sapiens
ITYQHIDRW

SEQ ID NO: 130636 - protein, 9 aa, Homo Sapiens
ITYTFHSTW

SEQ ID NO: 130637 - protein, 9 aa, Homo Sapiens
IVCPIRYEW

SEQ ID NO: 130638 - protein, 9 aa, Homo Sapiens
IVLKKWYTI

SEQ ID NO: 130639 - protein, 9 aa, Homo Sapiens
KAADLKNLF

SEQ ID NO: 130640 - protein, 9 aa, Homo Sapiens
KAAELSIKF

SEQ ID NO: 130641 - protein, 9 aa, Homo Sapiens
KAAEVYTRL

SEQ ID NO: 130642 - protein, 9 aa, Homo Sapiens
KAAHVSEQF

SEQ ID NO: 130643 - protein, 9 aa, Homo Sapiens
KAAKLKEKY

SEQ ID NO: 130644 - protein, 9 aa, Homo Sapiens
KAASLKSNY

SEQ ID NO: 130645 - protein, 9 aa, Homo Sapiens
KAASVRPVL

SEQ ID NO: 130646 - protein, 9 aa, Homo Sapiens
KAAVLLHLL

SEQ ID NO: 130647 - protein, 9 aa, Homo Sapiens
KAAVMVHQL

SEQ ID NO: 130648 - protein, 9 aa, Homo Sapiens
KACFLYFKL

SEQ ID NO: 130649 - protein, 9 aa, Homo Sapiens
KACTIAIRY

SEQ ID NO: 130650 - protein, 9 aa, Homo Sapiens
KACVVKREF

SEQ ID NO: 130651 - protein, 9 aa, Homo Sapiens
KACYLPWVI

SEQ ID NO: 130652 - protein, 9 aa, Homo Sapiens
KADENHPQF

SEQ ID NO: 130653 - protein, 9 aa, Homo Sapiens
KADKVTMLW

SEQ ID NO: 130654 - protein, 9 aa, Homo Sapiens
KAFDFPSSF

SEQ ID NO: 130655 - protein, 9 aa, Homo Sapiens
KAFDKHMNL

SEQ ID NO: 130656 - protein, 9 aa, Homo Sapiens
KAFDLIEHY

SEQ ID NO: 130657 - protein, 9 aa, Homo Sapiens
KAFDQRLTF

SEQ ID NO: 130658 - protein, 9 aa, Homo Sapiens
KAFDRPSLF

SEQ ID NO: 130659 - protein, 9 aa, Homo Sapiens
KAFDYPSLF

SEQ ID NO: 130660 - protein, 9 aa, Homo Sapiens
KAFDYPSRF

SEQ ID NO: 130661 - protein, 9 aa, Homo Sapiens
KAFNHPATL

SEQ ID NO: 130662 - protein, 9 aa, Homo Sapiens
KAFNLRISF

SEQ ID NO: 130663 - protein, 9 aa, Homo Sapiens
KAFPFHIIF

SEQ ID NO: 130664 - protein, 9 aa, Homo Sapiens
KAFQATLRW

SEQ ID NO: 130665 - protein, 9 aa, Homo Sapiens
KAFSTRWNW

SEQ ID NO: 130666 - protein, 9 aa, Homo Sapiens
KAFTHRSTF

SEQ ID NO: 130667 - protein, 9 aa, Homo Sapiens
KAGIIQDTW

SEQ ID NO: 130668 - protein, 9 aa, Homo Sapiens
KAGQVVTIW

SEQ ID NO: 130669 - protein, 9 aa, Homo Sapiens
KAIEENNNF

SEQ ID NO: 130670 - protein, 9 aa, Homo Sapiens
KAIEKNVLF

SEQ ID NO: 130671 - protein, 9 aa, Homo Sapiens
KAIELLQEF

SEQ ID NO: 130672 - protein, 9 aa, Homo Sapiens
KAIETQPNF

SEQ ID NO: 130673 - protein, 9 aa, Homo Sapiens
KAIGLFISF

SEQ ID NO: 130674 - protein, 9 aa, Homo Sapiens
KAIKELEEW

SEQ ID NO: 130675 - protein, 9 aa, Homo Sapiens
KAINPINTF

SEQ ID NO: 130676 - protein, 9 aa, Homo Sapiens
KAISKNVLF

SEQ ID NO: 130677 - protein, 9 aa, Homo Sapiens
KAKPDEPEF

SEQ ID NO: 130678 - protein, 9 aa, Homo Sapiens
KAKSEEFRF

SEQ ID NO: 130679 - protein, 9 aa, Homo Sapiens
KALDDKNCW

SEQ ID NO: 130680 - protein, 9 aa, Homo Sapiens
KALDKIAEI

SEQ ID NO: 130681 - protein, 9 aa, Homo Sapiens
KALDQFVNF

SEQ ID NO: 130682 - protein, 9 aa, Homo Sapiens
KALDYCHSM

SEQ ID NO: 130683 - protein, 9 aa, Homo Sapiens
KALEIITDF

SEQ ID NO: 130684 - protein, 9 aa, Homo Sapiens
KALEKGIEI

SEQ ID NO: 130685 - protein, 9 aa, Homo Sapiens
KALEMVPLL

SEQ ID NO: 130686 - protein, 9 aa, Homo Sapiens
KALEVFPEF

SEQ ID NO: 130687 - protein, 9 aa, Homo Sapiens
KALEYVFKF

SEQ ID NO: 130688 - protein, 9 aa, Homo Sapiens
KALGAIVYI

SEQ ID NO: 130689 - protein, 9 aa, Homo Sapiens
KALKGQFNF

SEQ ID NO: 130690 - protein, 9 aa, Homo Sapiens
KALKRIHQF

SEQ ID NO: 130691 - protein, 9 aa, Homo Sapiens
KALPELIYY

SEQ ID NO: 130692 - protein, 9 aa, Homo Sapiens
KALQEKVEI

SEQ ID NO: 130693 - protein, 9 aa, Homo Sapiens
KALQVMTDF

SEQ ID NO: 130694 - protein, 9 aa, Homo Sapiens
KALSMPEKW

SEQ ID NO: 130695 - protein, 9 aa, Homo Sapiens
KAMGIMNSF

SEQ ID NO: 130696 - protein, 9 aa, Homo Sapiens
KAMKQGFEF

SEQ ID NO: 130697 - protein, 9 aa, Homo Sapiens
KAMNQQTTL

SEQ ID NO: 130698 - protein, 9 aa, Homo Sapiens
KAMPLQPSI

SEQ ID NO: 130699 - protein, 9 aa, Homo Sapiens
KAMSAAVCF

SEQ ID NO: 130700 - protein, 9 aa, Homo Sapiens
KAMTGVEQW

SEQ ID NO: 130701 - protein, 9 aa, Homo Sapiens
KAMVFLEYF

SEQ ID NO: 130702 - protein, 9 aa, Homo Sapiens
KANPALYVL

SEQ ID NO: 130703 - protein, 9 aa, Homo Sapiens
KAPEYLHRF

SEQ ID NO: 130704 - protein, 9 aa, Homo Sapiens
KAPSVASSW

SEQ ID NO: 130705 - protein, 9 aa, Homo Sapiens
KARLAEPQL

SEQ ID NO: 130706 - protein, 9 aa, Homo Sapiens
KASDLYITL

SEQ ID NO: 130707 - protein, 9 aa, Homo Sapiens
KASNLLLGF

SEQ ID NO: 130708 - protein, 9 aa, Homo Sapiens
KASPTQNLF

SEQ ID NO: 130709 - protein, 9 aa, Homo Sapiens
KATNVCTRF

SEQ ID NO: 130710 - protein, 9 aa, Homo Sapiens
KATPIKLIW

SEQ ID NO: 130711 - protein, 9 aa, Homo Sapiens
KAVEAAHTF

SEQ ID NO: 130712 - protein, 9 aa, Homo Sapiens
KAVETVHNL

SEQ ID NO: 130713 - protein, 9 aa, Homo Sapiens
KAVFLVPKW

SEQ ID NO: 130714 - protein, 9 aa, Homo Sapiens
KAVKGKYKF

SEQ ID NO: 130715 - protein, 9 aa, Homo Sapiens
KAVTHQVKF

SEQ ID NO: 130716 - protein, 9 aa, Homo Sapiens
KAWENSPSL

SEQ ID NO: 130717 - protein, 9 aa, Homo Sapiens
KAWHQKSHF

SEQ ID NO: 130718 - protein, 9 aa, Homo Sapiens
KAWTKQNTL

SEQ ID NO: 130719 - protein, 9 aa, Homo Sapiens
KAYEALYNF

SEQ ID NO: 130720 - protein, 9 aa, Homo Sapiens
KAYFILDEF

SEQ ID NO: 130721 - protein, 9 aa, Homo Sapiens
KAYGASKTF

SEQ ID NO: 130722 - protein, 9 aa, Homo Sapiens
KAYRLTPKL

SEQ ID NO: 130723 - protein, 9 aa, Homo Sapiens
KAYSEAHEI

SEQ ID NO: 130724 - protein, 9 aa, Homo Sapiens
KGFLFLHTL

SEQ ID NO: 130725 - protein, 9 aa, Homo Sapiens
KGIEKLYEW

SEQ ID NO: 130726 - protein, 9 aa, Homo Sapiens
KIADLCHTF

SEQ ID NO: 130727 - protein, 9 aa, Homo Sapiens
KICDIAINW

SEQ ID NO: 130728 - protein, 9 aa, Homo Sapiens
KICEVDLVI

SEQ ID NO: 130729 - protein, 9 aa, Homo Sapiens
KIHPMAYQL

SEQ ID NO: 130730 - protein, 9 aa, Homo Sapiens
KIIFIDSTW

SEQ ID NO: 130731 - protein, 9 aa, Homo Sapiens
KIIPKTLTW

SEQ ID NO: 130732 - protein, 9 aa, Homo Sapiens
KIIPLVVKF

SEQ ID NO: 130733 - protein, 9 aa, Homo Sapiens
KIISTLPSW

SEQ ID NO: 130734 - protein, 9 aa, Homo Sapiens
KIKSFEVVF

SEQ ID NO: 130735 - protein, 9 aa, Homo Sapiens
KIKYPENFF

SEQ ID NO: 130736 - protein, 9 aa, Homo Sapiens
KILEENPKF

SEQ ID NO: 130737 - protein, 9 aa, Homo Sapiens
KILENAQRF

SEQ ID NO: 130738 - protein, 9 aa, Homo Sapiens
KILPFSPEF

SEQ ID NO: 130739 - protein, 9 aa, Homo Sapiens
KIREYEQTL

SEQ ID NO: 130740 - protein, 9 aa, Homo Sapiens
KIWTSEHVF

SEQ ID NO: 130741 - protein, 9 aa, Homo Sapiens
KLAYMPHTF

SEQ ID NO: 130742 - protein, 9 aa, Homo Sapiens
KLCDIIVHI

SEQ ID NO: 130743 - protein, 9 aa, Homo Sapiens
KLFDIRPIW

SEQ ID NO: 130744 - protein, 9 aa, Homo Sapiens
KLIEFLSKF

SEQ ID NO: 130745 - protein, 9 aa, Homo Sapiens
KLIEFMDTF

SEQ ID NO: 130746 - protein, 9 aa, Homo Sapiens
KLYPWIHQF

SEQ ID NO: 130747 - protein, 9 aa, Homo Sapiens
KMLDESFQW

SEQ ID NO: 130748 - protein, 9 aa, Homo Sapiens
KSADWVSDW

SEQ ID NO: 130749 - protein, 9 aa, Homo Sapiens
KSAFVRTQW

SEQ ID NO: 130750 - protein, 9 aa, Homo Sapiens
KSAIPHPLI

SEQ ID NO: 130751 - protein, 9 aa, Homo Sapiens
KSALVFITF

SEQ ID NO: 130752 - protein, 9 aa, Homo Sapiens
KSANPPHTI

SEQ ID NO: 130753 - protein, 9 aa, Homo Sapiens
KSAQPIEKF

SEQ ID NO: 130754 - protein, 9 aa, Homo Sapiens
KSCDLLLFL

SEQ ID NO: 130755 - protein, 9 aa, Homo Sapiens
KSCEKIHFI

SEQ ID NO: 130756 - protein, 9 aa, Homo Sapiens
KSCGLNPKL

SEQ ID NO: 130757 - protein, 9 aa, Homo Sapiens
KSCMNQVTI

SEQ ID NO: 130758 - protein, 9 aa, Homo Sapiens
KSCQSFISW

SEQ ID NO: 130759 - protein, 9 aa, Homo Sapiens
KSCVIVIRV

SEQ ID NO: 130760 - protein, 9 aa, Homo Sapiens
KSCVIVLRI

SEQ ID NO: 130761 - protein, 9 aa, Homo Sapiens
KSDPSIVRL

SEQ ID NO: 130762 - protein, 9 aa, Homo Sapiens
KSDQALHSF

SEQ ID NO: 130763 - protein, 9 aa, Homo Sapiens
KSFADINLY

SEQ ID NO: 130764 - protein, 9 aa, Homo Sapiens
KSFDFHFGF

SEQ ID NO: 130765 - protein, 9 aa, Homo Sapiens
KSFDNIKNW

SEQ ID NO: 130766 - protein, 9 aa, Homo Sapiens
KSFDNIRNW

SEQ ID NO: 130767 - protein, 9 aa, Homo Sapiens
KSFEAPIKL

SEQ ID NO: 130768 - protein, 9 aa, Homo Sapiens
KSFEGLFYF

SEQ ID NO: 130769 - protein, 9 aa, Homo Sapiens
KSFEGNVFM

SEQ ID NO: 130770 - protein, 9 aa, Homo Sapiens
KSFEKLMKI

SEQ ID NO: 130771 - protein, 9 aa, Homo Sapiens
KSFENISKW

SEQ ID NO: 130772 - protein, 9 aa, Homo Sapiens
KSFGGSHVM

SEQ ID NO: 130773 - protein, 9 aa, Homo Sapiens
KSFNRHLHF

SEQ ID NO: 130774 - protein, 9 aa, Homo Sapiens
KSFPSIFKF

SEQ ID NO: 130775 - protein, 9 aa, Homo Sapiens
KSFQAIHQF

SEQ ID NO: 130776 - protein, 9 aa, Homo Sapiens
KSFQIIAHL

SEQ ID NO: 130777 - protein, 9 aa, Homo Sapiens
KSFRSPSKL

SEQ ID NO: 130778 - protein, 9 aa, Homo Sapiens
KSFSHWSKL

SEQ ID NO: 130779 - protein, 9 aa, Homo Sapiens
KSFVKVYNY

SEQ ID NO: 130780 - protein, 9 aa, Homo Sapiens
KSGAIIEKW

SEQ ID NO: 130781 - protein, 9 aa, Homo Sapiens
KSGELLATW

SEQ ID NO: 130782 - protein, 9 aa, Homo Sapiens
KSGETSVRF

SEQ ID NO: 130783 - protein, 9 aa, Homo Sapiens
KSGKFVFSF

SEQ ID NO: 130784 - protein, 9 aa, Homo Sapiens
KSGLNIAHF

SEQ ID NO: 130785 - protein, 9 aa, Homo Sapiens
KSGPFGKKY

SEQ ID NO: 130786 - protein, 9 aa, Homo Sapiens
KSGSPVATF

SEQ ID NO: 130787 - protein, 9 aa, Homo Sapiens
KSHDVQEVL

SEQ ID NO: 130788 - protein, 9 aa, Homo Sapiens
KSHFIEIFL

SEQ ID NO: 130789 - protein, 9 aa, Homo Sapiens
KSHLLVTGF

SEQ ID NO: 130790 - protein, 9 aa, Homo Sapiens
KSHTVVIGF

SEQ ID NO: 130791 - protein, 9 aa, Homo Sapiens
KSHVECARF

SEQ ID NO: 130792 - protein, 9 aa, Homo Sapiens
KSIDCIRAF

SEQ ID NO: 130793 - protein, 9 aa, Homo Sapiens
KSIDDTSNF

SEQ ID NO: 130794 - protein, 9 aa, Homo Sapiens
KSIDLIQKW

SEQ ID NO: 130795 - protein, 9 aa, Homo Sapiens
KSIELFYKF

SEQ ID NO: 130796 - protein, 9 aa, Homo Sapiens
KSIHIVVTM

SEQ ID NO: 130797 - protein, 9 aa, Homo Sapiens
KSIKNIQKI

SEQ ID NO: 130798 - protein, 9 aa, Homo Sapiens
KSIRNDIEW

SEQ ID NO: 130799 - protein, 9 aa, Homo Sapiens
KSIVIMVHI

SEQ ID NO: 130800 - protein, 9 aa, Homo Sapiens
KSIVQVETL

SEQ ID NO: 130801 - protein, 9 aa, Homo Sapiens
KSKLIALFW

SEQ ID NO: 130802 - protein, 9 aa, Homo Sapiens
KSKPDKQLI

SEQ ID NO: 130803 - protein, 9 aa, Homo Sapiens
KSKPFCEKL

SEQ ID NO: 130804 - protein, 9 aa, Homo Sapiens
KSKSEEIKI

SEQ ID NO: 130805 - protein, 9 aa, Homo Sapiens
KSKTLQEFL

SEQ ID NO: 130806 - protein, 9 aa, Homo Sapiens
KSKVEDPEI

SEQ ID NO: 130807 - protein, 9 aa, Homo Sapiens
KSKYFESKF

SEQ ID NO: 130808 - protein, 9 aa, Homo Sapiens
KSLAKLPEF

SEQ ID NO: 130809 - protein, 9 aa, Homo Sapiens
KSLEEAQEW

SEQ ID NO: 130810 - protein, 9 aa, Homo Sapiens
KSLEEIYLF

SEQ ID NO: 130811 - protein, 9 aa, Homo Sapiens
KSLEIEEKI

SEQ ID NO: 130812 - protein, 9 aa, Homo Sapiens
KSLEKSELI

SEQ ID NO: 130813 - protein, 9 aa, Homo Sapiens
KSLELHEEF

SEQ ID NO: 130814 - protein, 9 aa, Homo Sapiens
KSLENAIEW

SEQ ID NO: 130815 - protein, 9 aa, Homo Sapiens
KSLENQTYF

SEQ ID NO: 130816 - protein, 9 aa, Homo Sapiens
KSLERATQL

SEQ ID NO: 130817 - protein, 9 aa, Homo Sapiens
KSLFLGQKL

SEQ ID NO: 130818 - protein, 9 aa, Homo Sapiens
KSLGLRANL

SEQ ID NO: 130819 - protein, 9 aa, Homo Sapiens
KSLGPMILI

SEQ ID NO: 130820 - protein, 9 aa, Homo Sapiens
KSLGVHYVF

SEQ ID NO: 130821 - protein, 9 aa, Homo Sapiens
KSLGVTTKF

SEQ ID NO: 130822 - protein, 9 aa, Homo Sapiens
KSLIEKNSW

SEQ ID NO: 130823 - protein, 9 aa, Homo Sapiens
KSLITTHHL

SEQ ID NO: 130824 - protein, 9 aa, Homo Sapiens
KSLKLIISM

SEQ ID NO: 130825 - protein, 9 aa, Homo Sapiens
KSLKQEFEM

SEQ ID NO: 130826 - protein, 9 aa, Homo Sapiens
KSLKQNINL

SEQ ID NO: 130827 - protein, 9 aa, Homo Sapiens
KSLLFVNTL

SEQ ID NO: 130828 - protein, 9 aa, Homo Sapiens
KSLLKIFAW

SEQ ID NO: 130829 - protein, 9 aa, Homo Sapiens
KSLLVVHFW

SEQ ID NO: 130830 - protein, 9 aa, Homo Sapiens
KSLPASITM

SEQ ID NO: 130831 - protein, 9 aa, Homo Sapiens
KSLPDTELM

SEQ ID NO: 130832 - protein, 9 aa, Homo Sapiens
KSLRSLNNF

SEQ ID NO: 130833 - protein, 9 aa, Homo Sapiens
KSLVSKGTL

SEQ ID NO: 130834 - protein, 9 aa, Homo Sapiens
KSMCAGQRL

SEQ ID NO: 130835 - protein, 9 aa, Homo Sapiens
KSMPTVTQI

SEQ ID NO: 130836 - protein, 9 aa, Homo Sapiens
KSMTLKEAI

SEQ ID NO: 130837 - protein, 9 aa, Homo Sapiens
KSNELFTTF

SEQ ID NO: 130838 - protein, 9 aa, Homo Sapiens
KSNKLLYTF

SEQ ID NO: 130839 - protein, 9 aa, Homo Sapiens
KSNPKPLVL

SEQ ID NO: 130840 - protein, 9 aa, Homo Sapiens
KSPAITATL

SEQ ID NO: 130841 - protein, 9 aa, Homo Sapiens
KSQDLELSW

SEQ ID NO: 130842 - protein, 9 aa, Homo Sapiens
KSQEIFLNL

SEQ ID NO: 130843 - protein, 9 aa, Homo Sapiens
KSQELQSQI

SEQ ID NO: 130844 - protein, 9 aa, Homo Sapiens
KSQEVYENF

SEQ ID NO: 130845 - protein, 9 aa, Homo Sapiens
KSQHASETF

SEQ ID NO: 130846 - protein, 9 aa, Homo Sapiens
KSQIPLSKI

SEQ ID NO: 130847 - protein, 9 aa, Homo Sapiens
KSRDYEREI

SEQ ID NO: 130848 - protein, 9 aa, Homo Sapiens
KSREEDPTL

SEQ ID NO: 130849 - protein, 9 aa, Homo Sapiens
KSRPELLEY

SEQ ID NO: 130850 - protein, 9 aa, Homo Sapiens
KSRPEVITF

SEQ ID NO: 130851 - protein, 9 aa, Homo Sapiens
KSRPIIKRF

SEQ ID NO: 130852 - protein, 9 aa, Homo Sapiens
KSSDIAKTF

SEQ ID NO: 130853 - protein, 9 aa, Homo Sapiens
KSSEMNVLI

SEQ ID NO: 130854 - protein, 9 aa, Homo Sapiens
KSSEPVVTM

SEQ ID NO: 130855 - protein, 9 aa, Homo Sapiens
KSSEVFTTF

SEQ ID NO: 130856 - protein, 9 aa, Homo Sapiens
KSSIQKVVF

SEQ ID NO: 130857 - protein, 9 aa, Homo Sapiens
KSSKIMESF

SEQ ID NO: 130858 - protein, 9 aa, Homo Sapiens
KSSLLQVLI

SEQ ID NO: 130859 - protein, 9 aa, Homo Sapiens
KSSLTQHSW

SEQ ID NO: 130860 - protein, 9 aa, Homo Sapiens
KSSQLVTHL

SEQ ID NO: 130861 - protein, 9 aa, Homo Sapiens
KSSQVQRRF

SEQ ID NO: 130862 - protein, 9 aa, Homo Sapiens
KSSTVLHTF

SEQ ID NO: 130863 - protein, 9 aa, Homo Sapiens
KSTCVLEAF

SEQ ID NO: 130864 - protein, 9 aa, Homo Sapiens
KSTDVAKTF

SEQ ID NO: 130865 - protein, 9 aa, Homo Sapiens
KSTMLYNKF

SEQ ID NO: 130866 - protein, 9 aa, Homo Sapiens
KSTTTGHLI

SEQ ID NO: 130867 - protein, 9 aa, Homo Sapiens
KSVDWLLVF

SEQ ID NO: 130868 - protein, 9 aa, Homo Sapiens
KSVGVFEAF

SEQ ID NO: 130869 - protein, 9 aa, Homo Sapiens
KSVKIKTKL

SEQ ID NO: 130870 - protein, 9 aa, Homo Sapiens
KSVKVKIKL

SEQ ID NO: 130871 - protein, 9 aa, Homo Sapiens
KSVKYTVNF

SEQ ID NO: 130872 - protein, 9 aa, Homo Sapiens
KSVLVKQTI

SEQ ID NO: 130873 - protein, 9 aa, Homo Sapiens
KSVRLDVTL

SEQ ID NO: 130874 - protein, 9 aa, Homo Sapiens
KSVSFSDVF

SEQ ID NO: 130875 - protein, 9 aa, Homo Sapiens
KSVSQGFCF

SEQ ID NO: 130876 - protein, 9 aa, Homo Sapiens
KSVTAFFKW

SEQ ID NO: 130877 - protein, 9 aa, Homo Sapiens
KSVTLGYLF

SEQ ID NO: 130878 - protein, 9 aa, Homo Sapiens
KSVTQGFSF

SEQ ID NO: 130879 - protein, 9 aa, Homo Sapiens
KSWADVVKL

SEQ ID NO: 130880 - protein, 9 aa, Homo Sapiens
KSWDEARMF

SEQ ID NO: 130881 - protein, 9 aa, Homo Sapiens
KSWKGGGII

SEQ ID NO: 130882 - protein, 9 aa, Homo Sapiens
KSWKKIFNL

SEQ ID NO: 130883 - protein, 9 aa, Homo Sapiens
KSWVFGVHF

SEQ ID NO: 130884 - protein, 9 aa, Homo Sapiens
KSYDFLTGF

SEQ ID NO: 130885 - protein, 9 aa, Homo Sapiens
KSYDRNYRL

SEQ ID NO: 130886 - protein, 9 aa, Homo Sapiens
KSYEDATKI

SEQ ID NO: 130887 - protein, 9 aa, Homo Sapiens
KSYGNEKRF

SEQ ID NO: 130888 - protein, 9 aa, Homo Sapiens
KSYKDPATL

SEQ ID NO: 130889 - protein, 9 aa, Homo Sapiens
KSYKGRQII

SEQ ID NO: 130890 - protein, 9 aa, Homo Sapiens
KSYPLVHVV

SEQ ID NO: 130891 - protein, 9 aa, Homo Sapiens
KSYQSFQTF

SEQ ID NO: 130892 - protein, 9 aa, Homo Sapiens
KSYSKAFTL

SEQ ID NO: 130893 - protein, 9 aa, Homo Sapiens
KSYVQGVTW

SEQ ID NO: 130894 - protein, 9 aa, Homo Sapiens
KSYYHVYKL

SEQ ID NO: 130895 - protein, 9 aa, Homo Sapiens
KTADICQML

SEQ ID NO: 130896 - protein, 9 aa, Homo Sapiens
KTAEDMNLF

SEQ ID NO: 130897 - protein, 9 aa, Homo Sapiens
KTAEELMNF

SEQ ID NO: 130898 - protein, 9 aa, Homo Sapiens
KTAELQEEL

SEQ ID NO: 130899 - protein, 9 aa, Homo Sapiens
KTAENFRQF

SEQ ID NO: 130900 - protein, 9 aa, Homo Sapiens
KTAITVEHL

SEQ ID NO: 130901 - protein, 9 aa, Homo Sapiens
KTAKLASTF

SEQ ID NO: 130902 - protein, 9 aa, Homo Sapiens
KTAPFDSRF

SEQ ID NO: 130903 - protein, 9 aa, Homo Sapiens
KTAQNHPML

SEQ ID NO: 130904 - protein, 9 aa, Homo Sapiens
KTASQVHLM

SEQ ID NO: 130905 - protein, 9 aa, Homo Sapiens
KTATIGSRF

SEQ ID NO: 130906 - protein, 9 aa, Homo Sapiens
KTAVVVGTI

SEQ ID NO: 130907 - protein, 9 aa, Homo Sapiens
KTCDQVMEF

SEQ ID NO: 130908 - protein, 9 aa, Homo Sapiens
KTCNVLVAL

SEQ ID NO: 130909 - protein, 9 aa, Homo Sapiens
KTCPIQIKV

SEQ ID NO: 130910 - protein, 9 aa, Homo Sapiens
KTCRYIPSL

SEQ ID NO: 130911 - protein, 9 aa, Homo Sapiens
KTCSMKVHW

SEQ ID NO: 130912 - protein, 9 aa, Homo Sapiens
KTDIIDHSF

SEQ ID NO: 130913 - protein, 9 aa, Homo Sapiens
KTDKTLVLL

SEQ ID NO: 130914 - protein, 9 aa, Homo Sapiens
KTDVTVVRF

SEQ ID NO: 130915 - protein, 9 aa, Homo Sapiens
KTDWHRYNL

SEQ ID NO: 130916 - protein, 9 aa, Homo Sapiens
KTEALTQAF

SEQ ID NO: 130917 - protein, 9 aa, Homo Sapiens
KTFARYLSF

SEQ ID NO: 130918 - protein, 9 aa, Homo Sapiens
KTFDAPPAL

SEQ ID NO: 130919 - protein, 9 aa, Homo Sapiens
KTFEEIWKF

SEQ ID NO: 130920 - protein, 9 aa, Homo Sapiens
KTFEGFCAL

SEQ ID NO: 130921 - protein, 9 aa, Homo Sapiens
KTFESLVDF

SEQ ID NO: 130922 - protein, 9 aa, Homo Sapiens
KTFHPVPNL

SEQ ID NO: 130923 - protein, 9 aa, Homo Sapiens
KTFLFSATM

SEQ ID NO: 130924 - protein, 9 aa, Homo Sapiens
KTFLIPVLF

SEQ ID NO: 130925 - protein, 9 aa, Homo Sapiens
KTFNIKNDF

SEQ ID NO: 130926 - protein, 9 aa, Homo Sapiens
KTFPFHFMF

SEQ ID NO: 130927 - protein, 9 aa, Homo Sapiens
KTFPYQHRY

SEQ ID NO: 130928 - protein, 9 aa, Homo Sapiens
KTFQGKPIM

SEQ ID NO: 130929 - protein, 9 aa, Homo Sapiens
KTFQMAEYL

SEQ ID NO: 130930 - protein, 9 aa, Homo Sapiens
KTFRDKNTL

SEQ ID NO: 130931 - protein, 9 aa, Homo Sapiens
KTFSGKSNL

SEQ ID NO: 130932 - protein, 9 aa, Homo Sapiens
KTFTAKSTL

SEQ ID NO: 130933 - protein, 9 aa, Homo Sapiens
KTFTFDTVF

SEQ ID NO: 130934 - protein, 9 aa, Homo Sapiens
KTFTGHREW

SEQ ID NO: 130935 - protein, 9 aa, Homo Sapiens
KTFTTQETI

SEQ ID NO: 130936 - protein, 9 aa, Homo Sapiens
KTFVGRAKL

SEQ ID NO: 130937 - protein, 9 aa, Homo Sapiens
KTFVQKQTL

SEQ ID NO: 130938 - protein, 9 aa, Homo Sapiens
KTFVQKSTL

SEQ ID NO: 130939 - protein, 9 aa, Homo Sapiens
KTFVQRNMF

SEQ ID NO: 130940 - protein, 9 aa, Homo Sapiens
KTGEHTWSL

SEQ ID NO: 130941 - protein, 9 aa, Homo Sapiens
KTGETMIQW

SEQ ID NO: 130942 - protein, 9 aa, Homo Sapiens
KTGKFLKRF

SEQ ID NO: 130943 - protein, 9 aa, Homo Sapiens
KTGKNKWFF

SEQ ID NO: 130944 - protein, 9 aa, Homo Sapiens
KTGPFVVHW

SEQ ID NO: 130945 - protein, 9 aa, Homo Sapiens
KTGPKPVRF

SEQ ID NO: 130946 - protein, 9 aa, Homo Sapiens
KTGPVAKEL

SEQ ID NO: 130947 - protein, 9 aa, Homo Sapiens
KTHGEHVGF

SEQ ID NO: 130948 - protein, 9 aa, Homo Sapiens
KTHPGDPRF

SEQ ID NO: 130949 - protein, 9 aa, Homo Sapiens
KTHTIQGTI

SEQ ID NO: 130950 - protein, 9 aa, Homo Sapiens
KTIDAMDTW

SEQ ID NO: 130951 - protein, 9 aa, Homo Sapiens
KTIDGHINL

SEQ ID NO: 130952 - protein, 9 aa, Homo Sapiens
KTIDGQQTI

SEQ ID NO: 130953 - protein, 9 aa, Homo Sapiens
KTIDYIQFL

SEQ ID NO: 130954 - protein, 9 aa, Homo Sapiens
KTIETSPSL

SEQ ID NO: 130955 - protein, 9 aa, Homo Sapiens
KTIHKYVHL

SEQ ID NO: 130956 - protein, 9 aa, Homo Sapiens
KTIIIKDHL

SEQ ID NO: 130957 - protein, 9 aa, Homo Sapiens
KTIIKKLFF

SEQ ID NO: 130958 - protein, 9 aa, Homo Sapiens
KTIKLWNTL

SEQ ID NO: 130959 - protein, 9 aa, Homo Sapiens
KTILDPLTL

SEQ ID NO: 130960 - protein, 9 aa, Homo Sapiens
KTILERNNF

SEQ ID NO: 130961 - protein, 9 aa, Homo Sapiens
KTILPLINF

SEQ ID NO: 130962 - protein, 9 aa, Homo Sapiens
KTIQKAALL

SEQ ID NO: 130963 - protein, 9 aa, Homo Sapiens
KTISPEHVI

SEQ ID NO: 130964 - protein, 9 aa, Homo Sapiens
KTITDVINI

SEQ ID NO: 130965 - protein, 9 aa, Homo Sapiens
KTITQIEEF

SEQ ID NO: 130966 - protein, 9 aa, Homo Sapiens
KTKESSEYL

SEQ ID NO: 130967 - protein, 9 aa, Homo Sapiens
KTKETSVNW

SEQ ID NO: 130968 - protein, 9 aa, Homo Sapiens
KTKEVADCF

SEQ ID NO: 130969 - protein, 9 aa, Homo Sapiens
KTKEVIQEW

SEQ ID NO: 130970 - protein, 9 aa, Homo Sapiens
KTKFEQHTI

SEQ ID NO: 130971 - protein, 9 aa, Homo Sapiens
KTKGFHTTI

SEQ ID NO: 130972 - protein, 9 aa, Homo Sapiens
KTKIDIIRM

SEQ ID NO: 130973 - protein, 9 aa, Homo Sapiens
KTKIEVIRM

SEQ ID NO: 130974 - protein, 9 aa, Homo Sapiens
KTKQGGLRF

SEQ ID NO: 130975 - protein, 9 aa, Homo Sapiens
KTKRDINRF

SEQ ID NO: 130976 - protein, 9 aa, Homo Sapiens
KTLDLINKL

SEQ ID NO: 130977 - protein, 9 aa, Homo Sapiens
KTLDQIRTI

SEQ ID NO: 130978 - protein, 9 aa, Homo Sapiens
KTLELPHVF

SEQ ID NO: 130979 - protein, 9 aa, Homo Sapiens
KTLERSYLL

SEQ ID NO: 130980 - protein, 9 aa, Homo Sapiens
KTLETHIKI

SEQ ID NO: 130981 - protein, 9 aa, Homo Sapiens
KTLETQSAL

SEQ ID NO: 130982 - protein, 9 aa, Homo Sapiens
KTLGKLWRL

SEQ ID NO: 130983 - protein, 9 aa, Homo Sapiens
KTLHETVNF

SEQ ID NO: 130984 - protein, 9 aa, Homo Sapiens
KTLIEKERF

SEQ ID NO: 130985 - protein, 9 aa, Homo Sapiens
KTLLEKSQF

SEQ ID NO: 130986 - protein, 9 aa, Homo Sapiens
KTLNAHEHF

SEQ ID NO: 130987 - protein, 9 aa, Homo Sapiens
KTLNVESNF

SEQ ID NO: 130988 - protein, 9 aa, Homo Sapiens
KTLPAKAKI

SEQ ID NO: 130989 - protein, 9 aa, Homo Sapiens
KTLPCLVRM

SEQ ID NO: 130990 - protein, 9 aa, Homo Sapiens
KTLPDILTF

SEQ ID NO: 130991 - protein, 9 aa, Homo Sapiens
KTLPIPVQI

SEQ ID NO: 130992 - protein, 9 aa, Homo Sapiens
KTLPSKPSW

SEQ ID NO: 130993 - protein, 9 aa, Homo Sapiens
KTLPSMLIL

SEQ ID NO: 130994 - protein, 9 aa, Homo Sapiens
KTLPVAFKV

SEQ ID NO: 130995 - protein, 9 aa, Homo Sapiens
KTLQEVTQL

SEQ ID NO: 130996 - protein, 9 aa, Homo Sapiens
KTLQKKCYL

SEQ ID NO: 130997 - protein, 9 aa, Homo Sapiens
KTLQLEYRF

SEQ ID NO: 130998 - protein, 9 aa, Homo Sapiens
KTLQRAPTI

SEQ ID NO: 130999 - protein, 9 aa, Homo Sapiens
KTLSAILRI

SEQ ID NO: 131000 - protein, 9 aa, Homo Sapiens
KTLTQEEKI

SEQ ID NO: 131001 - protein, 9 aa, Homo Sapiens
KTLVQNNCL

SEQ ID NO: 131002 - protein, 9 aa, Homo Sapiens
KTLYHITLW

SEQ ID NO: 131003 - protein, 9 aa, Homo Sapiens
KTMETAEKL

SEQ ID NO: 131004 - protein, 9 aa, Homo Sapiens
KTMKQQLQF

SEQ ID NO: 131005 - protein, 9 aa, Homo Sapiens
KTMLLIAHY

SEQ ID NO: 131006 - protein, 9 aa, Homo Sapiens
KTMTDTYLL

SEQ ID NO: 131007 - protein, 9 aa, Homo Sapiens
KTNEMLLNF

SEQ ID NO: 131008 - protein, 9 aa, Homo Sapiens
KTNIIRDYL

SEQ ID NO: 131009 - protein, 9 aa, Homo Sapiens
KTNVAQIRM

SEQ ID NO: 131010 - protein, 9 aa, Homo Sapiens
KTPEEAALF

SEQ ID NO: 131011 - protein, 9 aa, Homo Sapiens
KTPGKAYLF

SEQ ID NO: 131012 - protein, 9 aa, Homo Sapiens
KTPPPVLIF

SEQ ID NO: 131013 - protein, 9 aa, Homo Sapiens
KTQDVEYIF

SEQ ID NO: 131014 - protein, 9 aa, Homo Sapiens
KTQDYVVGF

SEQ ID NO: 131015 - protein, 9 aa, Homo Sapiens
KTQEKIWEF

SEQ ID NO: 131016 - protein, 9 aa, Homo Sapiens
KTQGPRALW

SEQ ID NO: 131017 - protein, 9 aa, Homo Sapiens
KTQHLQELF

SEQ ID NO: 131018 - protein, 9 aa, Homo Sapiens
KTRDEYLSL

SEQ ID NO: 131019 - protein, 9 aa, Homo Sapiens
KTRQIISTI

SEQ ID NO: 131020 - protein, 9 aa, Homo Sapiens
KTRSVEQTL

SEQ ID NO: 131021 - protein, 9 aa, Homo Sapiens
KTRTNVPTF

SEQ ID NO: 131022 - protein, 9 aa, Homo Sapiens
KTRYIFDLF

SEQ ID NO: 131023 - protein, 9 aa, Homo Sapiens
KTSDLYQLF

SEQ ID NO: 131024 - protein, 9 aa, Homo Sapiens
KTSGIINKF

SEQ ID NO: 131025 - protein, 9 aa, Homo Sapiens
KTSKLQTAF

SEQ ID NO: 131026 - protein, 9 aa, Homo Sapiens
KTSNIRANF

SEQ ID NO: 131027 - protein, 9 aa, Homo Sapiens
KTSVLVVQF

SEQ ID NO: 131028 - protein, 9 aa, Homo Sapiens
KTSVMVNSF

SEQ ID NO: 131029 - protein, 9 aa, Homo Sapiens
KTSVSQNVI

SEQ ID NO: 131030 - protein, 9 aa, Homo Sapiens
KTTECSNTF

SEQ ID NO: 131031 - protein, 9 aa, Homo Sapiens
KTTKLYSRF

SEQ ID NO: 131032 - protein, 9 aa, Homo Sapiens
KTTNTVSKF

SEQ ID NO: 131033 - protein, 9 aa, Homo Sapiens
KTTREYYTF

SEQ ID NO: 131034 - protein, 9 aa, Homo Sapiens
KTVAIHTLW

SEQ ID NO: 131035 - protein, 9 aa, Homo Sapiens
KTVALGHRL

SEQ ID NO: 131036 - protein, 9 aa, Homo Sapiens
KTVAQSQQL

SEQ ID NO: 131037 - protein, 9 aa, Homo Sapiens
KTVDKFNEW

SEQ ID NO: 131038 - protein, 9 aa, Homo Sapiens
KTVEDYFCF

SEQ ID NO: 131039 - protein, 9 aa, Homo Sapiens
KTVEQHLRL

SEQ ID NO: 131040 - protein, 9 aa, Homo Sapiens
KTVPQKVTI

SEQ ID NO: 131041 - protein, 9 aa, Homo Sapiens
KTVQCKVTL

SEQ ID NO: 131042 - protein, 9 aa, Homo Sapiens
KTVVGGAMF

SEQ ID NO: 131043 - protein, 9 aa, Homo Sapiens
KTVVNKDVF

SEQ ID NO: 131044 - protein, 9 aa, Homo Sapiens
KTWHKGTLI

SEQ ID NO: 131045 - protein, 9 aa, Homo Sapiens
KTWKGSIGL

SEQ ID NO: 131046 - protein, 9 aa, Homo Sapiens
KTWKVDVVL

SEQ ID NO: 131047 - protein, 9 aa, Homo Sapiens
KTYDKTVAL

SEQ ID NO: 131048 - protein, 9 aa, Homo Sapiens
KTYDLLFKL

SEQ ID NO: 131049 - protein, 9 aa, Homo Sapiens
KTYDYLFKL

SEQ ID NO: 131050 - protein, 9 aa, Homo Sapiens
KTYPPFVNF

SEQ ID NO: 131051 - protein, 9 aa, Homo Sapiens
KTYTDRVFF

SEQ ID NO: 131052 - protein, 9 aa, Homo Sapiens
KVADPVVTF

SEQ ID NO: 131053 - protein, 9 aa, Homo Sapiens
KVAELFEKL

SEQ ID NO: 131054 - protein, 9 aa, Homo Sapiens
KVAELKQEL

SEQ ID NO: 131055 - protein, 9 aa, Homo Sapiens
KVASALEKW

SEQ ID NO: 131056 - protein, 9 aa, Homo Sapiens
KVCVEHHTF

SEQ ID NO: 131057 - protein, 9 aa, Homo Sapiens
KVDIIISEW

SEQ ID NO: 131058 - protein, 9 aa, Homo Sapiens
KVFDSHPVL

SEQ ID NO: 131059 - protein, 9 aa, Homo Sapiens
KVFGNEIKL

SEQ ID NO: 131060 - protein, 9 aa, Homo Sapiens
KVGKFYELY

SEQ ID NO: 131061 - protein, 9 aa, Homo Sapiens
KVHCLNTLF

SEQ ID NO: 131062 - protein, 9 aa, Homo Sapiens
KVHQLYETI

SEQ ID NO: 131063 - protein, 9 aa, Homo Sapiens
KVIAQQVQL

SEQ ID NO: 131064 - protein, 9 aa, Homo Sapiens
KVIEEAVYF

SEQ ID NO: 131065 - protein, 9 aa, Homo Sapiens
KVIEINPYL

SEQ ID NO: 131066 - protein, 9 aa, Homo Sapiens
KVINAAHSF

SEQ ID NO: 131067 - protein, 9 aa, Homo Sapiens
KVIQMVPEF

SEQ ID NO: 131068 - protein, 9 aa, Homo Sapiens
KVITCEIAW

SEQ ID NO: 131069 - protein, 9 aa, Homo Sapiens
KVKEFCENL

SEQ ID NO: 131070 - protein, 9 aa, Homo Sapiens
KVKTDTVLI

SEQ ID NO: 131071 - protein, 9 aa, Homo Sapiens
KVLDFEHFL

SEQ ID NO: 131072 - protein, 9 aa, Homo Sapiens
KVLDILQHI

SEQ ID NO: 131073 - protein, 9 aa, Homo Sapiens
KVLDLKINL

SEQ ID NO: 131074 - protein, 9 aa, Homo Sapiens
KVLDLNPGF

SEQ ID NO: 131075 - protein, 9 aa, Homo Sapiens
KVLDLRINL

SEQ ID NO: 131076 - protein, 9 aa, Homo Sapiens
KVLELDPAL

SEQ ID NO: 131077 - protein, 9 aa, Homo Sapiens
KVLELFESF

SEQ ID NO: 131078 - protein, 9 aa, Homo Sapiens
KVLKIHINF

SEQ ID NO: 131079 - protein, 9 aa, Homo Sapiens
KVLKNNIRF

SEQ ID NO: 131080 - protein, 9 aa, Homo Sapiens
KVLPCQHTF

SEQ ID NO: 131081 - protein, 9 aa, Homo Sapiens
KVLPIIQRW

SEQ ID NO: 131082 - protein, 9 aa, Homo Sapiens
KVLVIPICF

SEQ ID NO: 131083 - protein, 9 aa, Homo Sapiens
KVMELLVHL

SEQ ID NO: 131084 - protein, 9 aa, Homo Sapiens
KVMPFANLM

SEQ ID NO: 131085 - protein, 9 aa, Homo Sapiens
KVMPQNHSF

SEQ ID NO: 131086 - protein, 9 aa, Homo Sapiens
KVNGKGSLW

SEQ ID NO: 131087 - protein, 9 aa, Homo Sapiens
KVPPFVFFF

SEQ ID NO: 131088 - protein, 9 aa, Homo Sapiens
KVQDITMQW

SEQ ID NO: 131089 - protein, 9 aa, Homo Sapiens
KVQPRNWLL

SEQ ID NO: 131090 - protein, 9 aa, Homo Sapiens
KVRPSEEML

SEQ ID NO: 131091 - protein, 9 aa, Homo Sapiens
KVSKMEQKF

SEQ ID NO: 131092 - protein, 9 aa, Homo Sapiens
KVSSINSRF

SEQ ID NO: 131093 - protein, 9 aa, Homo Sapiens
KVTIICIRF

SEQ ID NO: 131094 - protein, 9 aa, Homo Sapiens
KVVDAKTIF

SEQ ID NO: 131095 - protein, 9 aa, Homo Sapiens
KVVGKDYLL

SEQ ID NO: 131096 - protein, 9 aa, Homo Sapiens
KVVNIVPVI

SEQ ID NO: 131097 - protein, 9 aa, Homo Sapiens
KVVTIIPKI

SEQ ID NO: 131098 - protein, 9 aa, Homo Sapiens
KVWKAPSSW

SEQ ID NO: 131099 - protein, 9 aa, Homo Sapiens
KVYMFKCVW

SEQ ID NO: 131100 - protein, 9 aa, Homo Sapiens
LAAKLIHTL

SEQ ID NO: 131101 - protein, 9 aa, Homo Sapiens
LAAKLLAKY

SEQ ID NO: 131102 - protein, 9 aa, Homo Sapiens
LADRLLHQF

SEQ ID NO: 131103 - protein, 9 aa, Homo Sapiens
LAHRVETKM

SEQ ID NO: 131104 - protein, 9 aa, Homo Sapiens
LAKKIEPEL

SEQ ID NO: 131105 - protein, 9 aa, Homo Sapiens
LALVKPEVW

SEQ ID NO: 131106 - protein, 9 aa, Homo Sapiens
LANKLYERW

SEQ ID NO: 131107 - protein, 9 aa, Homo Sapiens
LASPIYTHF

SEQ ID NO: 131108 - protein, 9 aa, Homo Sapiens
LATTILQHW

SEQ ID NO: 131109 - protein, 9 aa, Homo Sapiens
LAVPFCVNF

SEQ ID NO: 131110 - protein, 9 aa, Homo Sapiens
LAWQNPSGW

SEQ ID NO: 131111 - protein, 9 aa, Homo Sapiens
LGTQLLYKF

SEQ ID NO: 131112 - protein, 9 aa, Homo Sapiens
LIRELEPLL

SEQ ID NO: 131113 - protein, 9 aa, Homo Sapiens
LKERDFEIK

SEQ ID NO: 131114 - protein, 9 aa, Homo Sapiens
LSAFLPARF

SEQ ID NO: 131115 - protein, 9 aa, Homo Sapiens
LSAFLSHQF

SEQ ID NO: 131116 - protein, 9 aa, Homo Sapiens
LSAPIHTQM

SEQ ID NO: 131117 - protein, 9 aa, Homo Sapiens
LSAPIMSRF

SEQ ID NO: 131118 - protein, 9 aa, Homo Sapiens
LSDETKNNW

SEQ ID NO: 131119 - protein, 9 aa, Homo Sapiens
LSDSPGPTW

SEQ ID NO: 131120 - protein, 9 aa, Homo Sapiens
LSFTHPISF

SEQ ID NO: 131121 - protein, 9 aa, Homo Sapiens
LSGPFVQKW

SEQ ID NO: 131122 - protein, 9 aa, Homo Sapiens
LSIHLQHKF

SEQ ID NO: 131123 - protein, 9 aa, Homo Sapiens
LSIKEAFRL

SEQ ID NO: 131124 - protein, 9 aa, Homo Sapiens
LSLKNIPVL

SEQ ID NO: 131125 - protein, 9 aa, Homo Sapiens
LSLPKQLVL

SEQ ID NO: 131126 - protein, 9 aa, Homo Sapiens
LSMIITPAF

SEQ ID NO: 131127 - protein, 9 aa, Homo Sapiens
LSNKISPLM

SEQ ID NO: 131128 - protein, 9 aa, Homo Sapiens
LSNTVMPRF

SEQ ID NO: 131129 - protein, 9 aa, Homo Sapiens
LSPDVTPCF

SEQ ID NO: 131130 - protein, 9 aa, Homo Sapiens
LSPRDITTI

SEQ ID NO: 131131 - protein, 9 aa, Homo Sapiens
LSQKLQMIL

SEQ ID NO: 131132 - protein, 9 aa, Homo Sapiens
LSQKPISSF

SEQ ID NO: 131133 - protein, 9 aa, Homo Sapiens
LSQNRLHTL

SEQ ID NO: 131134 - protein, 9 aa, Homo Sapiens
LSQPILLEL

SEQ ID NO: 131135 - protein, 9 aa, Homo Sapiens
LSQPTPATL

SEQ ID NO: 131136 - protein, 9 aa, Homo Sapiens
LSRELFESW

SEQ ID NO: 131137 - protein, 9 aa, Homo Sapiens
LSRPEAQSL

SEQ ID NO: 131138 - protein, 9 aa, Homo Sapiens
LSSTEILKW

SEQ ID NO: 131139 - protein, 9 aa, Homo Sapiens
LSTIISPLF

SEQ ID NO: 131140 - protein, 9 aa, Homo Sapiens
LSTLVRPVF

SEQ ID NO: 131141 - protein, 9 aa, Homo Sapiens
LSTTIQEEF

SEQ ID NO: 131142 - protein, 9 aa, Homo Sapiens
LSVAVRSEF

SEQ ID NO: 131143 - protein, 9 aa, Homo Sapiens
LSVETDYTF

SEQ ID NO: 131144 - protein, 9 aa, Homo Sapiens
LSVPSPFTW

SEQ ID NO: 131145 - protein, 9 aa, Homo Sapiens
LSWQYLTTL

SEQ ID NO: 131146 - protein, 9 aa, Homo Sapiens
LSYPQTDVF

SEQ ID NO: 131147 - protein, 9 aa, Homo Sapiens
LTAKILEAF

SEQ ID NO: 131148 - protein, 9 aa, Homo Sapiens
LTCKNQVLL

SEQ ID NO: 131149 - protein, 9 aa, Homo Sapiens
LTDRLQLTL

SEQ ID NO: 131150 - protein, 9 aa, Homo Sapiens
LTIDHVPIW

SEQ ID NO: 131151 - protein, 9 aa, Homo Sapiens
LTIVDTPGF

SEQ ID NO: 131152 - protein, 9 aa, Homo Sapiens
LTKAKEALI

SEQ ID NO: 131153 - protein, 9 aa, Homo Sapiens
LTKKSEEVF

SEQ ID NO: 131154 - protein, 9 aa, Homo Sapiens
LTKKYEHVL

SEQ ID NO: 131155 - protein, 9 aa, Homo Sapiens
LTKPFEYLF

SEQ ID NO: 131156 - protein, 9 aa, Homo Sapiens
LTKQEFQTL

SEQ ID NO: 131157 - protein, 9 aa, Homo Sapiens
LTLEERVHF

SEQ ID NO: 131158 - protein, 9 aa, Homo Sapiens
LTLPVNHIF

SEQ ID NO: 131159 - protein, 9 aa, Homo Sapiens
LTLREVEVF

SEQ ID NO: 131160 - protein, 9 aa, Homo Sapiens
LTMKDSNQF

SEQ ID NO: 131161 - protein, 9 aa, Homo Sapiens
LTMTRNAVW

SEQ ID NO: 131162 - protein, 9 aa, Homo Sapiens
LTNTIHCRL

SEQ ID NO: 131163 - protein, 9 aa, Homo Sapiens
LTPDVQPRF

SEQ ID NO: 131164 - protein, 9 aa, Homo Sapiens
LTPKINQTF

SEQ ID NO: 131165 - protein, 9 aa, Homo Sapiens
LTPVVVTLW

SEQ ID NO: 131166 - protein, 9 aa, Homo Sapiens
LTRTELETL

SEQ ID NO: 131167 - protein, 9 aa, Homo Sapiens
LTRVEVTEF

SEQ ID NO: 131168 - protein, 9 aa, Homo Sapiens
LTSKLYSLL

SEQ ID NO: 131169 - protein, 9 aa, Homo Sapiens
LTSVVQTLL

SEQ ID NO: 131170 - protein, 9 aa, Homo Sapiens
LTVGLSNLF

SEQ ID NO: 131171 - protein, 9 aa, Homo Sapiens
LTVIHDFLF

SEQ ID NO: 131172 - protein, 9 aa, Homo Sapiens
LTVRNLPQY

SEQ ID NO: 131173 - protein, 9 aa, Homo Sapiens
LTWKKIIKF

SEQ ID NO: 131174 - protein, 9 aa, Homo Sapiens
LTYASPPLI

SEQ ID NO: 131175 - protein, 9 aa, Homo Sapiens
LTYENVERW

SEQ ID NO: 131176 - protein, 9 aa, Homo Sapiens
LVHAVQALW

SEQ ID NO: 131177 - protein, 9 aa, Homo Sapiens
LVWKAQNTW

SEQ ID NO: 131178 - protein, 9 aa, Homo Sapiens
MAAKILEEF

SEQ ID NO: 131179 - protein, 9 aa, Homo Sapiens
MAALVHHSF

SEQ ID NO: 131180 - protein, 9 aa, Homo Sapiens
MAGIIIAGW

SEQ ID NO: 131181 - protein, 9 aa, Homo Sapiens
MAHQIQEMF

SEQ ID NO: 131182 - protein, 9 aa, Homo Sapiens
MAHQVQELF

SEQ ID NO: 131183 - protein, 9 aa, Homo Sapiens
MAIVGTHKF

SEQ ID NO: 131184 - protein, 9 aa, Homo Sapiens
MSERQVALW

SEQ ID NO: 131185 - protein, 9 aa, Homo Sapiens
MSLPYRLVF

SEQ ID NO: 131186 - protein, 9 aa, Homo Sapiens
MSLRLNEQY

SEQ ID NO: 131187 - protein, 9 aa, Homo Sapiens
MSNELENYF

SEQ ID NO: 131188 - protein, 9 aa, Homo Sapiens
MSNKHGWTW

SEQ ID NO: 131189 - protein, 9 aa, Homo Sapiens
MSVHLSPCF

SEQ ID NO: 131190 - protein, 9 aa, Homo Sapiens
MTNGFHMTW

SEQ ID NO: 131191 - protein, 9 aa, Homo Sapiens
MTNPHNHLY

SEQ ID NO: 131192 - protein, 9 aa, Homo Sapiens
MTQIMFETF

SEQ ID NO: 131193 - protein, 9 aa, Homo Sapiens
MTRIQKERF

SEQ ID NO: 131194 - protein, 9 aa, Homo Sapiens
MTVKEQQEW

SEQ ID NO: 131195 - protein, 9 aa, Homo Sapiens
MTVSIIDRF

SEQ ID NO: 131196 - protein, 9 aa, Homo Sapiens
NSRKQEAEW

SEQ ID NO: 131197 - protein, 9 aa, Homo Sapiens
NSTVRLYEW

SEQ ID NO: 131198 - protein, 9 aa, Homo Sapiens
NTINLIHTF

SEQ ID NO: 131199 - protein, 9 aa, Homo Sapiens
NTLKNTIVF

SEQ ID NO: 131200 - protein, 9 aa, Homo Sapiens
NVAAAAAFN

SEQ ID NO: 131201 - protein, 9 aa, Homo Sapiens
QAAELRAYL

SEQ ID NO: 131202 - protein, 9 aa, Homo Sapiens
QALQTNWHL

SEQ ID NO: 131203 - protein, 9 aa, Homo Sapiens
QARIEIESF

SEQ ID NO: 131204 - protein, 9 aa, Homo Sapiens
QATRTVPVF

SEQ ID NO: 131205 - protein, 9 aa, Homo Sapiens
QAWKEILKW

SEQ ID NO: 131206 - protein, 9 aa, Homo Sapiens
QSAKEQIKW

SEQ ID NO: 131207 - protein, 9 aa, Homo Sapiens
QSAKTQIKL

SEQ ID NO: 131208 - protein, 9 aa, Homo Sapiens
QSAVMSATF

SEQ ID NO: 131209 - protein, 9 aa, Homo Sapiens
QSCTVEVHF

SEQ ID NO: 131210 - protein, 9 aa, Homo Sapiens
QSCVIIIRI

SEQ ID NO: 131211 - protein, 9 aa, Homo Sapiens
QSIDLNHNF

SEQ ID NO: 131212 - protein, 9 aa, Homo Sapiens
QSLELVHRF

SEQ ID NO: 131213 - protein, 9 aa, Homo Sapiens
QSLKKQNVF

SEQ ID NO: 131214 - protein, 9 aa, Homo Sapiens
QSLMQAPLL

SEQ ID NO: 131215 - protein, 9 aa, Homo Sapiens
QSLRLGHLL

SEQ ID NO: 131216 - protein, 9 aa, Homo Sapiens
QSQIHNTCW

SEQ ID NO: 131217 - protein, 9 aa, Homo Sapiens
QSRVEEITM

SEQ ID NO: 131218 - protein, 9 aa, Homo Sapiens
QSTPIQHSF

SEQ ID NO: 131219 - protein, 9 aa, Homo Sapiens
QSVHFQTIF

SEQ ID NO: 131220 - protein, 9 aa, Homo Sapiens
QSVTLTHLF

SEQ ID NO: 131221 - protein, 9 aa, Homo Sapiens
QSYQESHCF

SEQ ID NO: 131222 - protein, 9 aa, Homo Sapiens
QSYQKFRRF

SEQ ID NO: 131223 - protein, 9 aa, Homo Sapiens
QTAVLIETL

SEQ ID NO: 131224 - protein, 9 aa, Homo Sapiens
QTCRLLLSY

SEQ ID NO: 131225 - protein, 9 aa, Homo Sapiens
QTFITLEKF

SEQ ID NO: 131226 - protein, 9 aa, Homo Sapiens
QTFLSEIRW

SEQ ID NO: 131227 - protein, 9 aa, Homo Sapiens
QTFSSKTEW

SEQ ID NO: 131228 - protein, 9 aa, Homo Sapiens
QTHRIHNAL

SEQ ID NO: 131229 - protein, 9 aa, Homo Sapiens
QTLPTSNYF

SEQ ID NO: 131230 - protein, 9 aa, Homo Sapiens
QTLSLKQLF

SEQ ID NO: 131231 - protein, 9 aa, Homo Sapiens
QTLVLHQYF

SEQ ID NO: 131232 - protein, 9 aa, Homo Sapiens
QTMELAPNF

SEQ ID NO: 131233 - protein, 9 aa, Homo Sapiens
QTVHINENF

SEQ ID NO: 131234 - protein, 9 aa, Homo Sapiens
QTVMITPTF

SEQ ID NO: 131235 - protein, 9 aa, Homo Sapiens
QTVSPAEKW

SEQ ID NO: 131236 - protein, 9 aa, Homo Sapiens
QVAPLTHVF

SEQ ID NO: 131237 - protein, 9 aa, Homo Sapiens
QVLKTQTKF

SEQ ID NO: 131238 - protein, 9 aa, Homo Sapiens
RAADVLVYL

SEQ ID NO: 131239 - protein, 9 aa, Homo Sapiens
RAAEIRETL

SEQ ID NO: 131240 - protein, 9 aa, Homo Sapiens
RAAELGVNF

SEQ ID NO: 131241 - protein, 9 aa, Homo Sapiens
RAAFVLPEF

SEQ ID NO: 131242 - protein, 9 aa, Homo Sapiens
RAANLESKF

SEQ ID NO: 131243 - protein, 9 aa, Homo Sapiens
RAATIHHRL

SEQ ID NO: 131244 - protein, 9 aa, Homo Sapiens
RAATLIQSF

SEQ ID NO: 131245 - protein, 9 aa, Homo Sapiens
RAAVIKHRF

SEQ ID NO: 131246 - protein, 9 aa, Homo Sapiens
RACQFLIKF

SEQ ID NO: 131247 - protein, 9 aa, Homo Sapiens
RAFEYEIRF

SEQ ID NO: 131248 - protein, 9 aa, Homo Sapiens
RAFHPDLEF

SEQ ID NO: 131249 - protein, 9 aa, Homo Sapiens
RAFLIRELF

SEQ ID NO: 131250 - protein, 9 aa, Homo Sapiens
RAGMFVSKF

SEQ ID NO: 131251 - protein, 9 aa, Homo Sapiens
RAHQIFEEF

SEQ ID NO: 131252 - protein, 9 aa, Homo Sapiens
RAIDKCWKI

SEQ ID NO: 131253 - protein, 9 aa, Homo Sapiens
RAIELQPHF

SEQ ID NO: 131254 - protein, 9 aa, Homo Sapiens
RAINIALQL

SEQ ID NO: 131255 - protein, 9 aa, Homo Sapiens
RAIQINPAF

SEQ ID NO: 131256 - protein, 9 aa, Homo Sapiens
RAKPEYHKF

SEQ ID NO: 131257 - protein, 9 aa, Homo Sapiens
RALKEITTF

SEQ ID NO: 131258 - protein, 9 aa, Homo Sapiens
RALKLLTTL

SEQ ID NO: 131259 - protein, 9 aa, Homo Sapiens
RALLVNVKF

SEQ ID NO: 131260 - protein, 9 aa, Homo Sapiens
RALSEQINI

SEQ ID NO: 131261 - protein, 9 aa, Homo Sapiens
RAPEVILSW

SEQ ID NO: 131262 - protein, 9 aa, Homo Sapiens
RAPEVYVAF

SEQ ID NO: 131263 - protein, 9 aa, Homo Sapiens
RAPPKQMVW

SEQ ID NO: 131264 - protein, 9 aa, Homo Sapiens
RAPQQWATF

SEQ ID NO: 131265 - protein, 9 aa, Homo Sapiens
RAQPYDPNF

SEQ ID NO: 131266 - protein, 9 aa, Homo Sapiens
RARTIYERF

SEQ ID NO: 131267 - protein, 9 aa, Homo Sapiens
RASGLTQKW

SEQ ID NO: 131268 - protein, 9 aa, Homo Sapiens
RASQVQSKL

SEQ ID NO: 131269 - protein, 9 aa, Homo Sapiens
RATPENYLF

SEQ ID NO: 131270 - protein, 9 aa, Homo Sapiens
RAVQLQELW

SEQ ID NO: 131271 - protein, 9 aa, Homo Sapiens
RAYAKDVKF

SEQ ID NO: 131272 - protein, 9 aa, Homo Sapiens
RAYPFHWAW

SEQ ID NO: 131273 - protein, 9 aa, Homo Sapiens
RGCDVTFEW

SEQ ID NO: 131274 - protein, 9 aa, Homo Sapiens
RGCQLTITF

SEQ ID NO: 131275 - protein, 9 aa, Homo Sapiens
RGFYSVETF

SEQ ID NO: 131276 - protein, 9 aa, Homo Sapiens
RGVPWNFTF

SEQ ID NO: 131277 - protein, 9 aa, Homo Sapiens
RGWDGFVEF

SEQ ID NO: 131278 - protein, 9 aa, Homo Sapiens
RGWNDPPQF

SEQ ID NO: 131279 - protein, 9 aa, Homo Sapiens
RICSKAHSW

SEQ ID NO: 131280 - protein, 9 aa, Homo Sapiens
RIHVCLYFI

SEQ ID NO: 131281 - protein, 9 aa, Homo Sapiens
RIIAKLAAW

SEQ ID NO: 131282 - protein, 9 aa, Homo Sapiens
RIIHLVHRF

SEQ ID NO: 131283 - protein, 9 aa, Homo Sapiens
RIKNNDPKL

SEQ ID NO: 131284 - protein, 9 aa, Homo Sapiens
RIYNFAHRF

SEQ ID NO: 131285 - protein, 9 aa, Homo Sapiens
RLAEISDVW

SEQ ID NO: 131286 - protein, 9 aa, Homo Sapiens
RLFKNDPLF

SEQ ID NO: 131287 - protein, 9 aa, Homo Sapiens
RLGQIYQSW

SEQ ID NO: 131288 - protein, 9 aa, Homo Sapiens
RLWEQLVHF

SEQ ID NO: 131289 - protein, 9 aa, Homo Sapiens
RMFLENETW

SEQ ID NO: 131290 - protein, 9 aa, Homo Sapiens
RMNPNSPSI

SEQ ID NO: 131291 - protein, 9 aa, Homo Sapiens
RNLPFDFTW

SEQ ID NO: 131292 - protein, 9 aa, Homo Sapiens
RQFPTAFEF

SEQ ID NO: 131293 - protein, 9 aa, Homo Sapiens
RSAAYAARW

SEQ ID NO: 131294 - protein, 9 aa, Homo Sapiens
RSADHPPKL

SEQ ID NO: 131295 - protein, 9 aa, Homo Sapiens
RSAEAYENF

SEQ ID NO: 131296 - protein, 9 aa, Homo Sapiens
RSAHLRSYF

SEQ ID NO: 131297 - protein, 9 aa, Homo Sapiens
RSAICIQSW

SEQ ID NO: 131298 - protein, 9 aa, Homo Sapiens
RSALLHADF

SEQ ID NO: 131299 - protein, 9 aa, Homo Sapiens
RSALVNNTI

SEQ ID NO: 131300 - protein, 9 aa, Homo Sapiens
RSANIEFQM

SEQ ID NO: 131301 - protein, 9 aa, Homo Sapiens
RSAQAIHKF

SEQ ID NO: 131302 - protein, 9 aa, Homo Sapiens
RSARPPEKF

SEQ ID NO: 131303 - protein, 9 aa, Homo Sapiens
RSAVFSVTY

SEQ ID NO: 131304 - protein, 9 aa, Homo Sapiens
RSAVVEMLI

SEQ ID NO: 131305 - protein, 9 aa, Homo Sapiens
RSCLLHLTL

SEQ ID NO: 131306 - protein, 9 aa, Homo Sapiens
RSCTLANNF

SEQ ID NO: 131307 - protein, 9 aa, Homo Sapiens
RSCTVNIMF

SEQ ID NO: 131308 - protein, 9 aa, Homo Sapiens
RSDNIIFQF

SEQ ID NO: 131309 - protein, 9 aa, Homo Sapiens
RSDPGHYSF

SEQ ID NO: 131310 - protein, 9 aa, Homo Sapiens
RSDTAQVEL

SEQ ID NO: 131311 - protein, 9 aa, Homo Sapiens
RSFFHQHYL

SEQ ID NO: 131312 - protein, 9 aa, Homo Sapiens
RSFHEVREF

SEQ ID NO: 131313 - protein, 9 aa, Homo Sapiens
RSFLTKLEW

SEQ ID NO: 131314 - protein, 9 aa, Homo Sapiens
RSFPGFQAF

SEQ ID NO: 131315 - protein, 9 aa, Homo Sapiens
RSFPTLPTL

SEQ ID NO: 131316 - protein, 9 aa, Homo Sapiens
RSFQGPVLI

SEQ ID NO: 131317 - protein, 9 aa, Homo Sapiens
RSFTNQIIL

SEQ ID NO: 131318 - protein, 9 aa, Homo Sapiens
RSFVEKHRW

SEQ ID NO: 131319 - protein, 9 aa, Homo Sapiens
RSFVSPPVL

SEQ ID NO: 131320 - protein, 9 aa, Homo Sapiens
RSGPFAPVL

SEQ ID NO: 131321 - protein, 9 aa, Homo Sapiens
RSGPFGQIF

SEQ ID NO: 131322 - protein, 9 aa, Homo Sapiens
RSHAGYQTI

SEQ ID NO: 131323 - protein, 9 aa, Homo Sapiens
RSHDTLVRW

SEQ ID NO: 131324 - protein, 9 aa, Homo Sapiens
RSHGFAAEF

SEQ ID NO: 131325 - protein, 9 aa, Homo Sapiens
RSHKIQTQL

SEQ ID NO: 131326 - protein, 9 aa, Homo Sapiens
RSHQVSVTL

SEQ ID NO: 131327 - protein, 9 aa, Homo Sapiens
RSHYLMHNY

SEQ ID NO: 131328 - protein, 9 aa, Homo Sapiens
RSHYSPIYL

SEQ ID NO: 131329 - protein, 9 aa, Homo Sapiens
RSIDKPFRL

SEQ ID NO: 131330 - protein, 9 aa, Homo Sapiens
RSIDLTVKL

SEQ ID NO: 131331 - protein, 9 aa, Homo Sapiens
RSIFSDFVF

SEQ ID NO: 131332 - protein, 9 aa, Homo Sapiens
RSILAPLAW

SEQ ID NO: 131333 - protein, 9 aa, Homo Sapiens
RSINKLIRI

SEQ ID NO: 131334 - protein, 9 aa, Homo Sapiens
RSINQPVAF

SEQ ID NO: 131335 - protein, 9 aa, Homo Sapiens
RSIPMTVDF

SEQ ID NO: 131336 - protein, 9 aa, Homo Sapiens
RSIQQGFCF

SEQ ID NO: 131337 - protein, 9 aa, Homo Sapiens
RSIRLPETI

SEQ ID NO: 131338 - protein, 9 aa, Homo Sapiens
RSIVNQVRF

SEQ ID NO: 131339 - protein, 9 aa, Homo Sapiens
RSKFENEEF

SEQ ID NO: 131340 - protein, 9 aa, Homo Sapiens
RSKKDDINL

SEQ ID NO: 131341 - protein, 9 aa, Homo Sapiens
RSKQAEEEF

SEQ ID NO: 131342 - protein, 9 aa, Homo Sapiens
RSKQTKELW

SEQ ID NO: 131343 - protein, 9 aa, Homo Sapiens
RSLAYIHSF

SEQ ID NO: 131344 - protein, 9 aa, Homo Sapiens
RSLDQQMYL

SEQ ID NO: 131345 - protein, 9 aa, Homo Sapiens
RSLEQKKTF

SEQ ID NO: 131346 - protein, 9 aa, Homo Sapiens
RSLEQNIQL

SEQ ID NO: 131347 - protein, 9 aa, Homo Sapiens
RSLGFNTQI

SEQ ID NO: 131348 - protein, 9 aa, Homo Sapiens
RSLGVHLSF

SEQ ID NO: 131349 - protein, 9 aa, Homo Sapiens
RSLIHHIRL

SEQ ID NO: 131350 - protein, 9 aa, Homo Sapiens
RSLPEHPAF

SEQ ID NO: 131351 - protein, 9 aa, Homo Sapiens
RSLPEIWTL

SEQ ID NO: 131352 - protein, 9 aa, Homo Sapiens
RSLPENIQF

SEQ ID NO: 131353 - protein, 9 aa, Homo Sapiens
RSLPQRFKM

SEQ ID NO: 131354 - protein, 9 aa, Homo Sapiens
RSLPRPHDF

SEQ ID NO: 131355 - protein, 9 aa, Homo Sapiens
RSLPSSSQL

SEQ ID NO: 131356 - protein, 9 aa, Homo Sapiens
RSLQLHLVF

SEQ ID NO: 131357 - protein, 9 aa, Homo Sapiens
RSLSTTNVF

SEQ ID NO: 131358 - protein, 9 aa, Homo Sapiens
RSLTHPPTI

SEQ ID NO: 131359 - protein, 9 aa, Homo Sapiens
RSLWKDVTF

SEQ ID NO: 131360 - protein, 9 aa, Homo Sapiens
RSMEAHNIL

SEQ ID NO: 131361 - protein, 9 aa, Homo Sapiens
RSMEDFVTW

SEQ ID NO: 131362 - protein, 9 aa, Homo Sapiens
RSMEVSTQL

SEQ ID NO: 131363 - protein, 9 aa, Homo Sapiens
RSMGLPLQF

SEQ ID NO: 131364 - protein, 9 aa, Homo Sapiens
RSMNGALAF

SEQ ID NO: 131365 - protein, 9 aa, Homo Sapiens
RSMQNSPSI

SEQ ID NO: 131366 - protein, 9 aa, Homo Sapiens
RSMQNYVQF

SEQ ID NO: 131367 - protein, 9 aa, Homo Sapiens
RSNKLHFAF

SEQ ID NO: 131368 - protein, 9 aa, Homo Sapiens
RSNNINTLF

SEQ ID NO: 131369 - protein, 9 aa, Homo Sapiens
RSPEILVKF

SEQ ID NO: 131370 - protein, 9 aa, Homo Sapiens
RSPEPGQTW

SEQ ID NO: 131371 - protein, 9 aa, Homo Sapiens
RSPETMIKW

SEQ ID NO: 131372 - protein, 9 aa, Homo Sapiens
RSPKLFVVF

SEQ ID NO: 131373 - protein, 9 aa, Homo Sapiens
RSPRTLVTL

SEQ ID NO: 131374 - protein, 9 aa, Homo Sapiens
RSQDHFHVF

SEQ ID NO: 131375 - protein, 9 aa, Homo Sapiens
RSQIHLHKY

SEQ ID NO: 131376 - protein, 9 aa, Homo Sapiens
RSQPPVRAF

SEQ ID NO: 131377 - protein, 9 aa, Homo Sapiens
RSQVSTPRF

SEQ ID NO: 131378 - protein, 9 aa, Homo Sapiens
RSSGRVYYF

SEQ ID NO: 131379 - protein, 9 aa, Homo Sapiens
RSSPLKLEF

SEQ ID NO: 131380 - protein, 9 aa, Homo Sapiens
RSSPVEYEF

SEQ ID NO: 131381 - protein, 9 aa, Homo Sapiens
RSSQMESQF

SEQ ID NO: 131382 - protein, 9 aa, Homo Sapiens
RSSTPLPTI

SEQ ID NO: 131383 - protein, 9 aa, Homo Sapiens
RSTELDSNW

SEQ ID NO: 131384 - protein, 9 aa, Homo Sapiens
RSTELIPRL

SEQ ID NO: 131385 - protein, 9 aa, Homo Sapiens
RSTPFRYLL

SEQ ID NO: 131386 - protein, 9 aa, Homo Sapiens
RSTQITVRF

SEQ ID NO: 131387 - protein, 9 aa, Homo Sapiens
RSTQQTTEW

SEQ ID NO: 131388 - protein, 9 aa, Homo Sapiens
RSTSTQVVF

SEQ ID NO: 131389 - protein, 9 aa, Homo Sapiens
RSVDLQTRI

SEQ ID NO: 131390 - protein, 9 aa, Homo Sapiens
RSVLHHFHF

SEQ ID NO: 131391 - protein, 9 aa, Homo Sapiens
RSVPLKATF

SEQ ID NO: 131392 - protein, 9 aa, Homo Sapiens
RSVVLNDVF

SEQ ID NO: 131393 - protein, 9 aa, Homo Sapiens
RSWAGIINL

SEQ ID NO: 131394 - protein, 9 aa, Homo Sapiens
RSWDHNEFF

SEQ ID NO: 131395 - protein, 9 aa, Homo Sapiens
RSWDQQIKL

SEQ ID NO: 131396 - protein, 9 aa, Homo Sapiens
RSWLPCIFF

SEQ ID NO: 131397 - protein, 9 aa, Homo Sapiens
RSYEEKKQF

SEQ ID NO: 131398 - protein, 9 aa, Homo Sapiens
RTADWRLYL

SEQ ID NO: 131399 - protein, 9 aa, Homo Sapiens
RTAFTKEQI

SEQ ID NO: 131400 - protein, 9 aa, Homo Sapiens
RTAHVILRY

SEQ ID NO: 131401 - protein, 9 aa, Homo Sapiens
RTAITTPNF

SEQ ID NO: 131402 - protein, 9 aa, Homo Sapiens
RTAKLQVTL

SEQ ID NO: 131403 - protein, 9 aa, Homo Sapiens
RTALFEVMF

SEQ ID NO: 131404 - protein, 9 aa, Homo Sapiens
RTATFQQRF

SEQ ID NO: 131405 - protein, 9 aa, Homo Sapiens
RTCDYKHHW

SEQ ID NO: 131406 - protein, 9 aa, Homo Sapiens
RTDGKVFQF

SEQ ID NO: 131407 - protein, 9 aa, Homo Sapiens
RTDYSFHKF

SEQ ID NO: 131408 - protein, 9 aa, Homo Sapiens
RTEILNQEW

SEQ ID NO: 131409 - protein, 9 aa, Homo Sapiens
RTFEDFVRI

SEQ ID NO: 131410 - protein, 9 aa, Homo Sapiens
RTFEEITFL

SEQ ID NO: 131411 - protein, 9 aa, Homo Sapiens
RTFLHTVCF

SEQ ID NO: 131412 - protein, 9 aa, Homo Sapiens
RTFLLQGLL

SEQ ID NO: 131413 - protein, 9 aa, Homo Sapiens
RTFPVLLRL

SEQ ID NO: 131414 - protein, 9 aa, Homo Sapiens
RTFQDEPLI

SEQ ID NO: 131415 - protein, 9 aa, Homo Sapiens
RTFSEGTHF

SEQ ID NO: 131416 - protein, 9 aa, Homo Sapiens
RTFSLFQQL

SEQ ID NO: 131417 - protein, 9 aa, Homo Sapiens
RTHPVATSF

SEQ ID NO: 131418 - protein, 9 aa, Homo Sapiens
RTHPVEIFY

SEQ ID NO: 131419 - protein, 9 aa, Homo Sapiens
RTIEDFNKF

SEQ ID NO: 131420 - protein, 9 aa, Homo Sapiens
RTIGVITKL

SEQ ID NO: 131421 - protein, 9 aa, Homo Sapiens
RTINVYPNF

SEQ ID NO: 131422 - protein, 9 aa, Homo Sapiens
RTIQAHEGF

SEQ ID NO: 131423 - protein, 9 aa, Homo Sapiens
RTIRMGTTL

SEQ ID NO: 131424 - protein, 9 aa, Homo Sapiens
RTIVLQESI

SEQ ID NO: 131425 - protein, 9 aa, Homo Sapiens
RTKASVHTL

SEQ ID NO: 131426 - protein, 9 aa, Homo Sapiens
RTKEEVNEW

SEQ ID NO: 131427 - protein, 9 aa, Homo Sapiens
RTKIDCDNL

SEQ ID NO: 131428 - protein, 9 aa, Homo Sapiens
RTKQVLHTF

SEQ ID NO: 131429 - protein, 9 aa, Homo Sapiens
RTKTKPHLF

SEQ ID NO: 131430 - protein, 9 aa, Homo Sapiens
RTKVKEALL

SEQ ID NO: 131431 - protein, 9 aa, Homo Sapiens
RTLALQQQL

SEQ ID NO: 131432 - protein, 9 aa, Homo Sapiens
RTLDCIHVL

SEQ ID NO: 131433 - protein, 9 aa, Homo Sapiens
RTLDFDPLL

SEQ ID NO: 131434 - protein, 9 aa, Homo Sapiens
RTLDNQLFF

SEQ ID NO: 131435 - protein, 9 aa, Homo Sapiens
RTLDSLMQF

SEQ ID NO: 131436 - protein, 9 aa, Homo Sapiens
RTLETLIRL

SEQ ID NO: 131437 - protein, 9 aa, Homo Sapiens
RTLLAILRL

SEQ ID NO: 131438 - protein, 9 aa, Homo Sapiens
RTLLGDPKF

SEQ ID NO: 131439 - protein, 9 aa, Homo Sapiens
RTLPKLYSL

SEQ ID NO: 131440 - protein, 9 aa, Homo Sapiens
RTLPVLLLY

SEQ ID NO: 131441 - protein, 9 aa, Homo Sapiens
RTLPWSSVL

SEQ ID NO: 131442 - protein, 9 aa, Homo Sapiens
RTLRDIETF

SEQ ID NO: 131443 - protein, 9 aa, Homo Sapiens
RTLVPNFTF

SEQ ID NO: 131444 - protein, 9 aa, Homo Sapiens
RTMDDKTVF

SEQ ID NO: 131445 - protein, 9 aa, Homo Sapiens
RTMEIESTF

SEQ ID NO: 131446 - protein, 9 aa, Homo Sapiens
RTMEIFQLL

SEQ ID NO: 131447 - protein, 9 aa, Homo Sapiens
RTMPRIPTL

SEQ ID NO: 131448 - protein, 9 aa, Homo Sapiens
RTMPSNACF

SEQ ID NO: 131449 - protein, 9 aa, Homo Sapiens
RTMQPLAVL

SEQ ID NO: 131450 - protein, 9 aa, Homo Sapiens
RTNAIKQTF

SEQ ID NO: 131451 - protein, 9 aa, Homo Sapiens
RTNGKEPEL

SEQ ID NO: 131452 - protein, 9 aa, Homo Sapiens
RTNPNNGEF

SEQ ID NO: 131453 - protein, 9 aa, Homo Sapiens
RTNTAYQCF

SEQ ID NO: 131454 - protein, 9 aa, Homo Sapiens
RTPFPLAFW

SEQ ID NO: 131455 - protein, 9 aa, Homo Sapiens
RTPSVTAQF

SEQ ID NO: 131456 - protein, 9 aa, Homo Sapiens
RTQAFQVLL

SEQ ID NO: 131457 - protein, 9 aa, Homo Sapiens
RTQGFLALF

SEQ ID NO: 131458 - protein, 9 aa, Homo Sapiens
RTQVITQTL

SEQ ID NO: 131459 - protein, 9 aa, Homo Sapiens
RTSETNTLF

SEQ ID NO: 131460 - protein, 9 aa, Homo Sapiens
RTSTSQAVF

SEQ ID NO: 131461 - protein, 9 aa, Homo Sapiens
RTSVTDVKF

SEQ ID NO: 131462 - protein, 9 aa, Homo Sapiens
RTTDIVIRI

SEQ ID NO: 131463 - protein, 9 aa, Homo Sapiens
RTTDLLTDW

SEQ ID NO: 131464 - protein, 9 aa, Homo Sapiens
RTTEILHHL

SEQ ID NO: 131465 - protein, 9 aa, Homo Sapiens
RTTQIYTYF

SEQ ID NO: 131466 - protein, 9 aa, Homo Sapiens
RTTTVESSF

SEQ ID NO: 131467 - protein, 9 aa, Homo Sapiens
RTVAELVQF

SEQ ID NO: 131468 - protein, 9 aa, Homo Sapiens
RTVALTALL

SEQ ID NO: 131469 - protein, 9 aa, Homo Sapiens
RTVDARLKL

SEQ ID NO: 131470 - protein, 9 aa, Homo Sapiens
RTVEDFNKF

SEQ ID NO: 131471 - protein, 9 aa, Homo Sapiens
RTVEKPPKF

SEQ ID NO: 131472 - protein, 9 aa, Homo Sapiens
RTVEKTWKL

SEQ ID NO: 131473 - protein, 9 aa, Homo Sapiens
RTVIIEQSW

SEQ ID NO: 131474 - protein, 9 aa, Homo Sapiens
RTVYFSEQW

SEQ ID NO: 131475 - protein, 9 aa, Homo Sapiens
RTWKKFVKF

SEQ ID NO: 131476 - protein, 9 aa, Homo Sapiens
RTYEHEAMW

SEQ ID NO: 131477 - protein, 9 aa, Homo Sapiens
RTYKQRLLF

SEQ ID NO: 131478 - protein, 9 aa, Homo Sapiens
RTYPVQEYF

SEQ ID NO: 131479 - protein, 9 aa, Homo Sapiens
RVADLTEQY

SEQ ID NO: 131480 - protein, 9 aa, Homo Sapiens
RVAQMKRTW

SEQ ID NO: 131481 - protein, 9 aa, Homo Sapiens
RVAVILNEF

SEQ ID NO: 131482 - protein, 9 aa, Homo Sapiens
RVAVVSSRF

SEQ ID NO: 131483 - protein, 9 aa, Homo Sapiens
RVCDYHTKL

SEQ ID NO: 131484 - protein, 9 aa, Homo Sapiens
RVCEIQATL

SEQ ID NO: 131485 - protein, 9 aa, Homo Sapiens
RVFDLPLTW

SEQ ID NO: 131486 - protein, 9 aa, Homo Sapiens
RVFKNLQLF

SEQ ID NO: 131487 - protein, 9 aa, Homo Sapiens
RVFPHEVNW

SEQ ID NO: 131488 - protein, 9 aa, Homo Sapiens
RVFSLSSEF

SEQ ID NO: 131489 - protein, 9 aa, Homo Sapiens
RVHAFLEQW

SEQ ID NO: 131490 - protein, 9 aa, Homo Sapiens
RVHPETYEW

SEQ ID NO: 131491 - protein, 9 aa, Homo Sapiens
RVIDVGSEW

SEQ ID NO: 131492 - protein, 9 aa, Homo Sapiens
RVIEFAAKF

SEQ ID NO: 131493 - protein, 9 aa, Homo Sapiens
RVKEKEAEL

SEQ ID NO: 131494 - protein, 9 aa, Homo Sapiens
RVKEKEAIL

SEQ ID NO: 131495 - protein, 9 aa, Homo Sapiens
RVLISTDVW

SEQ ID NO: 131496 - protein, 9 aa, Homo Sapiens
RVLPCNHEF

SEQ ID NO: 131497 - protein, 9 aa, Homo Sapiens
RVLQEAWMF

SEQ ID NO: 131498 - protein, 9 aa, Homo Sapiens
RVLRFQVSF

SEQ ID NO: 131499 - protein, 9 aa, Homo Sapiens
RVLVVSAKF

SEQ ID NO: 131500 - protein, 9 aa, Homo Sapiens
RVMPSSFFL

SEQ ID NO: 131501 - protein, 9 aa, Homo Sapiens
RVNPVEYSI

SEQ ID NO: 131502 - protein, 9 aa, Homo Sapiens
RVREITENL

SEQ ID NO: 131503 - protein, 9 aa, Homo Sapiens
RVTSVVTGF

SEQ ID NO: 131504 - protein, 9 aa, Homo Sapiens
RVVDFDETW

SEQ ID NO: 131505 - protein, 9 aa, Homo Sapiens
RVVDIYSKF

SEQ ID NO: 131506 - protein, 9 aa, Homo Sapiens
RVVELQQTL

SEQ ID NO: 131507 - protein, 9 aa, Homo Sapiens
RVVPQFVVF

SEQ ID NO: 131508 - protein, 9 aa, Homo Sapiens
RVWNLNHLW

SEQ ID NO: 131509 - protein, 9 aa, Homo Sapiens
RVWQWDEKW

SEQ ID NO: 131510 - protein, 9 aa, Homo Sapiens
RVYPELQRF

SEQ ID NO: 131511 - protein, 9 aa, Homo Sapiens
RVYPQAVYF

SEQ ID NO: 131512 - protein, 9 aa, Homo Sapiens
SAANIQPIF

SEQ ID NO: 131513 - protein, 9 aa, Homo Sapiens
SAAPLFFSW

SEQ ID NO: 131514 - protein, 9 aa, Homo Sapiens
SAARLLFSF

SEQ ID NO: 131515 - protein, 9 aa, Homo Sapiens
SAARLYYYW

SEQ ID NO: 131516 - protein, 9 aa, Homo Sapiens
SADKTVALW

SEQ ID NO: 131517 - protein, 9 aa, Homo Sapiens
SAFSGFPSF

SEQ ID NO: 131518 - protein, 9 aa, Homo Sapiens
SAIKENFQF

SEQ ID NO: 131519 - protein, 9 aa, Homo Sapiens
SALRAQETF

SEQ ID NO: 131520 - protein, 9 aa, Homo Sapiens
SAVKVLMKF

SEQ ID NO: 131521 - protein, 9 aa, Homo Sapiens
SAYQHPASF

SEQ ID NO: 131522 - protein, 9 aa, Homo Sapiens
SFHNIHNTF

SEQ ID NO: 131523 - protein, 9 aa, Homo Sapiens
SSFGNFDRF

SEQ ID NO: 131524 - protein, 9 aa, Homo Sapiens
SSFVNEATF

SEQ ID NO: 131525 - protein, 9 aa, Homo Sapiens
SSGPVAESW

SEQ ID NO: 131526 - protein, 9 aa, Homo Sapiens
SSHHFVETF

SEQ ID NO: 131527 - protein, 9 aa, Homo Sapiens
SSLALVTSW

SEQ ID NO: 131528 - protein, 9 aa, Homo Sapiens
SSLKTCYKY

SEQ ID NO: 131529 - protein, 9 aa, Homo Sapiens
SSLNVVTTF

SEQ ID NO: 131530 - protein, 9 aa, Homo Sapiens
SSLPTVEKW

SEQ ID NO: 131531 - protein, 9 aa, Homo Sapiens
SSLRVHERI

SEQ ID NO: 131532 - protein, 9 aa, Homo Sapiens
SSLRVPSQW

SEQ ID NO: 131533 - protein, 9 aa, Homo Sapiens
SSMTLVDKF

SEQ ID NO: 131534 - protein, 9 aa, Homo Sapiens
SSPAPRTAL

SEQ ID NO: 131535 - protein, 9 aa, Homo Sapiens
SSRPEEPFL

SEQ ID NO: 131536 - protein, 9 aa, Homo Sapiens
SSSKEHVKW

SEQ ID NO: 131537 - protein, 9 aa, Homo Sapiens
SSSSVRVEW

SEQ ID NO: 131538 - protein, 9 aa, Homo Sapiens
SSTTVIPTL

SEQ ID NO: 131539 - protein, 9 aa, Homo Sapiens
SSVRAVAVW

SEQ ID NO: 131540 - protein, 9 aa, Homo Sapiens
SSYPNTFEW

SEQ ID NO: 131541 - protein, 9 aa, Homo Sapiens
STAKCLNIW

SEQ ID NO: 131542 - protein, 9 aa, Homo Sapiens
STDKTVAVW

SEQ ID NO: 131543 - protein, 9 aa, Homo Sapiens
STFKNWPFL

SEQ ID NO: 131544 - protein, 9 aa, Homo Sapiens
STFPGFVSW

SEQ ID NO: 131545 - protein, 9 aa, Homo Sapiens
STFRLLTVF

SEQ ID NO: 131546 - protein, 9 aa, Homo Sapiens
STIETVPYW

SEQ ID NO: 131547 - protein, 9 aa, Homo Sapiens
STIKKTFNF

SEQ ID NO: 131548 - protein, 9 aa, Homo Sapiens
STIRLLTSL

SEQ ID NO: 131549 - protein, 9 aa, Homo Sapiens
STKTGEPLM

SEQ ID NO: 131550 - protein, 9 aa, Homo Sapiens
STLHLVLRL

SEQ ID NO: 131551 - protein, 9 aa, Homo Sapiens
STLPVSCAW

SEQ ID NO: 131552 - protein, 9 aa, Homo Sapiens
STLREQVSL

SEQ ID NO: 131553 - protein, 9 aa, Homo Sapiens
STLRFLCKL

SEQ ID NO: 131554 - protein, 9 aa, Homo Sapiens
STLRTLPTL

SEQ ID NO: 131555 - protein, 9 aa, Homo Sapiens
STLRVLYNL

SEQ ID NO: 131556 - protein, 9 aa, Homo Sapiens
STRLEKEKW

SEQ ID NO: 131557 - protein, 9 aa, Homo Sapiens
STRPEVASI

SEQ ID NO: 131558 - protein, 9 aa, Homo Sapiens
STTRVKPFI

SEQ ID NO: 131559 - protein, 9 aa, Homo Sapiens
STVKVLIRL

SEQ ID NO: 131560 - protein, 9 aa, Homo Sapiens
STYDGVFIW

SEQ ID NO: 131561 - protein, 9 aa, Homo Sapiens
STYKFFEVI

SEQ ID NO: 131562 - protein, 9 aa, Homo Sapiens
STYVIRDEW

SEQ ID NO: 131563 - protein, 9 aa, Homo Sapiens
SVAALRFEW

SEQ ID NO: 131564 - protein, 9 aa, Homo Sapiens
SVMRCIAVF

SEQ ID NO: 131565 - protein, 9 aa, Homo Sapiens
SVTEIQEKW

SEQ ID NO: 131566 - protein, 9 aa, Homo Sapiens
TAAVLNAVW

SEQ ID NO: 131567 - protein, 9 aa, Homo Sapiens
TALSNLITW

SEQ ID NO: 131568 - protein, 9 aa, Homo Sapiens
TAMTVQILL

SEQ ID NO: 131569 - protein, 9 aa, Homo Sapiens
TANKYQVFF

SEQ ID NO: 131570 - protein, 9 aa, Homo Sapiens
TITKGPSKL

SEQ ID NO: 131571 - protein, 9 aa, Homo Sapiens
TSCTSNYHF

SEQ ID NO: 131572 - protein, 9 aa, Homo Sapiens
TSFKHFIFF

SEQ ID NO: 131573 - protein, 9 aa, Homo Sapiens
TSHSVGTVF

SEQ ID NO: 131574 - protein, 9 aa, Homo Sapiens
TSLPDTDTW

SEQ ID NO: 131575 - protein, 9 aa, Homo Sapiens
TSLQLQHLF

SEQ ID NO: 131576 - protein, 9 aa, Homo Sapiens
TSLTIKSVF

SEQ ID NO: 131577 - protein, 9 aa, Homo Sapiens
TSLVEKHTL

SEQ ID NO: 131578 - protein, 9 aa, Homo Sapiens
TSRKALETL

SEQ ID NO: 131579 - protein, 9 aa, Homo Sapiens
TSVMLKDRW

SEQ ID NO: 131580 - protein, 9 aa, Homo Sapiens
TSVPLPVTW

SEQ ID NO: 131581 - protein, 9 aa, Homo Sapiens
TSYLGKEHW

SEQ ID NO: 131582 - protein, 9 aa, Homo Sapiens
TTAQVLIRF

SEQ ID NO: 131583 - protein, 9 aa, Homo Sapiens
TTARVTTAF

SEQ ID NO: 131584 - protein, 9 aa, Homo Sapiens
TTHNIPQTF

SEQ ID NO: 131585 - protein, 9 aa, Homo Sapiens
TTIKCMQTI

SEQ ID NO: 131586 - protein, 9 aa, Homo Sapiens
TTKDVEPLL

SEQ ID NO: 131587 - protein, 9 aa, Homo Sapiens
TTKTDDPQL

SEQ ID NO: 131588 - protein, 9 aa, Homo Sapiens
TTLKHSNVW

SEQ ID NO: 131589 - protein, 9 aa, Homo Sapiens
TTLVDNNTW

SEQ ID NO: 131590 - protein, 9 aa, Homo Sapiens
TTTVMNPKF

SEQ ID NO: 131591 - protein, 9 aa, Homo Sapiens
TTYKHQNKL

SEQ ID NO: 131592 - protein, 9 aa, Homo Sapiens
TVAQITQRF

SEQ ID NO: 131593 - protein, 9 aa, Homo Sapiens
TVLTTHHHW

SEQ ID NO: 131594 - protein, 9 aa, Homo Sapiens
TVYDKPASF

SEQ ID NO: 131595 - protein, 9 aa, Homo Sapiens
TVYPKPEEW

SEQ ID NO: 131596 - protein, 9 aa, Homo Sapiens
VAFHFNPRF

SEQ ID NO: 131597 - protein, 9 aa, Homo Sapiens
VALQDHFKW

SEQ ID NO: 131598 - protein, 9 aa, Homo Sapiens
VARKSEEHW

SEQ ID NO: 131599 - protein, 9 aa, Homo Sapiens
VIWPNPVIW

SEQ ID NO: 131600 - protein, 9 aa, Homo Sapiens
VSADLNNKF

SEQ ID NO: 131601 - protein, 9 aa, Homo Sapiens
VSAGIQTSF

SEQ ID NO: 131602 - protein, 9 aa, Homo Sapiens
VSAPSSETF

SEQ ID NO: 131603 - protein, 9 aa, Homo Sapiens
VSCRLVVLL

SEQ ID NO: 131604 - protein, 9 aa, Homo Sapiens
VSDKNHMHF

SEQ ID NO: 131605 - protein, 9 aa, Homo Sapiens
VSEHQPTTW

SEQ ID NO: 131606 - protein, 9 aa, Homo Sapiens
VSFAEKNGW

SEQ ID NO: 131607 - protein, 9 aa, Homo Sapiens
VSFQHPHKY

SEQ ID NO: 131608 - protein, 9 aa, Homo Sapiens
VSFYNQNKW

SEQ ID NO: 131609 - protein, 9 aa, Homo Sapiens
VSIRDILSW

SEQ ID NO: 131610 - protein, 9 aa, Homo Sapiens
VSKEEPVTF

SEQ ID NO: 131611 - protein, 9 aa, Homo Sapiens
VSKPDLITF

SEQ ID NO: 131612 - protein, 9 aa, Homo Sapiens
VSKPDLITW

SEQ ID NO: 131613 - protein, 9 aa, Homo Sapiens
VSKRIEPSV

SEQ ID NO: 131614 - protein, 9 aa, Homo Sapiens
VSLKVGETI

SEQ ID NO: 131615 - protein, 9 aa, Homo Sapiens
VSLPSHLNI

SEQ ID NO: 131616 - protein, 9 aa, Homo Sapiens
VSLTLTNKF

SEQ ID NO: 131617 - protein, 9 aa, Homo Sapiens
VSNRCITTF

SEQ ID NO: 131618 - protein, 9 aa, Homo Sapiens
VSPKTLLTF

SEQ ID NO: 131619 - protein, 9 aa, Homo Sapiens
VSPRINLTW

SEQ ID NO: 131620 - protein, 9 aa, Homo Sapiens
VSRPENEQL

SEQ ID NO: 131621 - protein, 9 aa, Homo Sapiens
VSSDVQSVF

SEQ ID NO: 131622 - protein, 9 aa, Homo Sapiens
VSTVLTSKY

SEQ ID NO: 131623 - protein, 9 aa, Homo Sapiens
VSVKLLTSF

SEQ ID NO: 131624 - protein, 9 aa, Homo Sapiens
VSYISKEHF

SEQ ID NO: 131625 - protein, 9 aa, Homo Sapiens
VSYKNPSLM

SEQ ID NO: 131626 - protein, 9 aa, Homo Sapiens
VSYPGKNKI

SEQ ID NO: 131627 - protein, 9 aa, Homo Sapiens
VTAHLAAKW

SEQ ID NO: 131628 - protein, 9 aa, Homo Sapiens
VTCETKELF

SEQ ID NO: 131629 - protein, 9 aa, Homo Sapiens
VTCPVAKEI

SEQ ID NO: 131630 - protein, 9 aa, Homo Sapiens
VTDIHQLSF

SEQ ID NO: 131631 - protein, 9 aa, Homo Sapiens
VTDNAVYHW

SEQ ID NO: 131632 - protein, 9 aa, Homo Sapiens
VTFLLPAGW

SEQ ID NO: 131633 - protein, 9 aa, Homo Sapiens
VTFPECVRW

SEQ ID NO: 131634 - protein, 9 aa, Homo Sapiens
VTHSVRIGF

SEQ ID NO: 131635 - protein, 9 aa, Homo Sapiens
VTIKKALTL

SEQ ID NO: 131636 - protein, 9 aa, Homo Sapiens
VTIRLLETI

SEQ ID NO: 131637 - protein, 9 aa, Homo Sapiens
VTKKTYEIW

SEQ ID NO: 131638 - protein, 9 aa, Homo Sapiens
VTKSVDFHF

SEQ ID NO: 131639 - protein, 9 aa, Homo Sapiens
VTLEFAQKW

SEQ ID NO: 131640 - protein, 9 aa, Homo Sapiens
VTLPEAIHF

SEQ ID NO: 131641 - protein, 9 aa, Homo Sapiens
VTNKSVSVW

SEQ ID NO: 131642 - protein, 9 aa, Homo Sapiens
VTNPHSSQW

SEQ ID NO: 131643 - protein, 9 aa, Homo Sapiens
VTNPHTDAW

SEQ ID NO: 131644 - protein, 9 aa, Homo Sapiens
VTNPYQATI

SEQ ID NO: 131645 - protein, 9 aa, Homo Sapiens
VTPKSPYTF

SEQ ID NO: 131646 - protein, 9 aa, Homo Sapiens
VTQRLNSQW

SEQ ID NO: 131647 - protein, 9 aa, Homo Sapiens
VTRDIVENW

SEQ ID NO: 131648 - protein, 9 aa, Homo Sapiens
VTRHEHEAW

SEQ ID NO: 131649 - protein, 9 aa, Homo Sapiens
VTRPEPQAL

SEQ ID NO: 131650 - protein, 9 aa, Homo Sapiens
VTSHFQVTL

SEQ ID NO: 131651 - protein, 9 aa, Homo Sapiens
VTSPLTVEW

SEQ ID NO: 131652 - protein, 9 aa, Homo Sapiens
VTSTILQTI

SEQ ID NO: 131653 - protein, 9 aa, Homo Sapiens
VTTVVNPKY

SEQ ID NO: 131654 - protein, 9 aa, Homo Sapiens
VTVAVVDTF

SEQ ID NO: 131655 - protein, 9 aa, Homo Sapiens
VTVKDMYLF

SEQ ID NO: 131656 - protein, 9 aa, Homo Sapiens
VTWELKCTF

SEQ ID NO: 131657 - protein, 9 aa, Homo Sapiens
VTYKNVPNW

SEQ ID NO: 131658 - protein, 9 aa, Homo Sapiens
VTYPGELLL

SEQ ID NO: 131659 - protein, 9 aa, Homo Sapiens
VTYVPVTTF

SEQ ID NO: 131660 - protein, 9 aa, Homo Sapiens
VVMPIAHEF

SEQ ID NO: 131661 - protein, 9 aa, Homo Sapiens
VVVPQAPEF

SEQ ID NO: 131662 - protein, 9 aa, Homo Sapiens
YAYDGKDYI

SEQ ID NO: 131663 - protein, 9 aa, Homo Sapiens
YSIPLRENW

SEQ ID NO: 131664 - protein, 9 aa, Homo Sapiens
YSIRGQLSW

SEQ ID NO: 131665 - protein, 9 aa, Homo Sapiens
YSLKKRHFF

SEQ ID NO: 131666 - protein, 9 aa, Homo Sapiens
YSLPNAPTL

SEQ ID NO: 131667 - protein, 9 aa, Homo Sapiens
YSLQHKLLL

SEQ ID NO: 131668 - protein, 9 aa, Homo Sapiens
YSMENANKW

SEQ ID NO: 131669 - protein, 9 aa, Homo Sapiens
YSPKIEVHF

SEQ ID NO: 131670 - protein, 9 aa, Homo Sapiens
YSPRAIHSW

SEQ ID NO: 131671 - protein, 9 aa, Homo Sapiens
YSQKAQNSW

SEQ ID NO: 131672 - protein, 9 aa, Homo Sapiens
YSRNEPLTF

SEQ ID NO: 131673 - protein, 9 aa, Homo Sapiens
YSVRVSPQM

SEQ ID NO: 131674 - protein, 9 aa, Homo Sapiens
YTCPFVEKF

SEQ ID NO: 131675 - protein, 9 aa, Homo Sapiens
YTHEVVTLW

SEQ ID NO: 131676 - protein, 9 aa, Homo Sapiens
YTHQVVTRW

SEQ ID NO: 131677 - protein, 9 aa, Homo Sapiens
YTLRILRQL

SEQ ID NO: 131678 - protein, 9 aa, Homo Sapiens
YTNKVITLW

SEQ ID NO: 131679 - protein, 9 aa, Homo Sapiens
YTNKYSSQF

SEQ ID NO: 131680 - protein, 9 aa, Homo Sapiens
YTNRVVTLW

SEQ ID NO: 131681 - protein, 9 aa, Homo Sapiens
YTSRIVVRL

SEQ ID NO: 131682 - protein, 9 aa, Homo Sapiens
YTTKIKPRL

SEQ ID NO: 131683 - protein, 9 aa, Homo Sapiens
YTVRVIDVF

SEQ ID NO: 131684 - protein, 9 aa, Homo Sapiens
YTYKKQVKI

SEQ ID NO: 131685 - protein, 9 aa, Homo Sapiens
YTYRGPKAF

SEQ ID NO: 131686 - protein, 10 aa, Homo Sapiens
AAAAAAAAAW

SEQ ID NO: 131687 - protein, 10 aa, Homo Sapiens
AAALPAAALW

SEQ ID NO: 131688 - protein, 10 aa, Homo Sapiens
AAGHAELAWT

SEQ ID NO: 131689 - protein, 10 aa, Homo Sapiens
AALPDQSFLW

SEQ ID NO: 131690 - protein, 10 aa, Homo Sapiens
AHSNLNGVWH

SEQ ID NO: 131691 - protein, 10 aa, Homo Sapiens
ASCGVNLYQF

SEQ ID NO: 131692 - protein, 10 aa, Homo Sapiens
ASFNDNIIKW

SEQ ID NO: 131693 - protein, 10 aa, Homo Sapiens
ASLNLPAVSW

SEQ ID NO: 131694 - protein, 10 aa, Homo Sapiens
ASRIIRNEQF

SEQ ID NO: 131695 - protein, 10 aa, Homo Sapiens
ASSRQIISHW

SEQ ID NO: 131696 - protein, 10 aa, Homo Sapiens
ASYQDRRQSW

SEQ ID NO: 131697 - protein, 10 aa, Homo Sapiens
ATAKAVAVTL

SEQ ID NO: 131698 - protein, 10 aa, Homo Sapiens
ATCHVVSDSW

SEQ ID NO: 131699 - protein, 10 aa, Homo Sapiens
ATCKDLVMFI

SEQ ID NO: 131700 - protein, 10 aa, Homo Sapiens
ATKVGKDELF

SEQ ID NO: 131701 - protein, 10 aa, Homo Sapiens
ATLAAVLQRI

SEQ ID NO: 131702 - protein, 10 aa, Homo Sapiens
ATLKDRELSF

SEQ ID NO: 131703 - protein, 10 aa, Homo Sapiens
ATLKIRNSNF

SEQ ID NO: 131704 - protein, 10 aa, Homo Sapiens
ATLTIQGIRF

SEQ ID NO: 131705 - protein, 10 aa, Homo Sapiens
ATRDELPYTF

SEQ ID NO: 131706 - protein, 10 aa, Homo Sapiens
AVNPRDPPSW

SEQ ID NO: 131707 - protein, 10 aa, Homo Sapiens
AVSEAVRQLW

SEQ ID NO: 131708 - protein, 10 aa, Homo Sapiens
EEFAKLIQTI

SEQ ID NO: 131709 - protein, 10 aa, Homo Sapiens
FSAAEARQKF

SEQ ID NO: 131710 - protein, 10 aa, Homo Sapiens
FSLQAPAPLM

SEQ ID NO: 131711 - protein, 10 aa, Homo Sapiens
FTLRDEGKTI

SEQ ID NO: 131712 - protein, 10 aa, Homo Sapiens
FTLRDMYEQF

SEQ ID NO: 131713 - protein, 10 aa, Homo Sapiens
FTLREVQERW

SEQ ID NO: 131714 - protein, 10 aa, Homo Sapiens
GALPNLRELW

SEQ ID NO: 131715 - protein, 10 aa, Homo Sapiens
GALRVLNSYW

SEQ ID NO: 131716 - protein, 10 aa, Homo Sapiens
GLIALAVLAC

SEQ ID NO: 131717 - protein, 10 aa, Homo Sapiens
GPPPPPGKPQ

SEQ ID NO: 131718 - protein, 10 aa, Homo Sapiens
GTCVAVNNKY

SEQ ID NO: 131719 - protein, 10 aa, Homo Sapiens
GTWLPSRAEW

SEQ ID NO: 131720 - protein, 10 aa, Homo Sapiens
GTYENLIHVW

SEQ ID NO: 131721 - protein, 10 aa, Homo Sapiens
GTYYIKEQKL

SEQ ID NO: 131722 - protein, 10 aa, Homo Sapiens
HACALAASLW

SEQ ID NO: 131723 - protein, 10 aa, Homo Sapiens
HAFDGFEVNW

SEQ ID NO: 131724 - protein, 10 aa, Homo Sapiens
HSAAVNGLSF

SEQ ID NO: 131725 - protein, 10 aa, Homo Sapiens
HSAVVEDVAW

SEQ ID NO: 131726 - protein, 10 aa, Homo Sapiens
HSCEVKGIEW

SEQ ID NO: 131727 - protein, 10 aa, Homo Sapiens
HSGPGLLQLW

SEQ ID NO: 131728 - protein, 10 aa, Homo Sapiens
HSGPVVAMVW

SEQ ID NO: 131729 - protein, 10 aa, Homo Sapiens
HSLDQSIISF

SEQ ID NO: 131730 - protein, 10 aa, Homo Sapiens
HSMDPPTFTF

SEQ ID NO: 131731 - protein, 10 aa, Homo Sapiens
HSMLDINALF

SEQ ID NO: 131732 - protein, 10 aa, Homo Sapiens
HSMSDPGVSY

SEQ ID NO: 131733 - protein, 10 aa, Homo Sapiens
HSNPGDPALW

SEQ ID NO: 131734 - protein, 10 aa, Homo Sapiens
HSQEVTSVCW

SEQ ID NO: 131735 - protein, 10 aa, Homo Sapiens
HSSGVTGVTF

SEQ ID NO: 131736 - protein, 10 aa, Homo Sapiens
HSSHVTNVSF

SEQ ID NO: 131737 - protein, 10 aa, Homo Sapiens
HSYRGHLWLF

SEQ ID NO: 131738 - protein, 10 aa, Homo Sapiens
HTADVQLHAW

SEQ ID NO: 131739 - protein, 10 aa, Homo Sapiens
HTAEVNCLSF

SEQ ID NO: 131740 - protein, 10 aa, Homo Sapiens
HTAKISDFSW

SEQ ID NO: 131741 - protein, 10 aa, Homo Sapiens
HTAPVLDIAW

SEQ ID NO: 131742 - protein, 10 aa, Homo Sapiens
HTATVIANSF

SEQ ID NO: 131743 - protein, 10 aa, Homo Sapiens
HTAVVEDVSW

SEQ ID NO: 131744 - protein, 10 aa, Homo Sapiens
HTFTFSHATF

SEQ ID NO: 131745 - protein, 10 aa, Homo Sapiens
HTGPVLDVCW

SEQ ID NO: 131746 - protein, 10 aa, Homo Sapiens
HTIGCNAVSW

SEQ ID NO: 131747 - protein, 10 aa, Homo Sapiens
HTLDDRTQLW

SEQ ID NO: 131748 - protein, 10 aa, Homo Sapiens
HTLGDAHIYL

SEQ ID NO: 131749 - protein, 10 aa, Homo Sapiens
HTSREVLIIF

SEQ ID NO: 131750 - protein, 10 aa, Homo Sapiens
HTVAIDNQIF

SEQ ID NO: 131751 - protein, 10 aa, Homo Sapiens
HTVYNIITNF

SEQ ID NO: 131752 - protein, 10 aa, Homo Sapiens
ILYPHEAPSW

SEQ ID NO: 131753 - protein, 10 aa, Homo Sapiens
INSTVRLYEW

SEQ ID NO: 131754 - protein, 10 aa, Homo Sapiens
ISAIPANIHI

SEQ ID NO: 131755 - protein, 10 aa, Homo Sapiens
ISAKDLKNML

SEQ ID NO: 131756 - protein, 10 aa, Homo Sapiens
ISAPDSQVRF

SEQ ID NO: 131757 - protein, 10 aa, Homo Sapiens
ISASSLTSKW

SEQ ID NO: 131758 - protein, 10 aa, Homo Sapiens
ISATEVDSRW

SEQ ID NO: 131759 - protein, 10 aa, Homo Sapiens
ISCDTGIILL

SEQ ID NO: 131760 - protein, 10 aa, Homo Sapiens
ISCRIINTFL

SEQ ID NO: 131761 - protein, 10 aa, Homo Sapiens
ISFHNIHNTF

SEQ ID NO: 131762 - protein, 10 aa, Homo Sapiens
ISISVDGLKF

SEQ ID NO: 131763 - protein, 10 aa, Homo Sapiens
ISKKEIGRCF

SEQ ID NO: 131764 - protein, 10 aa, Homo Sapiens
ISKKPESTSF

SEQ ID NO: 131765 - protein, 10 aa, Homo Sapiens
ISKMIINEEL

SEQ ID NO: 131766 - protein, 10 aa, Homo Sapiens
ISKPGQFETF

SEQ ID NO: 131767 - protein, 10 aa, Homo Sapiens
ISKQDAQELF

SEQ ID NO: 131768 - protein, 10 aa, Homo Sapiens
ISLADIAQKL

SEQ ID NO: 131769 - protein, 10 aa, Homo Sapiens
ISLIPPEERW

SEQ ID NO: 131770 - protein, 10 aa, Homo Sapiens
ISLLAQNTSW

SEQ ID NO: 131771 - protein, 10 aa, Homo Sapiens
ISLLNEPNTF

SEQ ID NO: 131772 - protein, 10 aa, Homo Sapiens
ISLPGIRNEF

SEQ ID NO: 131773 - protein, 10 aa, Homo Sapiens
ISLPNGLQGF

SEQ ID NO: 131774 - protein, 10 aa, Homo Sapiens
ISLRQPPMAF

SEQ ID NO: 131775 - protein, 10 aa, Homo Sapiens
ISMPDFDLHL

SEQ ID NO: 131776 - protein, 10 aa, Homo Sapiens
ISMPDVDLHL

SEQ ID NO: 131777 - protein, 10 aa, Homo Sapiens
ISNLVDAIYK

SEQ ID NO: 131778 - protein, 10 aa, Homo Sapiens
ISPRGAGWLF

SEQ ID NO: 131779 - protein, 10 aa, Homo Sapiens
ISPRGAGYTF

SEQ ID NO: 131780 - protein, 10 aa, Homo Sapiens
ISQPASGNTF

SEQ ID NO: 131781 - protein, 10 aa, Homo Sapiens
ISQSAVKTKF

SEQ ID NO: 131782 - protein, 10 aa, Homo Sapiens
ISSIKGAEEW

SEQ ID NO: 131783 - protein, 10 aa, Homo Sapiens
ISSSDLVSKW

SEQ ID NO: 131784 - protein, 10 aa, Homo Sapiens
ISSTAFDIRF

SEQ ID NO: 131785 - protein, 10 aa, Homo Sapiens
ISVPGLQTNW

SEQ ID NO: 131786 - protein, 10 aa, Homo Sapiens
ISVQVNSIKF

SEQ ID NO: 131787 - protein, 10 aa, Homo Sapiens
ISWTGDGWEF

SEQ ID NO: 131788 - protein, 10 aa, Homo Sapiens
ITAENVAKKW

SEQ ID NO: 131789 - protein, 10 aa, Homo Sapiens
ITFPNKEIAW

SEQ ID NO: 131790 - protein, 10 aa, Homo Sapiens
ITFQPDLSKF

SEQ ID NO: 131791 - protein, 10 aa, Homo Sapiens
ITKADAAEFW

SEQ ID NO: 131792 - protein, 10 aa, Homo Sapiens
ITLIVDGHHF

SEQ ID NO: 131793 - protein, 10 aa, Homo Sapiens
ITLIVENVHF

SEQ ID NO: 131794 - protein, 10 aa, Homo Sapiens
ITLRQTITTF

SEQ ID NO: 131795 - protein, 10 aa, Homo Sapiens
ITVDGKPPTW

SEQ ID NO: 131796 - protein, 10 aa, Homo Sapiens
IVYPGIAVFF

SEQ ID NO: 131797 - protein, 10 aa, Homo Sapiens
KAAEVFFETF

SEQ ID NO: 131798 - protein, 10 aa, Homo Sapiens
KAATIGQIGW

SEQ ID NO: 131799 - protein, 10 aa, Homo Sapiens
KAGPIWDLRL

SEQ ID NO: 131800 - protein, 10 aa, Homo Sapiens
KAHGVKNLVF

SEQ ID NO: 131801 - protein, 10 aa, Homo Sapiens
KAIADRGWRF

SEQ ID NO: 131802 - protein, 10 aa, Homo Sapiens
KAIDLSRNQF

SEQ ID NO: 131803 - protein, 10 aa, Homo Sapiens
KAIPDTRLTI

SEQ ID NO: 131804 - protein, 10 aa, Homo Sapiens
KAIPSFLNSF

SEQ ID NO: 131805 - protein, 10 aa, Homo Sapiens
KAKEFVADIF

SEQ ID NO: 131806 - protein, 10 aa, Homo Sapiens
KAKMTDFDRF

SEQ ID NO: 131807 - protein, 10 aa, Homo Sapiens
KALADVEVTY

SEQ ID NO: 131808 - protein, 10 aa, Homo Sapiens
KALDVMVSTF

SEQ ID NO: 131809 - protein, 10 aa, Homo Sapiens
KALEDARINL

SEQ ID NO: 131810 - protein, 10 aa, Homo Sapiens
KALEGIISNF

SEQ ID NO: 131811 - protein, 10 aa, Homo Sapiens
KALELDSNLY

SEQ ID NO: 131812 - protein, 10 aa, Homo Sapiens
KALKDIKVGF

SEQ ID NO: 131813 - protein, 10 aa, Homo Sapiens
KALKDYKSSF

SEQ ID NO: 131814 - protein, 10 aa, Homo Sapiens
KALPALPISI

SEQ ID NO: 131815 - protein, 10 aa, Homo Sapiens
KALQDVQIRF

SEQ ID NO: 131816 - protein, 10 aa, Homo Sapiens
KAMEDGGVKL

SEQ ID NO: 131817 - protein, 10 aa, Homo Sapiens
KAPLHLDVTW

SEQ ID NO: 131818 - protein, 10 aa, Homo Sapiens
KARLTEGCSF

SEQ ID NO: 131819 - protein, 10 aa, Homo Sapiens
KARVETQNHW

SEQ ID NO: 131820 - protein, 10 aa, Homo Sapiens
KAVDIVKQVW

SEQ ID NO: 131821 - protein, 10 aa, Homo Sapiens
KAVEAAHTFF

SEQ ID NO: 131822 - protein, 10 aa, Homo Sapiens
KAVEDIHGLF

SEQ ID NO: 131823 - protein, 10 aa, Homo Sapiens
KAVIDLNNRW

SEQ ID NO: 131824 - protein, 10 aa, Homo Sapiens
KAWAEYVVEW

SEQ ID NO: 131825 - protein, 10 aa, Homo Sapiens
KAYGPKVDIW

SEQ ID NO: 131826 - protein, 10 aa, Homo Sapiens
KGFSEEHNTW

SEQ ID NO: 131827 - protein, 10 aa, Homo Sapiens
KGFTDADNTW

SEQ ID NO: 131828 - protein, 10 aa, Homo Sapiens
KGWDGYDVQW

SEQ ID NO: 131829 - protein, 10 aa, Homo Sapiens
KIIEDLGVHF

SEQ ID NO: 131830 - protein, 10 aa, Homo Sapiens
KLIDVTNIYW

SEQ ID NO: 131831 - protein, 10 aa, Homo Sapiens
KLKKPEAVRW

SEQ ID NO: 131832 - protein, 10 aa, Homo Sapiens
KLLPVLVHTF

SEQ ID NO: 131833 - protein, 10 aa, Homo Sapiens
KSAEAVGVKI

SEQ ID NO: 131834 - protein, 10 aa, Homo Sapiens
KSAEKEISLW

SEQ ID NO: 131835 - protein, 10 aa, Homo Sapiens
KSAEQLRIEL

SEQ ID NO: 131836 - protein, 10 aa, Homo Sapiens
KSAPDQEVRI

SEQ ID NO: 131837 - protein, 10 aa, Homo Sapiens
KSARVKGLSF

SEQ ID NO: 131838 - protein, 10 aa, Homo Sapiens
KSATDTSAKW

SEQ ID NO: 131839 - protein, 10 aa, Homo Sapiens
KSAVELVQEF

SEQ ID NO: 131840 - protein, 10 aa, Homo Sapiens
KSAWQTLNEF

SEQ ID NO: 131841 - protein, 10 aa, Homo Sapiens
KSCSKLFQRW

SEQ ID NO: 131842 - protein, 10 aa, Homo Sapiens
KSFEKAKESW

SEQ ID NO: 131843 - protein, 10 aa, Homo Sapiens
KSFKDNYNTL

SEQ ID NO: 131844 - protein, 10 aa, Homo Sapiens
KSFKLSGFSF

SEQ ID NO: 131845 - protein, 10 aa, Homo Sapiens
KSFLPVVSTF

SEQ ID NO: 131846 - protein, 10 aa, Homo Sapiens
KSFLSQGQVL

SEQ ID NO: 131847 - protein, 10 aa, Homo Sapiens
KSFPGGKEYL

SEQ ID NO: 131848 - protein, 10 aa, Homo Sapiens
KSFQKIQVRL

SEQ ID NO: 131849 - protein, 10 aa, Homo Sapiens
KSFSQSSTLF

SEQ ID NO: 131850 - protein, 10 aa, Homo Sapiens
KSFSTVTNTF

SEQ ID NO: 131851 - protein, 10 aa, Homo Sapiens
KSFTQIQATF

SEQ ID NO: 131852 - protein, 10 aa, Homo Sapiens
KSFYGSTLFL

SEQ ID NO: 131853 - protein, 10 aa, Homo Sapiens
KSGPVVSLGW

SEQ ID NO: 131854 - protein, 10 aa, Homo Sapiens
KSHDDIVTEF

SEQ ID NO: 131855 - protein, 10 aa, Homo Sapiens
KSIDEMNNAW

SEQ ID NO: 131856 - protein, 10 aa, Homo Sapiens
KSIEFLSSKW

SEQ ID NO: 131857 - protein, 10 aa, Homo Sapiens
KSIGDIFLKY

SEQ ID NO: 131858 - protein, 10 aa, Homo Sapiens
KSIHLSINFF

SEQ ID NO: 131859 - protein, 10 aa, Homo Sapiens
KSINEFWNKF

SEQ ID NO: 131860 - protein, 10 aa, Homo Sapiens
KSINSEVLKF

SEQ ID NO: 131861 - protein, 10 aa, Homo Sapiens
KSITEINANF

SEQ ID NO: 131862 - protein, 10 aa, Homo Sapiens
KSITIIGGGF

SEQ ID NO: 131863 - protein, 10 aa, Homo Sapiens
KSKGNYDEGF

SEQ ID NO: 131864 - protein, 10 aa, Homo Sapiens
KSKGSQTEEW

SEQ ID NO: 131865 - protein, 10 aa, Homo Sapiens
KSKINVNEIF

SEQ ID NO: 131866 - protein, 10 aa, Homo Sapiens
KSLALLGQTF

SEQ ID NO: 131867 - protein, 10 aa, Homo Sapiens
KSLDHQGINF

SEQ ID NO: 131868 - protein, 10 aa, Homo Sapiens
KSLDLLTMKN

SEQ ID NO: 131869 - protein, 10 aa, Homo Sapiens
KSLDQAISRF

SEQ ID NO: 131870 - protein, 10 aa, Homo Sapiens
KSLDQIFETL

SEQ ID NO: 131871 - protein, 10 aa, Homo Sapiens
KSLEDKSLEF

SEQ ID NO: 131872 - protein, 10 aa, Homo Sapiens
KSLEDLKATL

SEQ ID NO: 131873 - protein, 10 aa, Homo Sapiens
KSLEKVLVEF

SEQ ID NO: 131874 - protein, 10 aa, Homo Sapiens
KSLELAIGRF

SEQ ID NO: 131875 - protein, 10 aa, Homo Sapiens
KSLEVSDTRF

SEQ ID NO: 131876 - protein, 10 aa, Homo Sapiens
KSLGLLTTKF

SEQ ID NO: 131877 - protein, 10 aa, Homo Sapiens
KSLGSSDLKF

SEQ ID NO: 131878 - protein, 10 aa, Homo Sapiens
KSLIIVHPSW

SEQ ID NO: 131879 - protein, 10 aa, Homo Sapiens
KSLKDPSNNF

SEQ ID NO: 131880 - protein, 10 aa, Homo Sapiens
KSLLGKDVLF

SEQ ID NO: 131881 - protein, 10 aa, Homo Sapiens
KSLPAEINRM

SEQ ID NO: 131882 - protein, 10 aa, Homo Sapiens
KSLRFIDVEF

SEQ ID NO: 131883 - protein, 10 aa, Homo Sapiens
KSMYGVYNTF

SEQ ID NO: 131884 - protein, 10 aa, Homo Sapiens
KSNDISIHHF

SEQ ID NO: 131885 - protein, 10 aa, Homo Sapiens
KSPPASPESW

SEQ ID NO: 131886 - protein, 10 aa, Homo Sapiens
KSPPVLSHEF

SEQ ID NO: 131887 - protein, 10 aa, Homo Sapiens
KSQPEPSPVL

SEQ ID NO: 131888 - protein, 10 aa, Homo Sapiens
KSSDGPIQRF

SEQ ID NO: 131889 - protein, 10 aa, Homo Sapiens
KSSGQMAQKF

SEQ ID NO: 131890 - protein, 10 aa, Homo Sapiens
KSSIAGSSTW

SEQ ID NO: 131891 - protein, 10 aa, Homo Sapiens
KSSTAPSRNF

SEQ ID NO: 131892 - protein, 10 aa, Homo Sapiens
KSTALQTWLF

SEQ ID NO: 131893 - protein, 10 aa, Homo Sapiens
KSTDYMNLHF

SEQ ID NO: 131894 - protein, 10 aa, Homo Sapiens
KSTEILLRKL

SEQ ID NO: 131895 - protein, 10 aa, Homo Sapiens
KSTGELVVQW

SEQ ID NO: 131896 - protein, 10 aa, Homo Sapiens
KSTPYTAVRW

SEQ ID NO: 131897 - protein, 10 aa, Homo Sapiens
KSVAVKTTRF

SEQ ID NO: 131898 - protein, 10 aa, Homo Sapiens
KSVDDHIVRF

SEQ ID NO: 131899 - protein, 10 aa, Homo Sapiens
KSVELEDVKF

SEQ ID NO: 131900 - protein, 10 aa, Homo Sapiens
KSVENLGVSY

SEQ ID NO: 131901 - protein, 10 aa, Homo Sapiens
KSVIDYQTHF

SEQ ID NO: 131902 - protein, 10 aa, Homo Sapiens
KSVKTGSVFW

SEQ ID NO: 131903 - protein, 10 aa, Homo Sapiens
KSVSFSDVFF

SEQ ID NO: 131904 - protein, 10 aa, Homo Sapiens
KSWLKGLVTF

SEQ ID NO: 131905 - protein, 10 aa, Homo Sapiens
KSWQGVTIYF

SEQ ID NO: 131906 - protein, 10 aa, Homo Sapiens
KSYLEREDFF

SEQ ID NO: 131907 - protein, 10 aa, Homo Sapiens
KSYRIIYNLF

SEQ ID NO: 131908 - protein, 10 aa, Homo Sapiens
KTAEDAKDFF

SEQ ID NO: 131909 - protein, 10 aa, Homo Sapiens
KTAEEIKQIW

SEQ ID NO: 131910 - protein, 10 aa, Homo Sapiens
KTAEEVAALI

SEQ ID NO: 131911 - protein, 10 aa, Homo Sapiens
KTAVETAVLL

SEQ ID NO: 131912 - protein, 10 aa, Homo Sapiens
KTAVIDHHNY

SEQ ID NO: 131913 - protein, 10 aa, Homo Sapiens
KTAYISIQQF

SEQ ID NO: 131914 - protein, 10 aa, Homo Sapiens
KTFDSSCHFF

SEQ ID NO: 131915 - protein, 10 aa, Homo Sapiens
KTFEDRMDLF

SEQ ID NO: 131916 - protein, 10 aa, Homo Sapiens
KTFGQKPVKF

SEQ ID NO: 131917 - protein, 10 aa, Homo Sapiens
KTFKDVGNLL

SEQ ID NO: 131918 - protein, 10 aa, Homo Sapiens
KTFQDGATKL

SEQ ID NO: 131919 - protein, 10 aa, Homo Sapiens
KTGADVCRLW

SEQ ID NO: 131920 - protein, 10 aa, Homo Sapiens
KTIDDLEDKL

SEQ ID NO: 131921 - protein, 10 aa, Homo Sapiens
KTIDDLEEKL

SEQ ID NO: 131922 - protein, 10 aa, Homo Sapiens
KTIDGQQTII

SEQ ID NO: 131923 - protein, 10 aa, Homo Sapiens
KTIDICHDHF

SEQ ID NO: 131924 - protein, 10 aa, Homo Sapiens
KTIEDFQQKI

SEQ ID NO: 131925 - protein, 10 aa, Homo Sapiens
KTIEDVREFL

SEQ ID NO: 131926 - protein, 10 aa, Homo Sapiens
KTIEESEETL

SEQ ID NO: 131927 - protein, 10 aa, Homo Sapiens
KTIEFGKTNF

SEQ ID NO: 131928 - protein, 10 aa, Homo Sapiens
KTIEGIYEKF

SEQ ID NO: 131929 - protein, 10 aa, Homo Sapiens
KTIGGGDDSF

SEQ ID NO: 131930 - protein, 10 aa, Homo Sapiens
KTIKAFKNRF

SEQ ID NO: 131931 - protein, 10 aa, Homo Sapiens
KTIQIPEHLM

SEQ ID NO: 131932 - protein, 10 aa, Homo Sapiens
KTKDFQESSI

SEQ ID NO: 131933 - protein, 10 aa, Homo Sapiens
KTKDGVREVF

SEQ ID NO: 131934 - protein, 10 aa, Homo Sapiens
KTKEGVREVF

SEQ ID NO: 131935 - protein, 10 aa, Homo Sapiens
KTKNAQQVHF

SEQ ID NO: 131936 - protein, 10 aa, Homo Sapiens
KTKSCSGVEF

SEQ ID NO: 131937 - protein, 10 aa, Homo Sapiens
KTKSENGLEF

SEQ ID NO: 131938 - protein, 10 aa, Homo Sapiens
KTLADLLESF

SEQ ID NO: 131939 - protein, 10 aa, Homo Sapiens
KTLAEINQKW

SEQ ID NO: 131940 - protein, 10 aa, Homo Sapiens
KTLALEIINF

SEQ ID NO: 131941 - protein, 10 aa, Homo Sapiens
KTLDFELDTF

SEQ ID NO: 131942 - protein, 10 aa, Homo Sapiens
KTLDQAIMKF

SEQ ID NO: 131943 - protein, 10 aa, Homo Sapiens
KTLDSASAHF

SEQ ID NO: 131944 - protein, 10 aa, Homo Sapiens
KTLDSWRDEF

SEQ ID NO: 131945 - protein, 10 aa, Homo Sapiens
KTLDVFNITI

SEQ ID NO: 131946 - protein, 10 aa, Homo Sapiens
KTLEECRVTL

SEQ ID NO: 131947 - protein, 10 aa, Homo Sapiens
KTLEHRGFKL

SEQ ID NO: 131948 - protein, 10 aa, Homo Sapiens
KTLEHVAVTV

SEQ ID NO: 131949 - protein, 10 aa, Homo Sapiens
KTLEKIRPVF

SEQ ID NO: 131950 - protein, 10 aa, Homo Sapiens
KTLESDCTKL

SEQ ID NO: 131951 - protein, 10 aa, Homo Sapiens
KTLESSIQGL

SEQ ID NO: 131952 - protein, 10 aa, Homo Sapiens
KTLGANAQTL

SEQ ID NO: 131953 - protein, 10 aa, Homo Sapiens
KTLGGVIFRK

SEQ ID NO: 131954 - protein, 10 aa, Homo Sapiens
KTLHDTRTHF

SEQ ID NO: 131955 - protein, 10 aa, Homo Sapiens
KTLKEIRNAF

SEQ ID NO: 131956 - protein, 10 aa, Homo Sapiens
KTLNVESNFI

SEQ ID NO: 131957 - protein, 10 aa, Homo Sapiens
KTLPADVQNY

SEQ ID NO: 131958 - protein, 10 aa, Homo Sapiens
KTLPFYKDYF

SEQ ID NO: 131959 - protein, 10 aa, Homo Sapiens
KTLQEFLERI

SEQ ID NO: 131960 - protein, 10 aa, Homo Sapiens
KTLQEVHFLL

SEQ ID NO: 131961 - protein, 10 aa, Homo Sapiens
KTLSDATTKF

SEQ ID NO: 131962 - protein, 10 aa, Homo Sapiens
KTLSDIFLLF

SEQ ID NO: 131963 - protein, 10 aa, Homo Sapiens
KTLSTFKESW

SEQ ID NO: 131964 - protein, 10 aa, Homo Sapiens
KTLTGKTITL

SEQ ID NO: 131965 - protein, 10 aa, Homo Sapiens
KTLTMDILTL

SEQ ID NO: 131966 - protein, 10 aa, Homo Sapiens
KTLVDQRFLI

SEQ ID NO: 131967 - protein, 10 aa, Homo Sapiens
KTLVLSNLSY

SEQ ID NO: 131968 - protein, 10 aa, Homo Sapiens
KTMKMRGQAF

SEQ ID NO: 131969 - protein, 10 aa, Homo Sapiens
KTNIQKEATW

SEQ ID NO: 131970 - protein, 10 aa, Homo Sapiens
KTNTFQGVIF

SEQ ID NO: 131971 - protein, 10 aa, Homo Sapiens
KTPEEIHKTF

SEQ ID NO: 131972 - protein, 10 aa, Homo Sapiens
KTPEEIRKTF

SEQ ID NO: 131973 - protein, 10 aa, Homo Sapiens
KTPEKEPPLW

SEQ ID NO: 131974 - protein, 10 aa, Homo Sapiens
KTPELNLDQF

SEQ ID NO: 131975 - protein, 10 aa, Homo Sapiens
KTPSSDVLVF

SEQ ID NO: 131976 - protein, 10 aa, Homo Sapiens
KTQEPDNLLF

SEQ ID NO: 131977 - protein, 10 aa, Homo Sapiens
KTQRDFMLSF

SEQ ID NO: 131978 - protein, 10 aa, Homo Sapiens
KTRDDWLVSW

SEQ ID NO: 131979 - protein, 10 aa, Homo Sapiens
KTRQGVEDAF

SEQ ID NO: 131980 - protein, 10 aa, Homo Sapiens
KTSDSTFLVF

SEQ ID NO: 131981 - protein, 10 aa, Homo Sapiens
KTSELLVRKW

SEQ ID NO: 131982 - protein, 10 aa, Homo Sapiens
KTSSTVNTKF

SEQ ID NO: 131983 - protein, 10 aa, Homo Sapiens
KTTAQVLIRF

SEQ ID NO: 131984 - protein, 10 aa, Homo Sapiens
KTTGIPIHVF

SEQ ID NO: 131985 - protein, 10 aa, Homo Sapiens
KTTPDVIFVF

SEQ ID NO: 131986 - protein, 10 aa, Homo Sapiens
KTVAGGAWTY

SEQ ID NO: 131987 - protein, 10 aa, Homo Sapiens
KTVEPTGKRF

SEQ ID NO: 131988 - protein, 10 aa, Homo Sapiens
KTVIDSQTHY

SEQ ID NO: 131989 - protein, 10 aa, Homo Sapiens
KTVQDLLNLM

SEQ ID NO: 131990 - protein, 10 aa, Homo Sapiens
KTVTAMDVVY

SEQ ID NO: 131991 - protein, 10 aa, Homo Sapiens
KTVTELGNQL

SEQ ID NO: 131992 - protein, 10 aa, Homo Sapiens
KTVVGGAMFF

SEQ ID NO: 131993 - protein, 10 aa, Homo Sapiens
KTYDSKRVCF

SEQ ID NO: 131994 - protein, 10 aa, Homo Sapiens
KTYEAALETI

SEQ ID NO: 131995 - protein, 10 aa, Homo Sapiens
KTYGEIFEKF

SEQ ID NO: 131996 - protein, 10 aa, Homo Sapiens
KTYQDIQNTI

SEQ ID NO: 131997 - protein, 10 aa, Homo Sapiens
KVAEAAIQIF

SEQ ID NO: 131998 - protein, 10 aa, Homo Sapiens
KVAELENSEF

SEQ ID NO: 131999 - protein, 10 aa, Homo Sapiens
KVAKEAANRW

SEQ ID NO: 132000 - protein, 10 aa, Homo Sapiens
KVARLDNIFL

SEQ ID NO: 132001 - protein, 10 aa, Homo Sapiens
KVCLSILNTW

SEQ ID NO: 132002 - protein, 10 aa, Homo Sapiens
KVFDPKVFTF

SEQ ID NO: 132003 - protein, 10 aa, Homo Sapiens
KVFESWMHHW

SEQ ID NO: 132004 - protein, 10 aa, Homo Sapiens
KVIAINDLNW

SEQ ID NO: 132005 - protein, 10 aa, Homo Sapiens
KVKPEELESF

SEQ ID NO: 132006 - protein, 10 aa, Homo Sapiens
KVLEEHGEWW

SEQ ID NO: 132007 - protein, 10 aa, Homo Sapiens
KVLIDIREYW

SEQ ID NO: 132008 - protein, 10 aa, Homo Sapiens
KVLPGHFNTF

SEQ ID NO: 132009 - protein, 10 aa, Homo Sapiens
KVLPPLEQVW

SEQ ID NO: 132010 - protein, 10 aa, Homo Sapiens
KVMPLIIQGF

SEQ ID NO: 132011 - protein, 10 aa, Homo Sapiens
LAADLSLHSF

SEQ ID NO: 132012 - protein, 10 aa, Homo Sapiens
LALFNPDVCW

SEQ ID NO: 132013 - protein, 10 aa, Homo Sapiens
LALSPVPSHW

SEQ ID NO: 132014 - protein, 10 aa, Homo Sapiens
LLFPGKAFSW

SEQ ID NO: 132015 - protein, 10 aa, Homo Sapiens
LSAEAIRQRL

SEQ ID NO: 132016 - protein, 10 aa, Homo Sapiens
LSAHGIVVAW

SEQ ID NO: 132017 - protein, 10 aa, Homo Sapiens
LSAQDHQTFF

SEQ ID NO: 132018 - protein, 10 aa, Homo Sapiens
LSDRGQLFSW

SEQ ID NO: 132019 - protein, 10 aa, Homo Sapiens
LSFKDVAVVF

SEQ ID NO: 132020 - protein, 10 aa, Homo Sapiens
LSIPDIKTAF

SEQ ID NO: 132021 - protein, 10 aa, Homo Sapiens
LSKPVPESEF

SEQ ID NO: 132022 - protein, 10 aa, Homo Sapiens
LSKQETGTEF

SEQ ID NO: 132023 - protein, 10 aa, Homo Sapiens
LSLPDIKVYL

SEQ ID NO: 132024 - protein, 10 aa, Homo Sapiens
LSLPEDFYHF

SEQ ID NO: 132025 - protein, 10 aa, Homo Sapiens
LSLPESTESF

SEQ ID NO: 132026 - protein, 10 aa, Homo Sapiens
LSMPASLGRM

SEQ ID NO: 132027 - protein, 10 aa, Homo Sapiens
LSNPDPRLLF

SEQ ID NO: 132028 - protein, 10 aa, Homo Sapiens
LSQSHAYQQF

SEQ ID NO: 132029 - protein, 10 aa, Homo Sapiens
LSSPDYQIRW

SEQ ID NO: 132030 - protein, 10 aa, Homo Sapiens
LSTHMSALLF

SEQ ID NO: 132031 - protein, 10 aa, Homo Sapiens
LTFRDVAIEF

SEQ ID NO: 132032 - protein, 10 aa, Homo Sapiens
LTIPDGGVHI

SEQ ID NO: 132033 - protein, 10 aa, Homo Sapiens
LTIVDTGIGM

SEQ ID NO: 132034 - protein, 10 aa, Homo Sapiens
LTKQEFQTLF

SEQ ID NO: 132035 - protein, 10 aa, Homo Sapiens
LTMSDVQIHW

SEQ ID NO: 132036 - protein, 10 aa, Homo Sapiens
LTSDALAVTF

SEQ ID NO: 132037 - protein, 10 aa, Homo Sapiens
LTSKLYSLLF

SEQ ID NO: 132038 - protein, 10 aa, Homo Sapiens
LTWPEGKVLW

SEQ ID NO: 132039 - protein, 10 aa, Homo Sapiens
LTYLDNGVVF

SEQ ID NO: 132040 - protein, 10 aa, Homo Sapiens
LVFPYTHQNW

SEQ ID NO: 132041 - protein, 10 aa, Homo Sapiens
LVFVGKGITF

SEQ ID NO: 132042 - protein, 10 aa, Homo Sapiens
MAFQNDVYEW

SEQ ID NO: 132043 - protein, 10 aa, Homo Sapiens
MTFKDVEVTF

SEQ ID NO: 132044 - protein, 10 aa, Homo Sapiens
MTTRELQQYW

SEQ ID NO: 132045 - protein, 10 aa, Homo Sapiens
MVMASAWRLW

SEQ ID NO: 132046 - protein, 10 aa, Homo Sapiens
NAGEDPGLAR

SEQ ID NO: 132047 - protein, 10 aa, Homo Sapiens
NARMPEKVTW

SEQ ID NO: 132048 - protein, 10 aa, Homo Sapiens
NTLKEVNMRW

SEQ ID NO: 132049 - protein, 10 aa, Homo Sapiens
PTSSPPSFEF

SEQ ID NO: 132050 - protein, 10 aa, Homo Sapiens
QSIYPLHDVF

SEQ ID NO: 132051 - protein, 10 aa, Homo Sapiens
QSLPDFGISY

SEQ ID NO: 132052 - protein, 10 aa, Homo Sapiens
QSMDNQILIF

SEQ ID NO: 132053 - protein, 10 aa, Homo Sapiens
QTALLQKLTW

SEQ ID NO: 132054 - protein, 10 aa, Homo Sapiens
QTARMEDFTF

SEQ ID NO: 132055 - protein, 10 aa, Homo Sapiens
QTASAVVQHM

SEQ ID NO: 132056 - protein, 10 aa, Homo Sapiens
QTLPTSVVTI

SEQ ID NO: 132057 - protein, 10 aa, Homo Sapiens
QTLTDYDIRF

SEQ ID NO: 132058 - protein, 10 aa, Homo Sapiens
QTNQRMQETF

SEQ ID NO: 132059 - protein, 10 aa, Homo Sapiens
RAAELFVETI

SEQ ID NO: 132060 - protein, 10 aa, Homo Sapiens
RAAEPVRVVW

SEQ ID NO: 132061 - protein, 10 aa, Homo Sapiens
RAAEVFFETF

SEQ ID NO: 132062 - protein, 10 aa, Homo Sapiens
RAFKEVGIEF

SEQ ID NO: 132063 - protein, 10 aa, Homo Sapiens
RAFPYGNVAF

SEQ ID NO: 132064 - protein, 10 aa, Homo Sapiens
RAFREEAIKF

SEQ ID NO: 132065 - protein, 10 aa, Homo Sapiens
RAGPFDEFQI

SEQ ID NO: 132066 - protein, 10 aa, Homo Sapiens
RAGPLSGKKF

SEQ ID NO: 132067 - protein, 10 aa, Homo Sapiens
RAIDSIHQLW

SEQ ID NO: 132068 - protein, 10 aa, Homo Sapiens
RAIEALLQYW

SEQ ID NO: 132069 - protein, 10 aa, Homo Sapiens
RAITHLNNNF

SEQ ID NO: 132070 - protein, 10 aa, Homo Sapiens
RAKTDSAEKW

SEQ ID NO: 132071 - protein, 10 aa, Homo Sapiens
RALESELQQL

SEQ ID NO: 132072 - protein, 10 aa, Homo Sapiens
RALPQGSIKF

SEQ ID NO: 132073 - protein, 10 aa, Homo Sapiens
RASLVTSVVW

SEQ ID NO: 132074 - protein, 10 aa, Homo Sapiens
RAVLDVANHF

SEQ ID NO: 132075 - protein, 10 aa, Homo Sapiens
RAYPHNLMTF

SEQ ID NO: 132076 - protein, 10 aa, Homo Sapiens
RGYPDSESTW

SEQ ID NO: 132077 - protein, 10 aa, Homo Sapiens
RILDIVPPTF

SEQ ID NO: 132078 - protein, 10 aa, Homo Sapiens
RLIPQPAFQW

SEQ ID NO: 132079 - protein, 10 aa, Homo Sapiens
RMYPLKPTWW

SEQ ID NO: 132080 - protein, 10 aa, Homo Sapiens
RSADEPMTTF

SEQ ID NO: 132081 - protein, 10 aa, Homo Sapiens
RSARDTAQIF

SEQ ID NO: 132082 - protein, 10 aa, Homo Sapiens
RSASSTSSLF

SEQ ID NO: 132083 - protein, 10 aa, Homo Sapiens
RSATEVDNNF

SEQ ID NO: 132084 - protein, 10 aa, Homo Sapiens
RSFEHALMLF

SEQ ID NO: 132085 - protein, 10 aa, Homo Sapiens
RSFKETTNRW

SEQ ID NO: 132086 - protein, 10 aa, Homo Sapiens
RSGEGFLLVF

SEQ ID NO: 132087 - protein, 10 aa, Homo Sapiens
RSIEEVYYLW

SEQ ID NO: 132088 - protein, 10 aa, Homo Sapiens
RSIISPNFSF

SEQ ID NO: 132089 - protein, 10 aa, Homo Sapiens
RSIKAQLQNF

SEQ ID NO: 132090 - protein, 10 aa, Homo Sapiens
RSIKGLKEHF

SEQ ID NO: 132091 - protein, 10 aa, Homo Sapiens
RSIQADGLVW

SEQ ID NO: 132092 - protein, 10 aa, Homo Sapiens
RSIQLDGLVW

SEQ ID NO: 132093 - protein, 10 aa, Homo Sapiens
RSKDVVEPLL

SEQ ID NO: 132094 - protein, 10 aa, Homo Sapiens
RSKEGLTERF

SEQ ID NO: 132095 - protein, 10 aa, Homo Sapiens
RSLAAFLQQL

SEQ ID NO: 132096 - protein, 10 aa, Homo Sapiens
RSLACQPISF

SEQ ID NO: 132097 - protein, 10 aa, Homo Sapiens
RSLDNGGYYI

SEQ ID NO: 132098 - protein, 10 aa, Homo Sapiens
RSLEQIESFF

SEQ ID NO: 132099 - protein, 10 aa, Homo Sapiens
RSLEYLPLRF

SEQ ID NO: 132100 - protein, 10 aa, Homo Sapiens
RSLGYAYVNF

SEQ ID NO: 132101 - protein, 10 aa, Homo Sapiens
RSLINSNVGF

SEQ ID NO: 132102 - protein, 10 aa, Homo Sapiens
RSLKADLQKL

SEQ ID NO: 132103 - protein, 10 aa, Homo Sapiens
RSLKDHKVSF

SEQ ID NO: 132104 - protein, 10 aa, Homo Sapiens
RSLKTYGVSF

SEQ ID NO: 132105 - protein, 10 aa, Homo Sapiens
RSLPDIPAHL

SEQ ID NO: 132106 - protein, 10 aa, Homo Sapiens
RSLPIVFDEF

SEQ ID NO: 132107 - protein, 10 aa, Homo Sapiens
RSLPRFQVTL

SEQ ID NO: 132108 - protein, 10 aa, Homo Sapiens
RSLPSLKKTL

SEQ ID NO: 132109 - protein, 10 aa, Homo Sapiens
RSLQDTAELL

SEQ ID NO: 132110 - protein, 10 aa, Homo Sapiens
RSLRDTAVRL

SEQ ID NO: 132111 - protein, 10 aa, Homo Sapiens
RSLTTLSEQW

SEQ ID NO: 132112 - protein, 10 aa, Homo Sapiens
RSLVPAAVVW

SEQ ID NO: 132113 - protein, 10 aa, Homo Sapiens
RSMGDYAQTL

SEQ ID NO: 132114 - protein, 10 aa, Homo Sapiens
RSMQLDYTTW

SEQ ID NO: 132115 - protein, 10 aa, Homo Sapiens
RSMSLVLDEF

SEQ ID NO: 132116 - protein, 10 aa, Homo Sapiens
RSNPSVFVIF

SEQ ID NO: 132117 - protein, 10 aa, Homo Sapiens
RSPDESHRMW

SEQ ID NO: 132118 - protein, 10 aa, Homo Sapiens
RSQKAEGQRW

SEQ ID NO: 132119 - protein, 10 aa, Homo Sapiens
RSRVDQEERW

SEQ ID NO: 132120 - protein, 10 aa, Homo Sapiens
RSSQSSSQQF

SEQ ID NO: 132121 - protein, 10 aa, Homo Sapiens
RSSSCLKNHF

SEQ ID NO: 132122 - protein, 10 aa, Homo Sapiens
RSSTVTVLLL

SEQ ID NO: 132123 - protein, 10 aa, Homo Sapiens
RSSVEVRMEF

SEQ ID NO: 132124 - protein, 10 aa, Homo Sapiens
RSSVVTAVKF

SEQ ID NO: 132125 - protein, 10 aa, Homo Sapiens
RSVDVTNTTF

SEQ ID NO: 132126 - protein, 10 aa, Homo Sapiens
RSVLDNRARF

SEQ ID NO: 132127 - protein, 10 aa, Homo Sapiens
RSVNIKEICW

SEQ ID NO: 132128 - protein, 10 aa, Homo Sapiens
RSVPTNKVCF

SEQ ID NO: 132129 - protein, 10 aa, Homo Sapiens
RSVQVIGGIW

SEQ ID NO: 132130 - protein, 10 aa, Homo Sapiens
RSVVLNDVFL

SEQ ID NO: 132131 - protein, 10 aa, Homo Sapiens
RSWDQQIKLW

SEQ ID NO: 132132 - protein, 10 aa, Homo Sapiens
RSYQLEGVNW

SEQ ID NO: 132133 - protein, 10 aa, Homo Sapiens
RSYSDPPLKF

SEQ ID NO: 132134 - protein, 10 aa, Homo Sapiens
RSYSESEKQW

SEQ ID NO: 132135 - protein, 10 aa, Homo Sapiens
RTAKALQAHW

SEQ ID NO: 132136 - protein, 10 aa, Homo Sapiens
RTAPFHLDLW

SEQ ID NO: 132137 - protein, 10 aa, Homo Sapiens
RTCEWTGLKF

SEQ ID NO: 132138 - protein, 10 aa, Homo Sapiens
RTDLDKARTF

SEQ ID NO: 132139 - protein, 10 aa, Homo Sapiens
RTFTDHVMLF

SEQ ID NO: 132140 - protein, 10 aa, Homo Sapiens
RTIKIRNISY

SEQ ID NO: 132141 - protein, 10 aa, Homo Sapiens
RTIKLEHVHF

SEQ ID NO: 132142 - protein, 10 aa, Homo Sapiens
RTILVDNNTW

SEQ ID NO: 132143 - protein, 10 aa, Homo Sapiens
RTIQGLIDFI

SEQ ID NO: 132144 - protein, 10 aa, Homo Sapiens
RTLCEGPQRF

SEQ ID NO: 132145 - protein, 10 aa, Homo Sapiens
RTLDELGIHL

SEQ ID NO: 132146 - protein, 10 aa, Homo Sapiens
RTLDKIMILF

SEQ ID NO: 132147 - protein, 10 aa, Homo Sapiens
RTLDNQLFFF

SEQ ID NO: 132148 - protein, 10 aa, Homo Sapiens
RTLDTIQLAF

SEQ ID NO: 132149 - protein, 10 aa, Homo Sapiens
RTLESKLVLF

SEQ ID NO: 132150 - protein, 10 aa, Homo Sapiens
RTLKEEVQKL

SEQ ID NO: 132151 - protein, 10 aa, Homo Sapiens
RTLNISGNEI

SEQ ID NO: 132152 - protein, 10 aa, Homo Sapiens
RTLPDDLHFL

SEQ ID NO: 132153 - protein, 10 aa, Homo Sapiens
RTLPELITQF

SEQ ID NO: 132154 - protein, 10 aa, Homo Sapiens
RTLPTKEFLW

SEQ ID NO: 132155 - protein, 10 aa, Homo Sapiens
RTLRDIETFY

SEQ ID NO: 132156 - protein, 10 aa, Homo Sapiens
RTMELLTQNW

SEQ ID NO: 132157 - protein, 10 aa, Homo Sapiens
RTMNCIVNVF

SEQ ID NO: 132158 - protein, 10 aa, Homo Sapiens
RTMNIKSATW

SEQ ID NO: 132159 - protein, 10 aa, Homo Sapiens
RTNHQGTYVL

SEQ ID NO: 132160 - protein, 10 aa, Homo Sapiens
RTPDTPFSLF

SEQ ID NO: 132161 - protein, 10 aa, Homo Sapiens
RTRLEQVHEW

SEQ ID NO: 132162 - protein, 10 aa, Homo Sapiens
RTSDDVAKEF

SEQ ID NO: 132163 - protein, 10 aa, Homo Sapiens
RTSIETNVRF

SEQ ID NO: 132164 - protein, 10 aa, Homo Sapiens
RTTLVDNNTW

SEQ ID NO: 132165 - protein, 10 aa, Homo Sapiens
RTTPGTLARF

SEQ ID NO: 132166 - protein, 10 aa, Homo Sapiens
RTVEICPFSF

SEQ ID NO: 132167 - protein, 10 aa, Homo Sapiens
RTVKELGNSL

SEQ ID NO: 132168 - protein, 10 aa, Homo Sapiens
RTVKELKEKF

SEQ ID NO: 132169 - protein, 10 aa, Homo Sapiens
RTVQPHFLEF

SEQ ID NO: 132170 - protein, 10 aa, Homo Sapiens
RTVSLVHESF

SEQ ID NO: 132171 - protein, 10 aa, Homo Sapiens
RTVVTGIEMF

SEQ ID NO: 132172 - protein, 10 aa, Homo Sapiens
RTWDYVAPFL

SEQ ID NO: 132173 - protein, 10 aa, Homo Sapiens
RTWNVVVHDW

SEQ ID NO: 132174 - protein, 10 aa, Homo Sapiens
RTYINPFVSF

SEQ ID NO: 132175 - protein, 10 aa, Homo Sapiens
RTYSDDHVKF

SEQ ID NO: 132176 - protein, 10 aa, Homo Sapiens
RTYSLVGQAW

SEQ ID NO: 132177 - protein, 10 aa, Homo Sapiens
RTYSVGVCTF

SEQ ID NO: 132178 - protein, 10 aa, Homo Sapiens
RTYTYEKLLW

SEQ ID NO: 132179 - protein, 10 aa, Homo Sapiens
RVADFGSATF

SEQ ID NO: 132180 - protein, 10 aa, Homo Sapiens
RVAQLEQVYI

SEQ ID NO: 132181 - protein, 10 aa, Homo Sapiens
RVDPDVAQHW

SEQ ID NO: 132182 - protein, 10 aa, Homo Sapiens
RVFPDKGYSF

SEQ ID NO: 132183 - protein, 10 aa, Homo Sapiens
RVFPEKGYSF

SEQ ID NO: 132184 - protein, 10 aa, Homo Sapiens
RVGPIEATSF

SEQ ID NO: 132185 - protein, 10 aa, Homo Sapiens
SAASPHYQEW

SEQ ID NO: 132186 - protein, 10 aa, Homo Sapiens
SACRTSGQTF

SEQ ID NO: 132187 - protein, 10 aa, Homo Sapiens
SALPADTQAW

SEQ ID NO: 132188 - protein, 10 aa, Homo Sapiens
SAQGSESHSL

SEQ ID NO: 132189 - protein, 10 aa, Homo Sapiens
SMDNNRSLDL

SEQ ID NO: 132190 - protein, 10 aa, Homo Sapiens
SNKGISKTEI

SEQ ID NO: 132191 - protein, 10 aa, Homo Sapiens
SSLSGPRLLF

SEQ ID NO: 132192 - protein, 10 aa, Homo Sapiens
SSSPSVRQTW

SEQ ID NO: 132193 - protein, 10 aa, Homo Sapiens
STAKEIIQHF

SEQ ID NO: 132194 - protein, 10 aa, Homo Sapiens
STAREIECFW

SEQ ID NO: 132195 - protein, 10 aa, Homo Sapiens
STIKDCATVF

SEQ ID NO: 132196 - protein, 10 aa, Homo Sapiens
STIRNLKERF

SEQ ID NO: 132197 - protein, 10 aa, Homo Sapiens
STLRELGQTW

SEQ ID NO: 132198 - protein, 10 aa, Homo Sapiens
STLRNIQGLF

SEQ ID NO: 132199 - protein, 10 aa, Homo Sapiens
STLRVLYNLF

SEQ ID NO: 132200 - protein, 10 aa, Homo Sapiens
SVGESSSKGP

SEQ ID NO: 132201 - protein, 10 aa, Homo Sapiens
SVNGSKSYEI

SEQ ID NO: 132202 - protein, 10 aa, Homo Sapiens
TAQSDNKITW

SEQ ID NO: 132203 - protein, 10 aa, Homo Sapiens
TSLGYEVQKF

SEQ ID NO: 132204 - protein, 10 aa, Homo Sapiens
TSLPDFCHKF

SEQ ID NO: 132205 - protein, 10 aa, Homo Sapiens
TSLPDKCNSF

SEQ ID NO: 132206 - protein, 10 aa, Homo Sapiens
TSLTLKHAAW

SEQ ID NO: 132207 - protein, 10 aa, Homo Sapiens
TSSRPEEPFL

SEQ ID NO: 132208 - protein, 10 aa, Homo Sapiens
TSSSSVRVEW

SEQ ID NO: 132209 - protein, 10 aa, Homo Sapiens
TSWYSPDAKF

SEQ ID NO: 132210 - protein, 10 aa, Homo Sapiens
TTIFVAAFPL

SEQ ID NO: 132211 - protein, 10 aa, Homo Sapiens
TTKKDLKDYF

SEQ ID NO: 132212 - protein, 10 aa, Homo Sapiens
TTKPSSLDQF

SEQ ID NO: 132213 - protein, 10 aa, Homo Sapiens
VAAPPPKNSF

SEQ ID NO: 132214 - protein, 10 aa, Homo Sapiens
VAGPLGVTHF

SEQ ID NO: 132215 - protein, 10 aa, Homo Sapiens
VDGAYMTKVD

SEQ ID NO: 132216 - protein, 10 aa, Homo Sapiens
VSAKSGAVTF

SEQ ID NO: 132217 - protein, 10 aa, Homo Sapiens
VSFKDVAVDF

SEQ ID NO: 132218 - protein, 10 aa, Homo Sapiens
VSIGDLQATF

SEQ ID NO: 132219 - protein, 10 aa, Homo Sapiens
VSKRIAQETF

SEQ ID NO: 132220 - protein, 10 aa, Homo Sapiens
VSLKNVAVSF

SEQ ID NO: 132221 - protein, 10 aa, Homo Sapiens
VSLRLGDLVW

SEQ ID NO: 132222 - protein, 10 aa, Homo Sapiens
VSQKISKTRW

SEQ ID NO: 132223 - protein, 10 aa, Homo Sapiens
VSSITASLRF

SEQ ID NO: 132224 - protein, 10 aa, Homo Sapiens
VSWDEKGMTW

SEQ ID NO: 132225 - protein, 10 aa, Homo Sapiens
VSWDTKLIQW

SEQ ID NO: 132226 - protein, 10 aa, Homo Sapiens
VTAEAVRSVW

SEQ ID NO: 132227 - protein, 10 aa, Homo Sapiens
VTARLVGVLW

SEQ ID NO: 132228 - protein, 10 aa, Homo Sapiens
VTATDIRVTL

SEQ ID NO: 132229 - protein, 10 aa, Homo Sapiens
VTFEDVAVHF

SEQ ID NO: 132230 - protein, 10 aa, Homo Sapiens
VTFKDVAVTF

SEQ ID NO: 132231 - protein, 10 aa, Homo Sapiens
VTFRDVAIDF

SEQ ID NO: 132232 - protein, 10 aa, Homo Sapiens
VTFRDVAIYF

SEQ ID NO: 132233 - protein, 10 aa, Homo Sapiens
VTIFVEGQRF

SEQ ID NO: 132234 - protein, 10 aa, Homo Sapiens
VTIKLKNVNF

SEQ ID NO: 132235 - protein, 10 aa, Homo Sapiens
VTLKIGDHKF

SEQ ID NO: 132236 - protein, 10 aa, Homo Sapiens
VTLKNKYLDW

SEQ ID NO: 132237 - protein, 10 aa, Homo Sapiens
VTMDVGMTKF

SEQ ID NO: 132238 - protein, 10 aa, Homo Sapiens
VTQPNTKYTF

SEQ ID NO: 132239 - protein, 10 aa, Homo Sapiens
VTTSITSKKW

SEQ ID NO: 132240 - protein, 10 aa, Homo Sapiens
VTVPANVQRW

SEQ ID NO: 132241 - protein, 10 aa, Homo Sapiens
VVARTVAQLW

SEQ ID NO: 132242 - protein, 10 aa, Homo Sapiens
VVWENKHITW

SEQ ID NO: 132243 - protein, 10 aa, Homo Sapiens
YACRVNHVTL

SEQ ID NO: 132244 - protein, 10 aa, Homo Sapiens
YSFKFGFNEF

SEQ ID NO: 132245 - protein, 10 aa, Homo Sapiens
YSKYYKTIDD

SEQ ID NO: 132246 - protein, 10 aa, Homo Sapiens
YTMKKVHALW

SEQ ID NO: 132247 - protein, 10 aa, Homo Sapiens
YTVKVEDLTF

SEQ ID NO: 132248 - protein, 10 aa, Homo Sapiens
YTYKDPITEF

SEQ ID NO: 132249 - protein, 11 aa, Homo Sapiens
AAAAAAAAAMS

SEQ ID NO: 132250 - protein, 11 aa, Homo Sapiens
AAFNKDALLNW

SEQ ID NO: 132251 - protein, 11 aa, Homo Sapiens
AALDSRKNYNW

SEQ ID NO: 132252 - protein, 11 aa, Homo Sapiens
AAYRNLGQNLW

SEQ ID NO: 132253 - protein, 11 aa, Homo Sapiens
ASAAVLAPLGF

SEQ ID NO: 132254 - protein, 11 aa, Homo Sapiens
ASCPNHFEGLF

SEQ ID NO: 132255 - protein, 11 aa, Homo Sapiens
ASIKDPKDLKF

SEQ ID NO: 132256 - protein, 11 aa, Homo Sapiens
ASIRLPSQYNF

SEQ ID NO: 132257 - protein, 11 aa, Homo Sapiens
ASLPAELINQI

SEQ ID NO: 132258 - protein, 11 aa, Homo Sapiens
ASLPSELIVHI

SEQ ID NO: 132259 - protein, 11 aa, Homo Sapiens
ASLRDLPAQLL

SEQ ID NO: 132260 - protein, 11 aa, Homo Sapiens
ASSLTIDKLLL

SEQ ID NO: 132261 - protein, 11 aa, Homo Sapiens
ATADYICKVKW

SEQ ID NO: 132262 - protein, 11 aa, Homo Sapiens
ATARNLSNLTL

SEQ ID NO: 132263 - protein, 11 aa, Homo Sapiens
ATFHQRGIALW

SEQ ID NO: 132264 - protein, 11 aa, Homo Sapiens
ATIKDIREHEW

SEQ ID NO: 132265 - protein, 11 aa, Homo Sapiens
ATIPVSQISTI

SEQ ID NO: 132266 - protein, 11 aa, Homo Sapiens
ATLGNFAKATF

SEQ ID NO: 132267 - protein, 11 aa, Homo Sapiens
ATMPHQLQDTF

SEQ ID NO: 132268 - protein, 11 aa, Homo Sapiens
ATNALLNSLEF

SEQ ID NO: 132269 - protein, 11 aa, Homo Sapiens
ATSSVFQEVTL

SEQ ID NO: 132270 - protein, 11 aa, Homo Sapiens
ATVPNTIVVNW

SEQ ID NO: 132271 - protein, 11 aa, Homo Sapiens
AVAAVLTQVVW

SEQ ID NO: 132272 - protein, 11 aa, Homo Sapiens
AVAEALTNLVF

SEQ ID NO: 132273 - protein, 11 aa, Homo Sapiens
AVFVQGPAWQF

SEQ ID NO: 132274 - protein, 11 aa, Homo Sapiens
AVSTIETVPYW

SEQ ID NO: 132275 - protein, 11 aa, Homo Sapiens
ESCRIASSVNW

SEQ ID NO: 132276 - protein, 11 aa, Homo Sapiens
ETADVIAKVAF

SEQ ID NO: 132277 - protein, 11 aa, Homo Sapiens
EVSRIVGSVEF

SEQ ID NO: 132278 - protein, 11 aa, Homo Sapiens
FAYKDQNENRW

SEQ ID NO: 132279 - protein, 11 aa, Homo Sapiens
FSLKGVDFQKF

SEQ ID NO: 132280 - protein, 11 aa, Homo Sapiens
FSLRPIDSNTF

SEQ ID NO: 132281 - protein, 11 aa, Homo Sapiens
FSSPAVAQAHY

SEQ ID NO: 132282 - protein, 11 aa, Homo Sapiens
GASEAVADIKF

SEQ ID NO: 132283 - protein, 11 aa, Homo Sapiens
GSSHLISTSSW

SEQ ID NO: 132284 - protein, 11 aa, Homo Sapiens
GSTKVLQAVQW

SEQ ID NO: 132285 - protein, 11 aa, Homo Sapiens
GTAAVFNAVNW

SEQ ID NO: 132286 - protein, 11 aa, Homo Sapiens
GTWIGKGTERW

SEQ ID NO: 132287 - protein, 11 aa, Homo Sapiens
GVSQVLNRLTF

SEQ ID NO: 132288 - protein, 11 aa, Homo Sapiens
HSAGNMLFRTW

SEQ ID NO: 132289 - protein, 11 aa, Homo Sapiens
HSFGGGTGSGF

SEQ ID NO: 132290 - protein, 11 aa, Homo Sapiens
HSFLYQPDWRF

SEQ ID NO: 132291 - protein, 11 aa, Homo Sapiens
HSFNQSSSSQW

SEQ ID NO: 132292 - protein, 11 aa, Homo Sapiens
HSFYPTPALQW

SEQ ID NO: 132293 - protein, 11 aa, Homo Sapiens
HSNETIGSVRW

SEQ ID NO: 132294 - protein, 11 aa, Homo Sapiens
HSSEELRNLGW

SEQ ID NO: 132295 - protein, 11 aa, Homo Sapiens
HSWMEGQVTVW

SEQ ID NO: 132296 - protein, 11 aa, Homo Sapiens
HTAPSGVGSSW

SEQ ID NO: 132297 - protein, 11 aa, Homo Sapiens
HTCVLHSIVGW

SEQ ID NO: 132298 - protein, 11 aa, Homo Sapiens
HTFFDHQDQVW

SEQ ID NO: 132299 - protein, 11 aa, Homo Sapiens
HTLPHEIVVNL

SEQ ID NO: 132300 - protein, 11 aa, Homo Sapiens
HTLVTSGVYAW

SEQ ID NO: 132301 - protein, 11 aa, Homo Sapiens
HTNQDHVHAVW

SEQ ID NO: 132302 - protein, 11 aa, Homo Sapiens
HTSDEQNHLVI

SEQ ID NO: 132303 - protein, 11 aa, Homo Sapiens
HTSDVPGKLIY

SEQ ID NO: 132304 - protein, 11 aa, Homo Sapiens
HTSPSSDSLLF

SEQ ID NO: 132305 - protein, 11 aa, Homo Sapiens
HTVQPKGKITF

SEQ ID NO: 132306 - protein, 11 aa, Homo Sapiens
HTWNGIRHLMW

SEQ ID NO: 132307 - protein, 11 aa, Homo Sapiens
IARKDEKLLSF

SEQ ID NO: 132308 - protein, 11 aa, Homo Sapiens
IASARAGETRF

SEQ ID NO: 132309 - protein, 11 aa, Homo Sapiens
IASHSIARISF

SEQ ID NO: 132310 - protein, 11 aa, Homo Sapiens
IAWWTDKNVKF

SEQ ID NO: 132311 - protein, 11 aa, Homo Sapiens
IGAQVLGKILW

SEQ ID NO: 132312 - protein, 11 aa, Homo Sapiens
ISAPDKRIYQF

SEQ ID NO: 132313 - protein, 11 aa, Homo Sapiens
ISDHEATLRCW

SEQ ID NO: 132314 - protein, 11 aa, Homo Sapiens
ISERYGPVFTI

SEQ ID NO: 132315 - protein, 11 aa, Homo Sapiens
ISFPATGCQKL

SEQ ID NO: 132316 - protein, 11 aa, Homo Sapiens
ISFPEKELLLL

SEQ ID NO: 132317 - protein, 11 aa, Homo Sapiens
ISKFDTVEDFW

SEQ ID NO: 132318 - protein, 11 aa, Homo Sapiens
ISKPVGFGEEF

SEQ ID NO: 132319 - protein, 11 aa, Homo Sapiens
ISLPDDVRRRL

SEQ ID NO: 132320 - protein, 11 aa, Homo Sapiens
ISTFLLTRELW

SEQ ID NO: 132321 - protein, 11 aa, Homo Sapiens
ISYPQEVIPTF

SEQ ID NO: 132322 - protein, 11 aa, Homo Sapiens
ITIPDIKKDRW

SEQ ID NO: 132323 - protein, 11 aa, Homo Sapiens
ITQKALQSQSW

SEQ ID NO: 132324 - protein, 11 aa, Homo Sapiens
ITREEGVLTLW

SEQ ID NO: 132325 - protein, 11 aa, Homo Sapiens
ITSQVTGQIGW

SEQ ID NO: 132326 - protein, 11 aa, Homo Sapiens
ITSSIHSKETF

SEQ ID NO: 132327 - protein, 11 aa, Homo Sapiens
ITVEDSDKQLL

SEQ ID NO: 132328 - protein, 11 aa, Homo Sapiens
ITYDDPIKTSW

SEQ ID NO: 132329 - protein, 11 aa, Homo Sapiens
ITYPAGFMDVI

SEQ ID NO: 132330 - protein, 11 aa, Homo Sapiens
IVDANLSVLNL

SEQ ID NO: 132331 - protein, 11 aa, Homo Sapiens
IVFPVPGICQF

SEQ ID NO: 132332 - protein, 11 aa, Homo Sapiens
KAAEAAASAYY

SEQ ID NO: 132333 - protein, 11 aa, Homo Sapiens
KAAECAGKLFL

SEQ ID NO: 132334 - protein, 11 aa, Homo Sapiens
KAAEVLNKHSL

SEQ ID NO: 132335 - protein, 11 aa, Homo Sapiens
KAATILTKSTL

SEQ ID NO: 132336 - protein, 11 aa, Homo Sapiens
KAIEEGVNHMW

SEQ ID NO: 132337 - protein, 11 aa, Homo Sapiens
KAIPRPDGIEW

SEQ ID NO: 132338 - protein, 11 aa, Homo Sapiens
KAISGVHTVRF

SEQ ID NO: 132339 - protein, 11 aa, Homo Sapiens
KAKYPDYEVTW

SEQ ID NO: 132340 - protein, 11 aa, Homo Sapiens
KALNVEKVINF

SEQ ID NO: 132341 - protein, 11 aa, Homo Sapiens
KASELHSVRKL

SEQ ID NO: 132342 - protein, 11 aa, Homo Sapiens
KASGQLKSLRF

SEQ ID NO: 132343 - protein, 11 aa, Homo Sapiens
KASLSLIEKYF

SEQ ID NO: 132344 - protein, 11 aa, Homo Sapiens
KATDAVSKMTI

SEQ ID NO: 132345 - protein, 11 aa, Homo Sapiens
KAVAAESNATF

SEQ ID NO: 132346 - protein, 11 aa, Homo Sapiens
KAVDCLLDSKW

SEQ ID NO: 132347 - protein, 11 aa, Homo Sapiens
KAVDSQILPKI

SEQ ID NO: 132348 - protein, 11 aa, Homo Sapiens
KAWFQTPYTTF

SEQ ID NO: 132349 - protein, 11 aa, Homo Sapiens
KGAYPIIFTAW

SEQ ID NO: 132350 - protein, 11 aa, Homo Sapiens
KGWKEGTKITF

SEQ ID NO: 132351 - protein, 11 aa, Homo Sapiens
KIITFTKNNQF

SEQ ID NO: 132352 - protein, 11 aa, Homo Sapiens
KIQPDTIIQVW

SEQ ID NO: 132353 - protein, 11 aa, Homo Sapiens
KLDENSAFLQF

SEQ ID NO: 132354 - protein, 11 aa, Homo Sapiens
KLFDSICNNKW

SEQ ID NO: 132355 - protein, 11 aa, Homo Sapiens
KLKPFIDREWW

SEQ ID NO: 132356 - protein, 11 aa, Homo Sapiens
KLSPEELLLRW

SEQ ID NO: 132357 - protein, 11 aa, Homo Sapiens
KQFAEMYVAKF

SEQ ID NO: 132358 - protein, 11 aa, Homo Sapiens
KSCEINNSTKF

SEQ ID NO: 132359 - protein, 11 aa, Homo Sapiens
KSCGIQDIFVF

SEQ ID NO: 132360 - protein, 11 aa, Homo Sapiens
KSCSPELQQKF

SEQ ID NO: 132361 - protein, 11 aa, Homo Sapiens
KSFEAPIKLVF

SEQ ID NO: 132362 - protein, 11 aa, Homo Sapiens
KSFEGNVFMYY

SEQ ID NO: 132363 - protein, 11 aa, Homo Sapiens
KSFETDTNLNF

SEQ ID NO: 132364 - protein, 11 aa, Homo Sapiens
KSFGSAQEFAW

SEQ ID NO: 132365 - protein, 11 aa, Homo Sapiens
KSFIPKDNQNF

SEQ ID NO: 132366 - protein, 11 aa, Homo Sapiens
KSFLGVKELSF

SEQ ID NO: 132367 - protein, 11 aa, Homo Sapiens
KSFPDTGSLNL

SEQ ID NO: 132368 - protein, 11 aa, Homo Sapiens
KSFPGGKEYLM

SEQ ID NO: 132369 - protein, 11 aa, Homo Sapiens
KSFSDTLKTYF

SEQ ID NO: 132370 - protein, 11 aa, Homo Sapiens
KSFSKSDLVNW

SEQ ID NO: 132371 - protein, 11 aa, Homo Sapiens
KSFVTPPQSHF

SEQ ID NO: 132372 - protein, 11 aa, Homo Sapiens
KSIASAIVNEL

SEQ ID NO: 132373 - protein, 11 aa, Homo Sapiens
KSIDNGIFVQL

SEQ ID NO: 132374 - protein, 11 aa, Homo Sapiens
KSIEDFAHSSF

SEQ ID NO: 132375 - protein, 11 aa, Homo Sapiens
KSIVSSSISAF

SEQ ID NO: 132376 - protein, 11 aa, Homo Sapiens
KSKAMTGVEQW

SEQ ID NO: 132377 - protein, 11 aa, Homo Sapiens
KSKLDAEVSKW

SEQ ID NO: 132378 - protein, 11 aa, Homo Sapiens
KSKPIIAEPEI

SEQ ID NO: 132379 - protein, 11 aa, Homo Sapiens
KSLCPETWPTW

SEQ ID NO: 132380 - protein, 11 aa, Homo Sapiens
KSLDPSRPVTF

SEQ ID NO: 132381 - protein, 11 aa, Homo Sapiens
KSLENSVENKI

SEQ ID NO: 132382 - protein, 11 aa, Homo Sapiens
KSLESLDTSLF

SEQ ID NO: 132383 - protein, 11 aa, Homo Sapiens
KSLGCEDFISF

SEQ ID NO: 132384 - protein, 11 aa, Homo Sapiens
KSLGELGLEHF

SEQ ID NO: 132385 - protein, 11 aa, Homo Sapiens
KSLGVQDLLQF

SEQ ID NO: 132386 - protein, 11 aa, Homo Sapiens
KSLKVDPRACF

SEQ ID NO: 132387 - protein, 11 aa, Homo Sapiens
KSLPCFEPYEF

SEQ ID NO: 132388 - protein, 11 aa, Homo Sapiens
KSLPEEDVAEI

SEQ ID NO: 132389 - protein, 11 aa, Homo Sapiens
KSLPEFPDSGF

SEQ ID NO: 132390 - protein, 11 aa, Homo Sapiens
KSLPSLVPLRI

SEQ ID NO: 132391 - protein, 11 aa, Homo Sapiens
KSLSALIGQCI

SEQ ID NO: 132392 - protein, 11 aa, Homo Sapiens
KSLTAHIVENF

SEQ ID NO: 132393 - protein, 11 aa, Homo Sapiens
KSLTYDEVISF

SEQ ID NO: 132394 - protein, 11 aa, Homo Sapiens
KSPASDTYIVF

SEQ ID NO: 132395 - protein, 11 aa, Homo Sapiens
KSSVIGASSQF

SEQ ID NO: 132396 - protein, 11 aa, Homo Sapiens
KSTSTLAMLNF

SEQ ID NO: 132397 - protein, 11 aa, Homo Sapiens
KSVSAAEQQLW

SEQ ID NO: 132398 - protein, 11 aa, Homo Sapiens
KSVTAHLAAKW

SEQ ID NO: 132399 - protein, 11 aa, Homo Sapiens
KSWPEGHFATI

SEQ ID NO: 132400 - protein, 11 aa, Homo Sapiens
KSYELPDGQVI

SEQ ID NO: 132401 - protein, 11 aa, Homo Sapiens
KSYLGSEADVW

SEQ ID NO: 132402 - protein, 11 aa, Homo Sapiens
KSYQPETNSSF

SEQ ID NO: 132403 - protein, 11 aa, Homo Sapiens
KTAPDQFIGIF

SEQ ID NO: 132404 - protein, 11 aa, Homo Sapiens
KTASQVHLMKF

SEQ ID NO: 132405 - protein, 11 aa, Homo Sapiens
KTATELSTVYL

SEQ ID NO: 132406 - protein, 11 aa, Homo Sapiens
KTAVETAVLLL

SEQ ID NO: 132407 - protein, 11 aa, Homo Sapiens
KTAVICQLDYW

SEQ ID NO: 132408 - protein, 11 aa, Homo Sapiens
KTCDADASGTF

SEQ ID NO: 132409 - protein, 11 aa, Homo Sapiens
KTCEEILNYVL

SEQ ID NO: 132410 - protein, 11 aa, Homo Sapiens
KTDATTAIIKL

SEQ ID NO: 132411 - protein, 11 aa, Homo Sapiens
KTFEEAAAQLL

SEQ ID NO: 132412 - protein, 11 aa, Homo Sapiens
KTFEEKQGTEI

SEQ ID NO: 132413 - protein, 11 aa, Homo Sapiens
KTFEGFCALHL

SEQ ID NO: 132414 - protein, 11 aa, Homo Sapiens
KTFEGHDASVL

SEQ ID NO: 132415 - protein, 11 aa, Homo Sapiens
KTFEQVKAIFL

SEQ ID NO: 132416 - protein, 11 aa, Homo Sapiens
KTFFLGDGQKL

SEQ ID NO: 132417 - protein, 11 aa, Homo Sapiens
KTFGGFASSSF

SEQ ID NO: 132418 - protein, 11 aa, Homo Sapiens
KTFIGKIPIML

SEQ ID NO: 132419 - protein, 11 aa, Homo Sapiens
KTFIVGDQISF

SEQ ID NO: 132420 - protein, 11 aa, Homo Sapiens
KTFLHDPLVEW

SEQ ID NO: 132421 - protein, 11 aa, Homo Sapiens
KTFNEPGSEYF

SEQ ID NO: 132422 - protein, 11 aa, Homo Sapiens
KTFSDEDYYQF

SEQ ID NO: 132423 - protein, 11 aa, Homo Sapiens
KTFVDNIQTAF

SEQ ID NO: 132424 - protein, 11 aa, Homo Sapiens
KTGTTIAGLVF

SEQ ID NO: 132425 - protein, 11 aa, Homo Sapiens
KTHVGMSIQTF

SEQ ID NO: 132426 - protein, 11 aa, Homo Sapiens
KTIEDDLVSAL

SEQ ID NO: 132427 - protein, 11 aa, Homo Sapiens
KTIRNDNSSRF

SEQ ID NO: 132428 - protein, 11 aa, Homo Sapiens
KTKPEVLEAHY

SEQ ID NO: 132429 - protein, 11 aa, Homo Sapiens
KTKSTETEHSF

SEQ ID NO: 132430 - protein, 11 aa, Homo Sapiens
KTLAESALQLL

SEQ ID NO: 132431 - protein, 11 aa, Homo Sapiens
KTLEEKLRSLF

SEQ ID NO: 132432 - protein, 11 aa, Homo Sapiens
KTLELAKVTQF

SEQ ID NO: 132433 - protein, 11 aa, Homo Sapiens
KTLKDEQTRKL

SEQ ID NO: 132434 - protein, 11 aa, Homo Sapiens
KTLPADVQNYY

SEQ ID NO: 132435 - protein, 11 aa, Homo Sapiens
KTLPETSLPNY

SEQ ID NO: 132436 - protein, 11 aa, Homo Sapiens
KTLQHDKLVRL

SEQ ID NO: 132437 - protein, 11 aa, Homo Sapiens
KTLRQVEVINF

SEQ ID NO: 132438 - protein, 11 aa, Homo Sapiens
KTLTADKLEHL

SEQ ID NO: 132439 - protein, 11 aa, Homo Sapiens
KTLTPIIQEYF

SEQ ID NO: 132440 - protein, 11 aa, Homo Sapiens
KTLVNPANVTF

SEQ ID NO: 132441 - protein, 11 aa, Homo Sapiens
KTMDGKADVSF

SEQ ID NO: 132442 - protein, 11 aa, Homo Sapiens
KTMLDDDKRQL

SEQ ID NO: 132443 - protein, 11 aa, Homo Sapiens
KTMTDTYLLNL

SEQ ID NO: 132444 - protein, 11 aa, Homo Sapiens
KTNDQMVVVYL

SEQ ID NO: 132445 - protein, 11 aa, Homo Sapiens
KTNPKIQSIYL

SEQ ID NO: 132446 - protein, 11 aa, Homo Sapiens
KTNTKLGKLYL

SEQ ID NO: 132447 - protein, 11 aa, Homo Sapiens
KTQQASKHIRF

SEQ ID NO: 132448 - protein, 11 aa, Homo Sapiens
KTRSKDIFDQL

SEQ ID NO: 132449 - protein, 11 aa, Homo Sapiens
KTSDSLLSMKF

SEQ ID NO: 132450 - protein, 11 aa, Homo Sapiens
KTSRVLQNVAF

SEQ ID NO: 132451 - protein, 11 aa, Homo Sapiens
KTSVSVHLMEW

SEQ ID NO: 132452 - protein, 11 aa, Homo Sapiens
KTVSAVCSLAW

SEQ ID NO: 132453 - protein, 11 aa, Homo Sapiens
KTVSNDSFFNF

SEQ ID NO: 132454 - protein, 11 aa, Homo Sapiens
KTVSSTKLVSF

SEQ ID NO: 132455 - protein, 11 aa, Homo Sapiens
KTVYTGIDHHW

SEQ ID NO: 132456 - protein, 11 aa, Homo Sapiens
KTYAEVDRQVI

SEQ ID NO: 132457 - protein, 11 aa, Homo Sapiens
KTYKDEGNDYF

SEQ ID NO: 132458 - protein, 11 aa, Homo Sapiens
KTYNEPGSQVF

SEQ ID NO: 132459 - protein, 11 aa, Homo Sapiens
KTYPVNTPERW

SEQ ID NO: 132460 - protein, 11 aa, Homo Sapiens
KTYSYLTPDLW

SEQ ID NO: 132461 - protein, 11 aa, Homo Sapiens
KVASLLHQVSW

SEQ ID NO: 132462 - protein, 11 aa, Homo Sapiens
KVDPAKDRELW

SEQ ID NO: 132463 - protein, 11 aa, Homo Sapiens
KVIHEQVNHRW

SEQ ID NO: 132464 - protein, 11 aa, Homo Sapiens
KVLPPNHRVVW

SEQ ID NO: 132465 - protein, 11 aa, Homo Sapiens
KVLPTNHRVTW

SEQ ID NO: 132466 - protein, 11 aa, Homo Sapiens
KVSEQVKNVKL

SEQ ID NO: 132467 - protein, 11 aa, Homo Sapiens
KVSVLTGIIKI

SEQ ID NO: 132468 - protein, 11 aa, Homo Sapiens
KVVDVVRNLVF

SEQ ID NO: 132469 - protein, 11 aa, Homo Sapiens
KVYDSQGLLIF

SEQ ID NO: 132470 - protein, 11 aa, Homo Sapiens
LADWVSGKISF

SEQ ID NO: 132471 - protein, 11 aa, Homo Sapiens
LALDPSLVPTF

SEQ ID NO: 132472 - protein, 11 aa, Homo Sapiens
LASPDLGLLKL

SEQ ID NO: 132473 - protein, 11 aa, Homo Sapiens
LAWSADGQTLF

SEQ ID NO: 132474 - protein, 11 aa, Homo Sapiens
LESRIRDVHEL

SEQ ID NO: 132475 - protein, 11 aa, Homo Sapiens
LGTLPPEIQAW

SEQ ID NO: 132476 - protein, 11 aa, Homo Sapiens
LSALPADTQAW

SEQ ID NO: 132477 - protein, 11 aa, Homo Sapiens
LSDPDEVARRW

SEQ ID NO: 132478 - protein, 11 aa, Homo Sapiens
LSLGVAALYKF

SEQ ID NO: 132479 - protein, 11 aa, Homo Sapiens
LSPPSANNATF

SEQ ID NO: 132480 - protein, 11 aa, Homo Sapiens
LSYNFSPEVEF

SEQ ID NO: 132481 - protein, 11 aa, Homo Sapiens
LSYPDTDVILM

SEQ ID NO: 132482 - protein, 11 aa, Homo Sapiens
LTADARLLCNF

SEQ ID NO: 132483 - protein, 11 aa, Homo Sapiens
LTKEDGEKETW

SEQ ID NO: 132484 - protein, 11 aa, Homo Sapiens
LTSPDVGLLKL

SEQ ID NO: 132485 - protein, 11 aa, Homo Sapiens
LVSLIDLLVLF

SEQ ID NO: 132486 - protein, 11 aa, Homo Sapiens
MSFPVGDVNNF

SEQ ID NO: 132487 - protein, 11 aa, Homo Sapiens
PEPAKSAPAPK

SEQ ID NO: 132488 - protein, 11 aa, Homo Sapiens
QAALALSRVEL

SEQ ID NO: 132489 - protein, 11 aa, Homo Sapiens
QALQDSRNYGW

SEQ ID NO: 132490 - protein, 11 aa, Homo Sapiens
QSAIVLGDLKL

SEQ ID NO: 132491 - protein, 11 aa, Homo Sapiens
QSDPSGAYFAW

SEQ ID NO: 132492 - protein, 11 aa, Homo Sapiens
QSIPYQDLPHL

SEQ ID NO: 132493 - protein, 11 aa, Homo Sapiens
QSLPAGTLLHL

SEQ ID NO: 132494 - protein, 11 aa, Homo Sapiens
QSLPEFGITHF

SEQ ID NO: 132495 - protein, 11 aa, Homo Sapiens
QSLPNDVISSL

SEQ ID NO: 132496 - protein, 11 aa, Homo Sapiens
QSLPNPKSWDF

SEQ ID NO: 132497 - protein, 11 aa, Homo Sapiens
QSLPSKTKVAW

SEQ ID NO: 132498 - protein, 11 aa, Homo Sapiens
QSLPSSVLHII

SEQ ID NO: 132499 - protein, 11 aa, Homo Sapiens
QSSSEISDHSF

SEQ ID NO: 132500 - protein, 11 aa, Homo Sapiens
QSSTLLTSVRL

SEQ ID NO: 132501 - protein, 11 aa, Homo Sapiens
QTARQHPKMHL

SEQ ID NO: 132502 - protein, 11 aa, Homo Sapiens
QTCKLFDTQQF

SEQ ID NO: 132503 - protein, 11 aa, Homo Sapiens
QTDGTLSTLEF

SEQ ID NO: 132504 - protein, 11 aa, Homo Sapiens
QTIRLPAQSIW

SEQ ID NO: 132505 - protein, 11 aa, Homo Sapiens
QTLPNGVTQKI

SEQ ID NO: 132506 - protein, 11 aa, Homo Sapiens
QTMSDQIIGRI

SEQ ID NO: 132507 - protein, 11 aa, Homo Sapiens
RAAEEFVNVYY

SEQ ID NO: 132508 - protein, 11 aa, Homo Sapiens
RAAGALSKRYW

SEQ ID NO: 132509 - protein, 11 aa, Homo Sapiens
RAALSDTVALW

SEQ ID NO: 132510 - protein, 11 aa, Homo Sapiens
RAALWIGTTSF

SEQ ID NO: 132511 - protein, 11 aa, Homo Sapiens
RAATVLATVLL

SEQ ID NO: 132512 - protein, 11 aa, Homo Sapiens
RACAAQTKATF

SEQ ID NO: 132513 - protein, 11 aa, Homo Sapiens
RAFPNKQGYVL

SEQ ID NO: 132514 - protein, 11 aa, Homo Sapiens
RAFQAHKEENW

SEQ ID NO: 132515 - protein, 11 aa, Homo Sapiens
RAFTCDDLFRF

SEQ ID NO: 132516 - protein, 11 aa, Homo Sapiens
RALEAEKRALW

SEQ ID NO: 132517 - protein, 11 aa, Homo Sapiens
RALQASALNAW

SEQ ID NO: 132518 - protein, 11 aa, Homo Sapiens
RASITPGTILI

SEQ ID NO: 132519 - protein, 11 aa, Homo Sapiens
RASTLLSKVFL

SEQ ID NO: 132520 - protein, 11 aa, Homo Sapiens
RGAVVVGNVGF

SEQ ID NO: 132521 - protein, 11 aa, Homo Sapiens
RGTTILAKHAW

SEQ ID NO: 132522 - protein, 11 aa, Homo Sapiens
RIAEALSKMKL

SEQ ID NO: 132523 - protein, 11 aa, Homo Sapiens
RILPQDVILKF

SEQ ID NO: 132524 - protein, 11 aa, Homo Sapiens
RLAPIGRRQLL

SEQ ID NO: 132525 - protein, 11 aa, Homo Sapiens
RLFPSAAQVTF

SEQ ID NO: 132526 - protein, 11 aa, Homo Sapiens
RSADFLGKVAI

SEQ ID NO: 132527 - protein, 11 aa, Homo Sapiens
RSAGACTAAAF

SEQ ID NO: 132528 - protein, 11 aa, Homo Sapiens
RSCLEQAKLLF

SEQ ID NO: 132529 - protein, 11 aa, Homo Sapiens
RSDESVGNVTF

SEQ ID NO: 132530 - protein, 11 aa, Homo Sapiens
RSFANDDRHVM

SEQ ID NO: 132531 - protein, 11 aa, Homo Sapiens
RSFDKGPFATF

SEQ ID NO: 132532 - protein, 11 aa, Homo Sapiens
RSFDQADRAKF

SEQ ID NO: 132533 - protein, 11 aa, Homo Sapiens
RSIGALNKINF

SEQ ID NO: 132534 - protein, 11 aa, Homo Sapiens
RSIPAYLAETL

SEQ ID NO: 132535 - protein, 11 aa, Homo Sapiens
RSIPVNEKDTL

SEQ ID NO: 132536 - protein, 11 aa, Homo Sapiens
RSISQGLTWTW

SEQ ID NO: 132537 - protein, 11 aa, Homo Sapiens
RSKKQTKFEVL

SEQ ID NO: 132538 - protein, 11 aa, Homo Sapiens
RSKPGEGKLIF

SEQ ID NO: 132539 - protein, 11 aa, Homo Sapiens
RSLAHQHVVGF

SEQ ID NO: 132540 - protein, 11 aa, Homo Sapiens
RSLPDPNLITF

SEQ ID NO: 132541 - protein, 11 aa, Homo Sapiens
RSLPHITDVSW

SEQ ID NO: 132542 - protein, 11 aa, Homo Sapiens
RSMPLGARILF

SEQ ID NO: 132543 - protein, 11 aa, Homo Sapiens
RSMSVERDIRF

SEQ ID NO: 132544 - protein, 11 aa, Homo Sapiens
RSNPKLKDLYI

SEQ ID NO: 132545 - protein, 11 aa, Homo Sapiens
RSSNMTATTKF

SEQ ID NO: 132546 - protein, 11 aa, Homo Sapiens
RSSRSHAVLLV

SEQ ID NO: 132547 - protein, 11 aa, Homo Sapiens
RSSRSHSVFQL

SEQ ID NO: 132548 - protein, 11 aa, Homo Sapiens
RSSSYLDNLVW

SEQ ID NO: 132549 - protein, 11 aa, Homo Sapiens
RSTVHGVTQAF

SEQ ID NO: 132550 - protein, 11 aa, Homo Sapiens
RSYQDPSNAQF

SEQ ID NO: 132551 - protein, 11 aa, Homo Sapiens
RSYSDGASQQF

SEQ ID NO: 132552 - protein, 11 aa, Homo Sapiens
RTAGTICLETF

SEQ ID NO: 132553 - protein, 11 aa, Homo Sapiens
RTATQLAVNKI

SEQ ID NO: 132554 - protein, 11 aa, Homo Sapiens
RTDVGITHQHW

SEQ ID NO: 132555 - protein, 11 aa, Homo Sapiens
RTFAAQSLVQL

SEQ ID NO: 132556 - protein, 11 aa, Homo Sapiens
RTFTSPRPTQF

SEQ ID NO: 132557 - protein, 11 aa, Homo Sapiens
RTHPDEPLYSF

SEQ ID NO: 132558 - protein, 11 aa, Homo Sapiens
RTIADSLINSF

SEQ ID NO: 132559 - protein, 11 aa, Homo Sapiens
RTIDDRIVHEL

SEQ ID NO: 132560 - protein, 11 aa, Homo Sapiens
RTIKPEKHLRF

SEQ ID NO: 132561 - protein, 11 aa, Homo Sapiens
RTIQTPIGSTW

SEQ ID NO: 132562 - protein, 11 aa, Homo Sapiens
RTLGTPDEVVW

SEQ ID NO: 132563 - protein, 11 aa, Homo Sapiens
RTLKSGDGITF

SEQ ID NO: 132564 - protein, 11 aa, Homo Sapiens
RTLPTNTLMGF

SEQ ID NO: 132565 - protein, 11 aa, Homo Sapiens
RTLPVDSSHGF

SEQ ID NO: 132566 - protein, 11 aa, Homo Sapiens
RTLVEHSGRVF

SEQ ID NO: 132567 - protein, 11 aa, Homo Sapiens
RTMQPLAVLAF

SEQ ID NO: 132568 - protein, 11 aa, Homo Sapiens
RTMVQLGICAF

SEQ ID NO: 132569 - protein, 11 aa, Homo Sapiens
RTNPNNGEFRF

SEQ ID NO: 132570 - protein, 11 aa, Homo Sapiens
RTNPNSGDFRF

SEQ ID NO: 132571 - protein, 11 aa, Homo Sapiens
RTRNEELAQTW

SEQ ID NO: 132572 - protein, 11 aa, Homo Sapiens
RTSAEIAAIVF

SEQ ID NO: 132573 - protein, 11 aa, Homo Sapiens
RTSTSQAVFRL

SEQ ID NO: 132574 - protein, 11 aa, Homo Sapiens
RTSVKISYIGL

SEQ ID NO: 132575 - protein, 11 aa, Homo Sapiens
RTVENMSIIGW

SEQ ID NO: 132576 - protein, 11 aa, Homo Sapiens
RTWKGTAFGGW

SEQ ID NO: 132577 - protein, 11 aa, Homo Sapiens
RTYTGLSGLAL

SEQ ID NO: 132578 - protein, 11 aa, Homo Sapiens
RVCQQPGLSLW

SEQ ID NO: 132579 - protein, 11 aa, Homo Sapiens
RVDPNGSRYLL

SEQ ID NO: 132580 - protein, 11 aa, Homo Sapiens
RVFEDESGKHW

SEQ ID NO: 132581 - protein, 11 aa, Homo Sapiens
RVFWDPSVNLF

SEQ ID NO: 132582 - protein, 11 aa, Homo Sapiens
RVLEAANLFQF

SEQ ID NO: 132583 - protein, 11 aa, Homo Sapiens
RVLPPSHRVTW

SEQ ID NO: 132584 - protein, 11 aa, Homo Sapiens
RVNPALAELNL

SEQ ID NO: 132585 - protein, 11 aa, Homo Sapiens
RVSDLVKDLIF

SEQ ID NO: 132586 - protein, 11 aa, Homo Sapiens
RVSNQVAVNMY

SEQ ID NO: 132587 - protein, 11 aa, Homo Sapiens
SANEILGSLRW

SEQ ID NO: 132588 - protein, 11 aa, Homo Sapiens
SSLPDVEALRF

SEQ ID NO: 132589 - protein, 11 aa, Homo Sapiens
SSLPNFKQNEF

SEQ ID NO: 132590 - protein, 11 aa, Homo Sapiens
SSSAAVKDTLW

SEQ ID NO: 132591 - protein, 11 aa, Homo Sapiens
SSSHTLTYSYW

SEQ ID NO: 132592 - protein, 11 aa, Homo Sapiens
SSSSVLHGMVF

SEQ ID NO: 132593 - protein, 11 aa, Homo Sapiens
STALPLTQLRW

SEQ ID NO: 132594 - protein, 11 aa, Homo Sapiens
STARSIAVLEL

SEQ ID NO: 132595 - protein, 11 aa, Homo Sapiens
STFEDVKILAF

SEQ ID NO: 132596 - protein, 11 aa, Homo Sapiens
STIDDSQICRF

SEQ ID NO: 132597 - protein, 11 aa, Homo Sapiens
STLKDTRLLTF

SEQ ID NO: 132598 - protein, 11 aa, Homo Sapiens
STNKGTAYTFF

SEQ ID NO: 132599 - protein, 11 aa, Homo Sapiens
STSGIHAITVF

SEQ ID NO: 132600 - protein, 11 aa, Homo Sapiens
STSRVFTTLVL

SEQ ID NO: 132601 - protein, 11 aa, Homo Sapiens
SVCGQISIIRF

SEQ ID NO: 132602 - protein, 11 aa, Homo Sapiens
SVIPARIIHNW

SEQ ID NO: 132603 - protein, 11 aa, Homo Sapiens
SVSEVVGSSTL

SEQ ID NO: 132604 - protein, 11 aa, Homo Sapiens
TISAARLYYYW

SEQ ID NO: 132605 - protein, 11 aa, Homo Sapiens
TSADAVRNMEW

SEQ ID NO: 132606 - protein, 11 aa, Homo Sapiens
TSLPDKCNSFL

SEQ ID NO: 132607 - protein, 11 aa, Homo Sapiens
TSYRDFLGTNW

SEQ ID NO: 132608 - protein, 11 aa, Homo Sapiens
TTIDPRWLVEF

SEQ ID NO: 132609 - protein, 11 aa, Homo Sapiens
TTIPTKQTQTF

SEQ ID NO: 132610 - protein, 11 aa, Homo Sapiens
TTSAVIHSENF

SEQ ID NO: 132611 - protein, 11 aa, Homo Sapiens
TTVKNKDIRKF

SEQ ID NO: 132612 - protein, 11 aa, Homo Sapiens
TTVPNTIVVSW

SEQ ID NO: 132613 - protein, 11 aa, Homo Sapiens
TTWKPLNPNSW

SEQ ID NO: 132614 - protein, 11 aa, Homo Sapiens
VAKRNSLKELW

SEQ ID NO: 132615 - protein, 11 aa, Homo Sapiens
VAMKNLADNHW

SEQ ID NO: 132616 - protein, 11 aa, Homo Sapiens
VASKEIGKRKL

SEQ ID NO: 132617 - protein, 11 aa, Homo Sapiens
VASTAIAAAQW

SEQ ID NO: 132618 - protein, 11 aa, Homo Sapiens
VGLPAAGKTTW

SEQ ID NO: 132619 - protein, 11 aa, Homo Sapiens
VSAPTQILAQF

SEQ ID NO: 132620 - protein, 11 aa, Homo Sapiens
VSCGNGKLRQW

SEQ ID NO: 132621 - protein, 11 aa, Homo Sapiens
VSFEEDDKIRW

SEQ ID NO: 132622 - protein, 11 aa, Homo Sapiens
VSFPDVEKAEW

SEQ ID NO: 132623 - protein, 11 aa, Homo Sapiens
VSKSTQFEYAW

SEQ ID NO: 132624 - protein, 11 aa, Homo Sapiens
VSLPAPGVPAW

SEQ ID NO: 132625 - protein, 11 aa, Homo Sapiens
VSLPSHLNISY

SEQ ID NO: 132626 - protein, 11 aa, Homo Sapiens
VSMDNRLMELF

SEQ ID NO: 132627 - protein, 11 aa, Homo Sapiens
VSPPLITQVHW

SEQ ID NO: 132628 - protein, 11 aa, Homo Sapiens
VTDKKIAILGF

SEQ ID NO: 132629 - protein, 11 aa, Homo Sapiens
VTIKKDVDGAY

SEQ ID NO: 132630 - protein, 11 aa, Homo Sapiens
VTLHDQGTAQW

SEQ ID NO: 132631 - protein, 11 aa, Homo Sapiens
VTLKTLQQQTF

SEQ ID NO: 132632 - protein, 11 aa, Homo Sapiens
VVDPVHGFMYW

SEQ ID NO: 132633 - protein, 11 aa, Homo Sapiens
VVVPAEWIKNW

SEQ ID NO: 132634 - protein, 11 aa, Homo Sapiens
YAPRAEAEKTF

SEQ ID NO: 132635 - protein, 11 aa, Homo Sapiens
YSFQDKDNLYF

SEQ ID NO: 132636 - protein, 11 aa, Homo Sapiens
YSSDDINKFLW

SEQ ID NO: 132637 - protein, 8 aa, Homo Sapiens
AAGQVFSW

SEQ ID NO: 132638 - protein, 8 aa, Homo Sapiens
AALSWQYL

SEQ ID NO: 132639 - protein, 8 aa, Homo Sapiens
AAVKTYRW

SEQ ID NO: 132640 - protein, 8 aa, Homo Sapiens
AAYKTFSW

SEQ ID NO: 132641 - protein, 8 aa, Homo Sapiens
ASAPNWKW

SEQ ID NO: 132642 - protein, 8 aa, Homo Sapiens
ASAPSWEW

SEQ ID NO: 132643 - protein, 8 aa, Homo Sapiens
ASSTAHLW

SEQ ID NO: 132644 - protein, 8 aa, Homo Sapiens
ATGHHYTW

SEQ ID NO: 132645 - protein, 8 aa, Homo Sapiens
ATGPSIKI

SEQ ID NO: 132646 - protein, 8 aa, Homo Sapiens
AVGPTFSF

SEQ ID NO: 132647 - protein, 8 aa, Homo Sapiens
DTNADKQL

SEQ ID NO: 132648 - protein, 8 aa, Homo Sapiens
FAARSFYY

SEQ ID NO: 132649 - protein, 8 aa, Homo Sapiens
FNEKSKEL

SEQ ID NO: 132650 - protein, 8 aa, Homo Sapiens
FSFRSFIW

SEQ ID NO: 132651 - protein, 8 aa, Homo Sapiens
FSKSSDVW

SEQ ID NO: 132652 - protein, 8 aa, Homo Sapiens
FSSKSDIW

SEQ ID NO: 132653 - protein, 8 aa, Homo Sapiens
FSSKSDVW

SEQ ID NO: 132654 - protein, 8 aa, Homo Sapiens
FSTKSDVW

SEQ ID NO: 132655 - protein, 8 aa, Homo Sapiens
FTIKSDVW

SEQ ID NO: 132656 - protein, 8 aa, Homo Sapiens
GTAPAYSF

SEQ ID NO: 132657 - protein, 8 aa, Homo Sapiens
GTGKTFSF

SEQ ID NO: 132658 - protein, 8 aa, Homo Sapiens
HASTSWYW

SEQ ID NO: 132659 - protein, 8 aa, Homo Sapiens
HGVQSWSW

SEQ ID NO: 132660 - protein, 8 aa, Homo Sapiens
HSFLGFEW

SEQ ID NO: 132661 - protein, 8 aa, Homo Sapiens
HSGPFFTF

SEQ ID NO: 132662 - protein, 8 aa, Homo Sapiens
HSGPPIVI

SEQ ID NO: 132663 - protein, 8 aa, Homo Sapiens
HSHVAVAW

SEQ ID NO: 132664 - protein, 8 aa, Homo Sapiens
HSISPQMW

SEQ ID NO: 132665 - protein, 8 aa, Homo Sapiens
HSSVAFMF

SEQ ID NO: 132666 - protein, 8 aa, Homo Sapiens
HSTIVYHW

SEQ ID NO: 132667 - protein, 8 aa, Homo Sapiens
HSVEVHKW

SEQ ID NO: 132668 - protein, 8 aa, Homo Sapiens
HTTQSAQW

SEQ ID NO: 132669 - protein, 8 aa, Homo Sapiens
HTYQDHLW

SEQ ID NO: 132670 - protein, 8 aa, Homo Sapiens
IANVAHTF

SEQ ID NO: 132671 - protein, 8 aa, Homo Sapiens
IIGPYASW

SEQ ID NO: 132672 - protein, 8 aa, Homo Sapiens
ILGPTFTL

SEQ ID NO: 132673 - protein, 8 aa, Homo Sapiens
ISADTHQF

SEQ ID NO: 132674 - protein, 8 aa, Homo Sapiens
ISAKPLEM

SEQ ID NO: 132675 - protein, 8 aa, Homo Sapiens
ISGFAYEY

SEQ ID NO: 132676 - protein, 8 aa, Homo Sapiens
ISGSSVQW

SEQ ID NO: 132677 - protein, 8 aa, Homo Sapiens
ISMGDHLW

SEQ ID NO: 132678 - protein, 8 aa, Homo Sapiens
ITAHPERW

SEQ ID NO: 132679 - protein, 8 aa, Homo Sapiens
ITARPVLW

SEQ ID NO: 132680 - protein, 8 aa, Homo Sapiens
ITDKAREF

SEQ ID NO: 132681 - protein, 8 aa, Homo Sapiens
ITTEGKLW

SEQ ID NO: 132682 - protein, 8 aa, Homo Sapiens
IVTSTYGW

SEQ ID NO: 132683 - protein, 8 aa, Homo Sapiens
KAAISNKI

SEQ ID NO: 132684 - protein, 8 aa, Homo Sapiens
KAGISFII

SEQ ID NO: 132685 - protein, 8 aa, Homo Sapiens
KAGKSFDL

SEQ ID NO: 132686 - protein, 8 aa, Homo Sapiens
KAGKSLLF

SEQ ID NO: 132687 - protein, 8 aa, Homo Sapiens
KAGLASRW

SEQ ID NO: 132688 - protein, 8 aa, Homo Sapiens
KAGLAYHL

SEQ ID NO: 132689 - protein, 8 aa, Homo Sapiens
KAGLTHII

SEQ ID NO: 132690 - protein, 8 aa, Homo Sapiens
KANPGYKW

SEQ ID NO: 132691 - protein, 8 aa, Homo Sapiens
KASESFLL

SEQ ID NO: 132692 - protein, 8 aa, Homo Sapiens
KATTSTNW

SEQ ID NO: 132693 - protein, 8 aa, Homo Sapiens
KAVTTNQW

SEQ ID NO: 132694 - protein, 8 aa, Homo Sapiens
KAWKALEI

SEQ ID NO: 132695 - protein, 8 aa, Homo Sapiens
KAYKAYRL

SEQ ID NO: 132696 - protein, 8 aa, Homo Sapiens
KGASSFKI

SEQ ID NO: 132697 - protein, 8 aa, Homo Sapiens
KLGPAIKL

SEQ ID NO: 132698 - protein, 8 aa, Homo Sapiens
KSALALRW

SEQ ID NO: 132699 - protein, 8 aa, Homo Sapiens
KSDQSYVI

SEQ ID NO: 132700 - protein, 8 aa, Homo Sapiens
KSEKVKLW

SEQ ID NO: 132701 - protein, 8 aa, Homo Sapiens
KSFGGEKW

SEQ ID NO: 132702 - protein, 8 aa, Homo Sapiens
KSFVLPSW

SEQ ID NO: 132703 - protein, 8 aa, Homo Sapiens
KSGLAEHW

SEQ ID NO: 132704 - protein, 8 aa, Homo Sapiens
KSGLSVRF

SEQ ID NO: 132705 - protein, 8 aa, Homo Sapiens
KSIWNNRW

SEQ ID NO: 132706 - protein, 8 aa, Homo Sapiens
KSTIGVEF

SEQ ID NO: 132707 - protein, 8 aa, Homo Sapiens
KSVTADRW

SEQ ID NO: 132708 - protein, 8 aa, Homo Sapiens
KSWRDVYW

SEQ ID NO: 132709 - protein, 8 aa, Homo Sapiens
KSWSTGKW

SEQ ID NO: 132710 - protein, 8 aa, Homo Sapiens
KSYFSQKW

SEQ ID NO: 132711 - protein, 8 aa, Homo Sapiens
KTIKDCKW

SEQ ID NO: 132712 - protein, 8 aa, Homo Sapiens
KTSHTVKW

SEQ ID NO: 132713 - protein, 8 aa, Homo Sapiens
KTSVVIKW

SEQ ID NO: 132714 - protein, 8 aa, Homo Sapiens
KVGKTYEL

SEQ ID NO: 132715 - protein, 8 aa, Homo Sapiens
KVGPNATY

SEQ ID NO: 132716 - protein, 8 aa, Homo Sapiens
LAALSWQY

SEQ ID NO: 132717 - protein, 8 aa, Homo Sapiens
LAGPPLEI

SEQ ID NO: 132718 - protein, 8 aa, Homo Sapiens
LAGVSFEI

SEQ ID NO: 132719 - protein, 8 aa, Homo Sapiens
LGAPGFAW

SEQ ID NO: 132720 - protein, 8 aa, Homo Sapiens
LIGPPLLI

SEQ ID NO: 132721 - protein, 8 aa, Homo Sapiens
LIGPTFSY

SEQ ID NO: 132722 - protein, 8 aa, Homo Sapiens
LLGPTAQW

SEQ ID NO: 132723 - protein, 8 aa, Homo Sapiens
LNNMRSQY

SEQ ID NO: 132724 - protein, 8 aa, Homo Sapiens
LSGEAFDW

SEQ ID NO: 132725 - protein, 8 aa, Homo Sapiens
LSGPRLLF

SEQ ID NO: 132726 - protein, 8 aa, Homo Sapiens
LSQKGYSW

SEQ ID NO: 132727 - protein, 8 aa, Homo Sapiens
LSQRGYEW

SEQ ID NO: 132728 - protein, 8 aa, Homo Sapiens
LSSQSRQW

SEQ ID NO: 132729 - protein, 8 aa, Homo Sapiens
LSTRPEKF

SEQ ID NO: 132730 - protein, 8 aa, Homo Sapiens
LTAEAFGF

SEQ ID NO: 132731 - protein, 8 aa, Homo Sapiens
LTGPALQW

SEQ ID NO: 132732 - protein, 8 aa, Homo Sapiens
LTGPWKLW

SEQ ID NO: 132733 - protein, 8 aa, Homo Sapiens
MSGPAWQL

SEQ ID NO: 132734 - protein, 8 aa, Homo Sapiens
MSTKAVLW

SEQ ID NO: 132735 - protein, 8 aa, Homo Sapiens
MSTLPSKW

SEQ ID NO: 132736 - protein, 8 aa, Homo Sapiens
MTGLALLY

SEQ ID NO: 132737 - protein, 8 aa, Homo Sapiens
MTGPFFRY

SEQ ID NO: 132738 - protein, 8 aa, Homo Sapiens
MTGRAARW

SEQ ID NO: 132739 - protein, 8 aa, Homo Sapiens
NGGPSHLW

SEQ ID NO: 132740 - protein, 8 aa, Homo Sapiens
NSASSHNW

SEQ ID NO: 132741 - protein, 8 aa, Homo Sapiens
PDEVARRW

SEQ ID NO: 132742 - protein, 8 aa, Homo Sapiens
PDIKKDRW

SEQ ID NO: 132743 - protein, 8 aa, Homo Sapiens
PINGNGKQ

SEQ ID NO: 132744 - protein, 8 aa, Homo Sapiens
PSGAYFAW

SEQ ID NO: 132745 - protein, 8 aa, Homo Sapiens
QAAQPTRW

SEQ ID NO: 132746 - protein, 8 aa, Homo Sapiens
QATGTSRW

SEQ ID NO: 132747 - protein, 8 aa, Homo Sapiens
QAWTSHLW

SEQ ID NO: 132748 - protein, 8 aa, Homo Sapiens
QSFITSSW

SEQ ID NO: 132749 - protein, 8 aa, Homo Sapiens
QSGLVHIW

SEQ ID NO: 132750 - protein, 8 aa, Homo Sapiens
QSLKELYI

SEQ ID NO: 132751 - protein, 8 aa, Homo Sapiens
RAIRDFFW

SEQ ID NO: 132752 - protein, 8 aa, Homo Sapiens
RGFGSFRF

SEQ ID NO: 132753 - protein, 8 aa, Homo Sapiens
RGGPFQRW

SEQ ID NO: 132754 - protein, 8 aa, Homo Sapiens
RLAPNFRW

SEQ ID NO: 132755 - protein, 8 aa, Homo Sapiens
RSAEALAF

SEQ ID NO: 132756 - protein, 8 aa, Homo Sapiens
RSAKWRPG

SEQ ID NO: 132757 - protein, 8 aa, Homo Sapiens
RSDKPKLF

SEQ ID NO: 132758 - protein, 8 aa, Homo Sapiens
RSFRPLLF

SEQ ID NO: 132759 - protein, 8 aa, Homo Sapiens
RSGPASTF

SEQ ID NO: 132760 - protein, 8 aa, Homo Sapiens
RSMKGLRW

SEQ ID NO: 132761 - protein, 8 aa, Homo Sapiens
RSWLSYSY

SEQ ID NO: 132762 - protein, 8 aa, Homo Sapiens
RTFKGFQI

SEQ ID NO: 132763 - protein, 8 aa, Homo Sapiens
RVGKAFKY

SEQ ID NO: 132764 - protein, 8 aa, Homo Sapiens
SAAGTYAW

SEQ ID NO: 132765 - protein, 8 aa, Homo Sapiens
SAAKSWVF

SEQ ID NO: 132766 - protein, 8 aa, Homo Sapiens
SAAPTFMI

SEQ ID NO: 132767 - protein, 8 aa, Homo Sapiens
SAASSYSF

SEQ ID NO: 132768 - protein, 8 aa, Homo Sapiens
SAGHAYHW

SEQ ID NO: 132769 - protein, 8 aa, Homo Sapiens
SAGHTFSW

SEQ ID NO: 132770 - protein, 8 aa, Homo Sapiens
SAGQAWKW

SEQ ID NO: 132771 - protein, 8 aa, Homo Sapiens
SAGSSFVF

SEQ ID NO: 132772 - protein, 8 aa, Homo Sapiens
SIHLQHKF

SEQ ID NO: 132773 - protein, 8 aa, Homo Sapiens
SSFASHKW

SEQ ID NO: 132774 - protein, 8 aa, Homo Sapiens
SSGPQSGW

SEQ ID NO: 132775 - protein, 8 aa, Homo Sapiens
SSSSSFRW

SEQ ID NO: 132776 - protein, 8 aa, Homo Sapiens
SSTVTHLF

SEQ ID NO: 132777 - protein, 8 aa, Homo Sapiens
STAPQPVW

SEQ ID NO: 132778 - protein, 8 aa, Homo Sapiens
STAVSYAW

SEQ ID NO: 132779 - protein, 8 aa, Homo Sapiens
SVTEIQEK

SEQ ID NO: 132780 - protein, 8 aa, Homo Sapiens
TSGPGFHL

SEQ ID NO: 132781 - protein, 8 aa, Homo Sapiens
TSGPPLTM

SEQ ID NO: 132782 - protein, 8 aa, Homo Sapiens
TTAIAEAW

SEQ ID NO: 132783 - protein, 8 aa, Homo Sapiens
TTKAISRW

SEQ ID NO: 132784 - protein, 8 aa, Homo Sapiens
VAAKPESW

SEQ ID NO: 132785 - protein, 8 aa, Homo Sapiens
VAAPSWLH

SEQ ID NO: 132786 - protein, 8 aa, Homo Sapiens
VAAQSYLY

SEQ ID NO: 132787 - protein, 8 aa, Homo Sapiens
VAGKTYRW

SEQ ID NO: 132788 - protein, 8 aa, Homo Sapiens
VIEVKVPA

SEQ ID NO: 132789 - protein, 8 aa, Homo Sapiens
VSAVASQW

SEQ ID NO: 132790 - protein, 8 aa, Homo Sapiens
VSGKVYQW

SEQ ID NO: 132791 - protein, 8 aa, Homo Sapiens
VSIKAIGW

SEQ ID NO: 132792 - protein, 8 aa, Homo Sapiens
VSLTACKV

SEQ ID NO: 132793 - protein, 8 aa, Homo Sapiens
VSSKAYLM

SEQ ID NO: 132794 - protein, 8 aa, Homo Sapiens
VSTASHLL

SEQ ID NO: 132795 - protein, 8 aa, Homo Sapiens
VSVPTFSW

SEQ ID NO: 132796 - protein, 8 aa, Homo Sapiens
VTATSSKW

SEQ ID NO: 132797 - protein, 8 aa, Homo Sapiens
VTMDDFRW

SEQ ID NO: 132798 - protein, 8 aa, Homo Sapiens
VTVQSFGW

SEQ ID NO: 132799 - protein, 8 aa, Homo Sapiens
YATQSHQW

SEQ ID NO: 132800 - protein, 8 aa, Homo Sapiens
YSARGWEW

SEQ ID NO: 132801 - protein, 8 aa, Homo Sapiens
YSASEYRW

SEQ ID NO: 132802 - protein, 8 aa, Homo Sapiens
YSGLSVSW

SEQ ID NO: 132803 - protein, 9 aa, Homo Sapiens
AAAKIQASF

SEQ ID NO: 132804 - protein, 9 aa, Homo Sapiens
AAANAQLHW

SEQ ID NO: 132805 - protein, 9 aa, Homo Sapiens
AAAPPSPAW

SEQ ID NO: 132806 - protein, 9 aa, Homo Sapiens
AALPAAALW

SEQ ID NO: 132807 - protein, 9 aa, Homo Sapiens
AANHKVAKW

SEQ ID NO: 132808 - protein, 9 aa, Homo Sapiens
AANPHSFVF

SEQ ID NO: 132809 - protein, 9 aa, Homo Sapiens
AANPIESQW

SEQ ID NO: 132810 - protein, 9 aa, Homo Sapiens
AASSISSPW

SEQ ID NO: 132811 - protein, 9 aa, Homo Sapiens
AAVVPLGTW

SEQ ID NO: 132812 - protein, 9 aa, Homo Sapiens
AIESGQHYW

SEQ ID NO: 132813 - protein, 9 aa, Homo Sapiens
AILKKVIQW

SEQ ID NO: 132814 - protein, 9 aa, Homo Sapiens
AISDLQQLW

SEQ ID NO: 132815 - protein, 9 aa, Homo Sapiens
ALSPAVGSW

SEQ ID NO: 132816 - protein, 9 aa, Homo Sapiens
ASAHDQLLW

SEQ ID NO: 132817 - protein, 9 aa, Homo Sapiens
ASAIDISKW

SEQ ID NO: 132818 - protein, 9 aa, Homo Sapiens
ASAIIIQRW

SEQ ID NO: 132819 - protein, 9 aa, Homo Sapiens
ASAPSWEWA

SEQ ID NO: 132820 - protein, 9 aa, Homo Sapiens
ASATERQEW

SEQ ID NO: 132821 - protein, 9 aa, Homo Sapiens
ASAWALERW

SEQ ID NO: 132822 - protein, 9 aa, Homo Sapiens
ASFDGTFLW

SEQ ID NO: 132823 - protein, 9 aa, Homo Sapiens
ASFHQDSAW

SEQ ID NO: 132824 - protein, 9 aa, Homo Sapiens
ASGNVSWLW

SEQ ID NO: 132825 - protein, 9 aa, Homo Sapiens
ASHKGQKLW

SEQ ID NO: 132826 - protein, 9 aa, Homo Sapiens
ASILCKALW

SEQ ID NO: 132827 - protein, 9 aa, Homo Sapiens
ASLLHQVSW

SEQ ID NO: 132828 - protein, 9 aa, Homo Sapiens
ASLPEAQVW

SEQ ID NO: 132829 - protein, 9 aa, Homo Sapiens
ASLPSSASW

SEQ ID NO: 132830 - protein, 9 aa, Homo Sapiens
ASMGFDPRW

SEQ ID NO: 132831 - protein, 9 aa, Homo Sapiens
ASNGDVYAW

SEQ ID NO: 132832 - protein, 9 aa, Homo Sapiens
ASNGVLLLM

SEQ ID NO: 132833 - protein, 9 aa, Homo Sapiens
ASNKLQIVF

SEQ ID NO: 132834 - protein, 9 aa, Homo Sapiens
ASNKYLVEF

SEQ ID NO: 132835 - protein, 9 aa, Homo Sapiens
ASNPAMLLY

SEQ ID NO: 132836 - protein, 9 aa, Homo Sapiens
ASNPVLDAW

SEQ ID NO: 132837 - protein, 9 aa, Homo Sapiens
ASRDTVIVW

SEQ ID NO: 132838 - protein, 9 aa, Homo Sapiens
ASSPDGFFW

SEQ ID NO: 132839 - protein, 9 aa, Homo Sapiens
ASSSAEEQW

SEQ ID NO: 132840 - protein, 9 aa, Homo Sapiens
ASTHMSPSW

SEQ ID NO: 132841 - protein, 9 aa, Homo Sapiens
ASTLIVGHW

SEQ ID NO: 132842 - protein, 9 aa, Homo Sapiens
ASTQPTHSW

SEQ ID NO: 132843 - protein, 9 aa, Homo Sapiens
ASVKVVSKF

SEQ ID NO: 132844 - protein, 9 aa, Homo Sapiens
ASVPIMYSW

SEQ ID NO: 132845 - protein, 9 aa, Homo Sapiens
ATADVEWRW

SEQ ID NO: 132846 - protein, 9 aa, Homo Sapiens
ATAPVVALF

SEQ ID NO: 132847 - protein, 9 aa, Homo Sapiens
ATATEKSEW

SEQ ID NO: 132848 - protein, 9 aa, Homo Sapiens
ATAVAQLLW

SEQ ID NO: 132849 - protein, 9 aa, Homo Sapiens
ATDGKVLLW

SEQ ID NO: 132850 - protein, 9 aa, Homo Sapiens
ATEVTGHRW

SEQ ID NO: 132851 - protein, 9 aa, Homo Sapiens
ATGPRPALF

SEQ ID NO: 132852 - protein, 9 aa, Homo Sapiens
ATIGHVEKF

SEQ ID NO: 132853 - protein, 9 aa, Homo Sapiens
ATIKEIVVW

SEQ ID NO: 132854 - protein, 9 aa, Homo Sapiens
ATLELTHNW

SEQ ID NO: 132855 - protein, 9 aa, Homo Sapiens
ATLKNPILW

SEQ ID NO: 132856 - protein, 9 aa, Homo Sapiens
ATNGVVVTW

SEQ ID NO: 132857 - protein, 9 aa, Homo Sapiens
ATNRITVTW

SEQ ID NO: 132858 - protein, 9 aa, Homo Sapiens
ATNVNNWHW

SEQ ID NO: 132859 - protein, 9 aa, Homo Sapiens
ATQPEVADW

SEQ ID NO: 132860 - protein, 9 aa, Homo Sapiens
ATRPDYISW

SEQ ID NO: 132861 - protein, 9 aa, Homo Sapiens
ATSKVALVY

SEQ ID NO: 132862 - protein, 9 aa, Homo Sapiens
ATSKYLIGW

SEQ ID NO: 132863 - protein, 9 aa, Homo Sapiens
ATSQAQAGW

SEQ ID NO: 132864 - protein, 9 aa, Homo Sapiens
ATVEQQEHW

SEQ ID NO: 132865 - protein, 9 aa, Homo Sapiens
ATYMKPEMW

SEQ ID NO: 132866 - protein, 9 aa, Homo Sapiens
AVCRLRHWW

SEQ ID NO: 132867 - protein, 9 aa, Homo Sapiens
AVDFTQEEW

SEQ ID NO: 132868 - protein, 9 aa, Homo Sapiens
AVDSTVKVW

SEQ ID NO: 132869 - protein, 9 aa, Homo Sapiens
AVEKNPAVW

SEQ ID NO: 132870 - protein, 9 aa, Homo Sapiens
AVIDLNNRW

SEQ ID NO: 132871 - protein, 9 aa, Homo Sapiens
AVLQKVALW

SEQ ID NO: 132872 - protein, 9 aa, Homo Sapiens
AVMTPQELW

SEQ ID NO: 132873 - protein, 9 aa, Homo Sapiens
AVNCHVITW

SEQ ID NO: 132874 - protein, 9 aa, Homo Sapiens
AVNGVQLHY

SEQ ID NO: 132875 - protein, 9 aa, Homo Sapiens
AVSAVASQW

SEQ ID NO: 132876 - protein, 9 aa, Homo Sapiens
AVSKDIANW

SEQ ID NO: 132877 - protein, 9 aa, Homo Sapiens
AVSLIREEW

SEQ ID NO: 132878 - protein, 9 aa, Homo Sapiens
AVSRILEEW

SEQ ID NO: 132879 - protein, 9 aa, Homo Sapiens
DPDEVARRW

SEQ ID NO: 132880 - protein, 9 aa, Homo Sapiens
FAVPDKVLW

SEQ ID NO: 132881 - protein, 9 aa, Homo Sapiens
FICTAKTEW

SEQ ID NO: 132882 - protein, 9 aa, Homo Sapiens
FMVPAQSSW

SEQ ID NO: 132883 - protein, 9 aa, Homo Sapiens
FRVPTANVS

SEQ ID NO: 132884 - protein, 9 aa, Homo Sapiens
FSAPGVTSW

SEQ ID NO: 132885 - protein, 9 aa, Homo Sapiens
FSDRSSLTF

SEQ ID NO: 132886 - protein, 9 aa, Homo Sapiens
FSEKFPTLW

SEQ ID NO: 132887 - protein, 9 aa, Homo Sapiens
FSFAEVHSW

SEQ ID NO: 132888 - protein, 9 aa, Homo Sapiens
FSFKKSFKL

SEQ ID NO: 132889 - protein, 9 aa, Homo Sapiens
FSKKCSERW

SEQ ID NO: 132890 - protein, 9 aa, Homo Sapiens
FSKSDLVNW

SEQ ID NO: 132891 - protein, 9 aa, Homo Sapiens
FSLPAQPLW

SEQ ID NO: 132892 - protein, 9 aa, Homo Sapiens
FSLPNIPRW

SEQ ID NO: 132893 - protein, 9 aa, Homo Sapiens
FSLSVFHHW

SEQ ID NO: 132894 - protein, 9 aa, Homo Sapiens
FSQPEVQLW

SEQ ID NO: 132895 - protein, 9 aa, Homo Sapiens
FSSPVCMAF

SEQ ID NO: 132896 - protein, 9 aa, Homo Sapiens
FSSREQPKL

SEQ ID NO: 132897 - protein, 9 aa, Homo Sapiens
FSYRDVNSW

SEQ ID NO: 132898 - protein, 9 aa, Homo Sapiens
FVAVEREEW

SEQ ID NO: 132899 - protein, 9 aa, Homo Sapiens
GAVRENYTW

SEQ ID NO: 132900 - protein, 9 aa, Homo Sapiens
GLTKNILGF

SEQ ID NO: 132901 - protein, 9 aa, Homo Sapiens
GSASVNSRW

SEQ ID NO: 132902 - protein, 9 aa, Homo Sapiens
GSCRLPVSW

SEQ ID NO: 132903 - protein, 9 aa, Homo Sapiens
GSHGIEAAW

SEQ ID NO: 132904 - protein, 9 aa, Homo Sapiens
GSIPNSWKW

SEQ ID NO: 132905 - protein, 9 aa, Homo Sapiens
GSNKTLLSF

SEQ ID NO: 132906 - protein, 9 aa, Homo Sapiens
GSNPHLQTF

SEQ ID NO: 132907 - protein, 9 aa, Homo Sapiens
GSYNGQVGW

SEQ ID NO: 132908 - protein, 9 aa, Homo Sapiens
GSYWKEGRW

SEQ ID NO: 132909 - protein, 9 aa, Homo Sapiens
GTAGLLEQW

SEQ ID NO: 132910 - protein, 9 aa, Homo Sapiens
GTDGHPFGW

SEQ ID NO: 132911 - protein, 9 aa, Homo Sapiens
GTDKTLRTW

SEQ ID NO: 132912 - protein, 9 aa, Homo Sapiens
GTDPNSAAW

SEQ ID NO: 132913 - protein, 9 aa, Homo Sapiens
GTDRNAYVW

SEQ ID NO: 132914 - protein, 9 aa, Homo Sapiens
GTFNPVSLW

SEQ ID NO: 132915 - protein, 9 aa, Homo Sapiens
GTHSLDIKW

SEQ ID NO: 132916 - protein, 9 aa, Homo Sapiens
GTISREHPW

SEQ ID NO: 132917 - protein, 9 aa, Homo Sapiens
GTLETKYKW

SEQ ID NO: 132918 - protein, 9 aa, Homo Sapiens
GTLKERVQW

SEQ ID NO: 132919 - protein, 9 aa, Homo Sapiens
GTMDVHHHW

SEQ ID NO: 132920 - protein, 9 aa, Homo Sapiens
GTSPEVQTW

SEQ ID NO: 132921 - protein, 9 aa, Homo Sapiens
GTVITPDTW

SEQ ID NO: 132922 - protein, 9 aa, Homo Sapiens
GTYSPEISW

SEQ ID NO: 132923 - protein, 9 aa, Homo Sapiens
HAASDTVGW

SEQ ID NO: 132924 - protein, 9 aa, Homo Sapiens
HAATIRLIF

SEQ ID NO: 132925 - protein, 9 aa, Homo Sapiens
HAATTSLSW

SEQ ID NO: 132926 - protein, 9 aa, Homo Sapiens
HACGVIATI

SEQ ID NO: 132927 - protein, 9 aa, Homo Sapiens
HADINLLYW

SEQ ID NO: 132928 - protein, 9 aa, Homo Sapiens
HADTTKWEW

SEQ ID NO: 132929 - protein, 9 aa, Homo Sapiens
HAGNINFKW

SEQ ID NO: 132930 - protein, 9 aa, Homo Sapiens
HAGPIVSVW

SEQ ID NO: 132931 - protein, 9 aa, Homo Sapiens
HAIPLRSSW

SEQ ID NO: 132932 - protein, 9 aa, Homo Sapiens
HAIRLLLEY

SEQ ID NO: 132933 - protein, 9 aa, Homo Sapiens
HALICISHW

SEQ ID NO: 132934 - protein, 9 aa, Homo Sapiens
HAMGGVPAW

SEQ ID NO: 132935 - protein, 9 aa, Homo Sapiens
HAMTNDVTW

SEQ ID NO: 132936 - protein, 9 aa, Homo Sapiens
HATKAIYRW

SEQ ID NO: 132937 - protein, 9 aa, Homo Sapiens
HAVVICTEW

SEQ ID NO: 132938 - protein, 9 aa, Homo Sapiens
HLAWVQEEW

SEQ ID NO: 132939 - protein, 9 aa, Homo Sapiens
HSAQELQEW

SEQ ID NO: 132940 - protein, 9 aa, Homo Sapiens
HSCDALNRW

SEQ ID NO: 132941 - protein, 9 aa, Homo Sapiens
HSCLFRHSW

SEQ ID NO: 132942 - protein, 9 aa, Homo Sapiens
HSDPEEMQW

SEQ ID NO: 132943 - protein, 9 aa, Homo Sapiens
HSFLYQPDW

SEQ ID NO: 132944 - protein, 9 aa, Homo Sapiens
HSFPLQFTL

SEQ ID NO: 132945 - protein, 9 aa, Homo Sapiens
HSGGPCALW

SEQ ID NO: 132946 - protein, 9 aa, Homo Sapiens
HSGIAVHTW

SEQ ID NO: 132947 - protein, 9 aa, Homo Sapiens
HSGPSKWNW

SEQ ID NO: 132948 - protein, 9 aa, Homo Sapiens
HSGPVIPVY

SEQ ID NO: 132949 - protein, 9 aa, Homo Sapiens
HSHFQNIFW

SEQ ID NO: 132950 - protein, 9 aa, Homo Sapiens
HSICTSEEW

SEQ ID NO: 132951 - protein, 9 aa, Homo Sapiens
HSILNPQKW

SEQ ID NO: 132952 - protein, 9 aa, Homo Sapiens
HSLESQVTF

SEQ ID NO: 132953 - protein, 9 aa, Homo Sapiens
HSNEVIMTI

SEQ ID NO: 132954 - protein, 9 aa, Homo Sapiens
HSNGTVSLW

SEQ ID NO: 132955 - protein, 9 aa, Homo Sapiens
HSNPEGSSW

SEQ ID NO: 132956 - protein, 9 aa, Homo Sapiens
HSNPGDYAW

SEQ ID NO: 132957 - protein, 9 aa, Homo Sapiens
HSNSVPLAL

SEQ ID NO: 132958 - protein, 9 aa, Homo Sapiens
HSQEELAEW

SEQ ID NO: 132959 - protein, 9 aa, Homo Sapiens
HSQVCSILW

SEQ ID NO: 132960 - protein, 9 aa, Homo Sapiens
HSSAVAATY

SEQ ID NO: 132961 - protein, 9 aa, Homo Sapiens
HSSGILPKW

SEQ ID NO: 132962 - protein, 9 aa, Homo Sapiens
HSSIVRSGW

SEQ ID NO: 132963 - protein, 9 aa, Homo Sapiens
HSSVGQVTW

SEQ ID NO: 132964 - protein, 9 aa, Homo Sapiens
HSSVVNYEF

SEQ ID NO: 132965 - protein, 9 aa, Homo Sapiens
HSTKLIQEW

SEQ ID NO: 132966 - protein, 9 aa, Homo Sapiens
HSTLVPHEW

SEQ ID NO: 132967 - protein, 9 aa, Homo Sapiens
HSVDQSWSW

SEQ ID NO: 132968 - protein, 9 aa, Homo Sapiens
HSYFWPLEW

SEQ ID NO: 132969 - protein, 9 aa, Homo Sapiens
HSYPGASGW

SEQ ID NO: 132970 - protein, 9 aa, Homo Sapiens
HTAHIACKF

SEQ ID NO: 132971 - protein, 9 aa, Homo Sapiens
HTAPNVPHY

SEQ ID NO: 132972 - protein, 9 aa, Homo Sapiens
HTEMVAELW

SEQ ID NO: 132973 - protein, 9 aa, Homo Sapiens
HTGPAGDSW

SEQ ID NO: 132974 - protein, 9 aa, Homo Sapiens
HTIQIRQDW

SEQ ID NO: 132975 - protein, 9 aa, Homo Sapiens
HTNPVGTEW

SEQ ID NO: 132976 - protein, 9 aa, Homo Sapiens
HTQENCETW

SEQ ID NO: 132977 - protein, 9 aa, Homo Sapiens
HTQTGVSTW

SEQ ID NO: 132978 - protein, 9 aa, Homo Sapiens
HTSSTTSAW

SEQ ID NO: 132979 - protein, 9 aa, Homo Sapiens
HTSYEISAW

SEQ ID NO: 132980 - protein, 9 aa, Homo Sapiens
HTTGMDVLW

SEQ ID NO: 132981 - protein, 9 aa, Homo Sapiens
HTVGLSSTW

SEQ ID NO: 132982 - protein, 9 aa, Homo Sapiens
HTVPDMGKW

SEQ ID NO: 132983 - protein, 9 aa, Homo Sapiens
HTVWESEEW

SEQ ID NO: 132984 - protein, 9 aa, Homo Sapiens
HTWKELELW

SEQ ID NO: 132985 - protein, 9 aa, Homo Sapiens
HVEDLNAKW

SEQ ID NO: 132986 - protein, 9 aa, Homo Sapiens
HVIWFHPTW

SEQ ID NO: 132987 - protein, 9 aa, Homo Sapiens
HVVEQHWEW

SEQ ID NO: 132988 - protein, 9 aa, Homo Sapiens
IAAPDSRRW

SEQ ID NO: 132989 - protein, 9 aa, Homo Sapiens
IAAQTGTRW

SEQ ID NO: 132990 - protein, 9 aa, Homo Sapiens
IAIKGVARF

SEQ ID NO: 132991 - protein, 9 aa, Homo Sapiens
IAIPLRRSS

SEQ ID NO: 132992 - protein, 9 aa, Homo Sapiens
IAIPVTVAF

SEQ ID NO: 132993 - protein, 9 aa, Homo Sapiens
IALPPIAKW

SEQ ID NO: 132994 - protein, 9 aa, Homo Sapiens
IANQIQEDW

SEQ ID NO: 132995 - protein, 9 aa, Homo Sapiens
IANQVQLFY

SEQ ID NO: 132996 - protein, 9 aa, Homo Sapiens
IAQRYLLQY

SEQ ID NO: 132997 - protein, 9 aa, Homo Sapiens
IAVEPGNQW

SEQ ID NO: 132998 - protein, 9 aa, Homo Sapiens
IAVPRNDEW

SEQ ID NO: 132999 - protein, 9 aa, Homo Sapiens
IFNAVSLRW

SEQ ID NO: 133000 - protein, 9 aa, Homo Sapiens
IGYVDTTHW

SEQ ID NO: 133001 - protein, 9 aa, Homo Sapiens
IIFVPVPQL

SEQ ID NO: 133002 - protein, 9 aa, Homo Sapiens
IIISTPEKW

SEQ ID NO: 133003 - protein, 9 aa, Homo Sapiens
IIMKDVPDW

SEQ ID NO: 133004 - protein, 9 aa, Homo Sapiens
IITPIHEQW

SEQ ID NO: 133005 - protein, 9 aa, Homo Sapiens
IIVCTPEKW

SEQ ID NO: 133006 - protein, 9 aa, Homo Sapiens
ILSRLILLW

SEQ ID NO: 133007 - protein, 9 aa, Homo Sapiens
IMDVTEEVW

SEQ ID NO: 133008 - protein, 9 aa, Homo Sapiens
IMFDGPEAW

SEQ ID NO: 133009 - protein, 9 aa, Homo Sapiens
IMSRCIPLW

SEQ ID NO: 133010 - protein, 9 aa, Homo Sapiens
ISAEDAERW

SEQ ID NO: 133011 - protein, 9 aa, Homo Sapiens
ISAHDILSW

SEQ ID NO: 133012 - protein, 9 aa, Homo Sapiens
ISAIPEQRW

SEQ ID NO: 133013 - protein, 9 aa, Homo Sapiens
ISAKNGVQW

SEQ ID NO: 133014 - protein, 9 aa, Homo Sapiens
ISAPVSERM

SEQ ID NO: 133015 - protein, 9 aa, Homo Sapiens
ISCGPSSRW

SEQ ID NO: 133016 - protein, 9 aa, Homo Sapiens
ISCKEELLL

SEQ ID NO: 133017 - protein, 9 aa, Homo Sapiens
ISFPPRDEW

SEQ ID NO: 133018 - protein, 9 aa, Homo Sapiens
ISGHHPETW

SEQ ID NO: 133019 - protein, 9 aa, Homo Sapiens
ISHEDGTLW

SEQ ID NO: 133020 - protein, 9 aa, Homo Sapiens
ISHGEVLEW

SEQ ID NO: 133021 - protein, 9 aa, Homo Sapiens
ISHIPASRW

SEQ ID NO: 133022 - protein, 9 aa, Homo Sapiens
ISHYPDYSW

SEQ ID NO: 133023 - protein, 9 aa, Homo Sapiens
ISLKENRHW

SEQ ID NO: 133024 - protein, 9 aa, Homo Sapiens
ISMPAQNLW

SEQ ID NO: 133025 - protein, 9 aa, Homo Sapiens
ISMRCMVQF

SEQ ID NO: 133026 - protein, 9 aa, Homo Sapiens
ISNPKTAEF

SEQ ID NO: 133027 - protein, 9 aa, Homo Sapiens
ISNPVTKEM

SEQ ID NO: 133028 - protein, 9 aa, Homo Sapiens
ISQKTLSQW

SEQ ID NO: 133029 - protein, 9 aa, Homo Sapiens
ISQRAPVHW

SEQ ID NO: 133030 - protein, 9 aa, Homo Sapiens
ISSDGQFAL

SEQ ID NO: 133031 - protein, 9 aa, Homo Sapiens
ISSGVVSIW

SEQ ID NO: 133032 - protein, 9 aa, Homo Sapiens
ISSKTAAKL

SEQ ID NO: 133033 - protein, 9 aa, Homo Sapiens
ISSQTTERF

SEQ ID NO: 133034 - protein, 9 aa, Homo Sapiens
ISSSAGARW

SEQ ID NO: 133035 - protein, 9 aa, Homo Sapiens
ISSSAHHVT

SEQ ID NO: 133036 - protein, 9 aa, Homo Sapiens
ISTEVNPKL

SEQ ID NO: 133037 - protein, 9 aa, Homo Sapiens
ISTIFKSLW

SEQ ID NO: 133038 - protein, 9 aa, Homo Sapiens
ISTKTSAKL

SEQ ID NO: 133039 - protein, 9 aa, Homo Sapiens
ISTPFPAVW

SEQ ID NO: 133040 - protein, 9 aa, Homo Sapiens
ISTPVIRTF

SEQ ID NO: 133041 - protein, 9 aa, Homo Sapiens
ISVAEVEKW

SEQ ID NO: 133042 - protein, 9 aa, Homo Sapiens
ISVAPEETW

SEQ ID NO: 133043 - protein, 9 aa, Homo Sapiens
ISVPIFKQF

SEQ ID NO: 133044 - protein, 9 aa, Homo Sapiens
ISVPPIQKW

SEQ ID NO: 133045 - protein, 9 aa, Homo Sapiens
ITAGAHRLW

SEQ ID NO: 133046 - protein, 9 aa, Homo Sapiens
ITAQELDRW

SEQ ID NO: 133047 - protein, 9 aa, Homo Sapiens
ITDFHPDTW

SEQ ID NO: 133048 - protein, 9 aa, Homo Sapiens
ITFAPTYRF

SEQ ID NO: 133049 - protein, 9 aa, Homo Sapiens
ITIPKNMHW

SEQ ID NO: 133050 - protein, 9 aa, Homo Sapiens
ITNHIHVRI

SEQ ID NO: 133051 - protein, 9 aa, Homo Sapiens
ITNKYQLVF

SEQ ID NO: 133052 - protein, 9 aa, Homo Sapiens
ITSPTGETW

SEQ ID NO: 133053 - protein, 9 aa, Homo Sapiens
ITTDVLYTI

SEQ ID NO: 133054 - protein, 9 aa, Homo Sapiens
ITTDVNPYY

SEQ ID NO: 133055 - protein, 9 aa, Homo Sapiens
ITTKAISRW

SEQ ID NO: 133056 - protein, 9 aa, Homo Sapiens
ITTSLTTKW

SEQ ID NO: 133057 - protein, 9 aa, Homo Sapiens
ITTTINPRF

SEQ ID NO: 133058 - protein, 9 aa, Homo Sapiens
ITTVIQHVF

SEQ ID NO: 133059 - protein, 9 aa, Homo Sapiens
ITVKVNAPY

SEQ ID NO: 133060 - protein, 9 aa, Homo Sapiens
ITYDKLNKW

SEQ ID NO: 133061 - protein, 9 aa, Homo Sapiens
ITYQHIDRW

SEQ ID NO: 133062 - protein, 9 aa, Homo Sapiens
ITYTFHSTW

SEQ ID NO: 133063 - protein, 9 aa, Homo Sapiens
IVCSVPHTW

SEQ ID NO: 133064 - protein, 9 aa, Homo Sapiens
IVDFTQEEW

SEQ ID NO: 133065 - protein, 9 aa, Homo Sapiens
IVDIGRQDW

SEQ ID NO: 133066 - protein, 9 aa, Homo Sapiens
IVSSALMIW

SEQ ID NO: 133067 - protein, 9 aa, Homo Sapiens
KAADPVPSF

SEQ ID NO: 133068 - protein, 9 aa, Homo Sapiens
KAAELFSQW

SEQ ID NO: 133069 - protein, 9 aa, Homo Sapiens
KAAGEKVYW

SEQ ID NO: 133070 - protein, 9 aa, Homo Sapiens
KAAHVSEQF

SEQ ID NO: 133071 - protein, 9 aa, Homo Sapiens
KAALELEMW

SEQ ID NO: 133072 - protein, 9 aa, Homo Sapiens
KAASVRPVL

SEQ ID NO: 133073 - protein, 9 aa, Homo Sapiens
KACDKSFHF

SEQ ID NO: 133074 - protein, 9 aa, Homo Sapiens
KACDLGHIW

SEQ ID NO: 133075 - protein, 9 aa, Homo Sapiens
KACTIAIRY

SEQ ID NO: 133076 - protein, 9 aa, Homo Sapiens
KADKVTMLW

SEQ ID NO: 133077 - protein, 9 aa, Homo Sapiens
KADVVKVKW

SEQ ID NO: 133078 - protein, 9 aa, Homo Sapiens
KAFDQRLTF

SEQ ID NO: 133079 - protein, 9 aa, Homo Sapiens
KAFNLRISF

SEQ ID NO: 133080 - protein, 9 aa, Homo Sapiens
KAFPEHFTY

SEQ ID NO: 133081 - protein, 9 aa, Homo Sapiens
KAFPFHIIF

SEQ ID NO: 133082 - protein, 9 aa, Homo Sapiens
KAFQATLRW

SEQ ID NO: 133083 - protein, 9 aa, Homo Sapiens
KAFSTRWNW

SEQ ID NO: 133084 - protein, 9 aa, Homo Sapiens
KAGIIQDTW

SEQ ID NO: 133085 - protein, 9 aa, Homo Sapiens
KAGPGLKRW

SEQ ID NO: 133086 - protein, 9 aa, Homo Sapiens
KAGQTVTIW

SEQ ID NO: 133087 - protein, 9 aa, Homo Sapiens
KAGQVVTIW

SEQ ID NO: 133088 - protein, 9 aa, Homo Sapiens
KAGSSKYQW

SEQ ID NO: 133089 - protein, 9 aa, Homo Sapiens
KAIATTVTY

SEQ ID NO: 133090 - protein, 9 aa, Homo Sapiens
KAIEENNNF

SEQ ID NO: 133091 - protein, 9 aa, Homo Sapiens
KAIEKNVLF

SEQ ID NO: 133092 - protein, 9 aa, Homo Sapiens
KAIELLQEF

SEQ ID NO: 133093 - protein, 9 aa, Homo Sapiens
KAIETQPNF

SEQ ID NO: 133094 - protein, 9 aa, Homo Sapiens
KAIEYVHGY

SEQ ID NO: 133095 - protein, 9 aa, Homo Sapiens
KAIKELEEW

SEQ ID NO: 133096 - protein, 9 aa, Homo Sapiens
KAINFNFGY

SEQ ID NO: 133097 - protein, 9 aa, Homo Sapiens
KAINPINTF

SEQ ID NO: 133098 - protein, 9 aa, Homo Sapiens
KAISKNVLF

SEQ ID NO: 133099 - protein, 9 aa, Homo Sapiens
KAISPSEGW

SEQ ID NO: 133100 - protein, 9 aa, Homo Sapiens
KAITFVTQY

SEQ ID NO: 133101 - protein, 9 aa, Homo Sapiens
KAIWNVINW

SEQ ID NO: 133102 - protein, 9 aa, Homo Sapiens
KALDDKNCW

SEQ ID NO: 133103 - protein, 9 aa, Homo Sapiens
KALEYVFKF

SEQ ID NO: 133104 - protein, 9 aa, Homo Sapiens
KALKGQFNF

SEQ ID NO: 133105 - protein, 9 aa, Homo Sapiens
KALKMTIFW

SEQ ID NO: 133106 - protein, 9 aa, Homo Sapiens
KALPVNVKW

SEQ ID NO: 133107 - protein, 9 aa, Homo Sapiens
KALSMPEKW

SEQ ID NO: 133108 - protein, 9 aa, Homo Sapiens
KAMGIMNSF

SEQ ID NO: 133109 - protein, 9 aa, Homo Sapiens
KAMTGVEQW

SEQ ID NO: 133110 - protein, 9 aa, Homo Sapiens
KAMVFLEYF

SEQ ID NO: 133111 - protein, 9 aa, Homo Sapiens
KANDLDVRW

SEQ ID NO: 133112 - protein, 9 aa, Homo Sapiens
KANHAELIL

SEQ ID NO: 133113 - protein, 9 aa, Homo Sapiens
KANHFLILF

SEQ ID NO: 133114 - protein, 9 aa, Homo Sapiens
KANITCLVY

SEQ ID NO: 133115 - protein, 9 aa, Homo Sapiens
KANIVHLML

SEQ ID NO: 133116 - protein, 9 aa, Homo Sapiens
KANPALYVL

SEQ ID NO: 133117 - protein, 9 aa, Homo Sapiens
KANPTFHHW

SEQ ID NO: 133118 - protein, 9 aa, Homo Sapiens
KANSSVGKW

SEQ ID NO: 133119 - protein, 9 aa, Homo Sapiens
KANVVCVVY

SEQ ID NO: 133120 - protein, 9 aa, Homo Sapiens
KAQAQVSEW

SEQ ID NO: 133121 - protein, 9 aa, Homo Sapiens
KASDVLARF

SEQ ID NO: 133122 - protein, 9 aa, Homo Sapiens
KASNLLLGF

SEQ ID NO: 133123 - protein, 9 aa, Homo Sapiens
KASPTQNLF

SEQ ID NO: 133124 - protein, 9 aa, Homo Sapiens
KATDILPKW

SEQ ID NO: 133125 - protein, 9 aa, Homo Sapiens
KATNVCTRF

SEQ ID NO: 133126 - protein, 9 aa, Homo Sapiens
KATNVVMNY

SEQ ID NO: 133127 - protein, 9 aa, Homo Sapiens
KATPIKLIW

SEQ ID NO: 133128 - protein, 9 aa, Homo Sapiens
KATYFSEKW

SEQ ID NO: 133129 - protein, 9 aa, Homo Sapiens
KAVEAAHTF

SEQ ID NO: 133130 - protein, 9 aa, Homo Sapiens
KAVEEKIEW

SEQ ID NO: 133131 - protein, 9 aa, Homo Sapiens
KAVETVHNL

SEQ ID NO: 133132 - protein, 9 aa, Homo Sapiens
KAVEVHVLL

SEQ ID NO: 133133 - protein, 9 aa, Homo Sapiens
KAVFLVPKW

SEQ ID NO: 133134 - protein, 9 aa, Homo Sapiens
KAVQDLCGW

SEQ ID NO: 133135 - protein, 9 aa, Homo Sapiens
KAVSLFLCY

SEQ ID NO: 133136 - protein, 9 aa, Homo Sapiens
KAVTHQVKF

SEQ ID NO: 133137 - protein, 9 aa, Homo Sapiens
KAYSEAHEI

SEQ ID NO: 133138 - protein, 9 aa, Homo Sapiens
KFIEIDQAW

SEQ ID NO: 133139 - protein, 9 aa, Homo Sapiens
KFNETLMKF

SEQ ID NO: 133140 - protein, 9 aa, Homo Sapiens
KFNPVSFTW

SEQ ID NO: 133141 - protein, 9 aa, Homo Sapiens
KFVDILTNW

SEQ ID NO: 133142 - protein, 9 aa, Homo Sapiens
KGENINICW

SEQ ID NO: 133143 - protein, 9 aa, Homo Sapiens
KGGPPPPNW

SEQ ID NO: 133144 - protein, 9 aa, Homo Sapiens
KGIKVVGKW

SEQ ID NO: 133145 - protein, 9 aa, Homo Sapiens
KGLSTQAIW

SEQ ID NO: 133146 - protein, 9 aa, Homo Sapiens
KGSQLQERW

SEQ ID NO: 133147 - protein, 9 aa, Homo Sapiens
KGWRDVTTF

SEQ ID NO: 133148 - protein, 9 aa, Homo Sapiens
KICDIAINW

SEQ ID NO: 133149 - protein, 9 aa, Homo Sapiens
KIETVNESW

SEQ ID NO: 133150 - protein, 9 aa, Homo Sapiens
KIIDSKETW

SEQ ID NO: 133151 - protein, 9 aa, Homo Sapiens
KIIFIDSTW

SEQ ID NO: 133152 - protein, 9 aa, Homo Sapiens
KIIPKTLTW

SEQ ID NO: 133153 - protein, 9 aa, Homo Sapiens
KIIPLVVKF

SEQ ID NO: 133154 - protein, 9 aa, Homo Sapiens
KIISTLPSW

SEQ ID NO: 133155 - protein, 9 aa, Homo Sapiens
KILGKFYSW

SEQ ID NO: 133156 - protein, 9 aa, Homo Sapiens
KILPFSPEF

SEQ ID NO: 133157 - protein, 9 aa, Homo Sapiens
KILSEEPRW

SEQ ID NO: 133158 - protein, 9 aa, Homo Sapiens
KILSKVEKF

SEQ ID NO: 133159 - protein, 9 aa, Homo Sapiens
KILSNQEEW

SEQ ID NO: 133160 - protein, 9 aa, Homo Sapiens
KIMADNPSW

SEQ ID NO: 133161 - protein, 9 aa, Homo Sapiens
KINELELRL

SEQ ID NO: 133162 - protein, 9 aa, Homo Sapiens
KINKVDMQW

SEQ ID NO: 133163 - protein, 9 aa, Homo Sapiens
KINTESSLW

SEQ ID NO: 133164 - protein, 9 aa, Homo Sapiens
KISLISEKW

SEQ ID NO: 133165 - protein, 9 aa, Homo Sapiens
KISPKSDVW

SEQ ID NO: 133166 - protein, 9 aa, Homo Sapiens
KISVCQQTW

SEQ ID NO: 133167 - protein, 9 aa, Homo Sapiens
KITDVIIGF

SEQ ID NO: 133168 - protein, 9 aa, Homo Sapiens
KIVLEKVCW

SEQ ID NO: 133169 - protein, 9 aa, Homo Sapiens
KLEDRQTSW

SEQ ID NO: 133170 - protein, 9 aa, Homo Sapiens
KLFYDVITW

SEQ ID NO: 133171 - protein, 9 aa, Homo Sapiens
KLSSALQKW

SEQ ID NO: 133172 - protein, 9 aa, Homo Sapiens
KLTNIVEKF

SEQ ID NO: 133173 - protein, 9 aa, Homo Sapiens
KMCSMVKKW

SEQ ID NO: 133174 - protein, 9 aa, Homo Sapiens
KMFIGGLSW

SEQ ID NO: 133175 - protein, 9 aa, Homo Sapiens
KMGPMEKFW

SEQ ID NO: 133176 - protein, 9 aa, Homo Sapiens
KMLDESFQW

SEQ ID NO: 133177 - protein, 9 aa, Homo Sapiens
KMNNVNVVY

SEQ ID NO: 133178 - protein, 9 aa, Homo Sapiens
KMNPQSAFF

SEQ ID NO: 133179 - protein, 9 aa, Homo Sapiens
KMTILQTYF

SEQ ID NO: 133180 - protein, 9 aa, Homo Sapiens
KQCGKTFTW

SEQ ID NO: 133181 - protein, 9 aa, Homo Sapiens
KSADWVSDW

SEQ ID NO: 133182 - protein, 9 aa, Homo Sapiens
KSAFVRTQW

SEQ ID NO: 133183 - protein, 9 aa, Homo Sapiens
KSALVFITF

SEQ ID NO: 133184 - protein, 9 aa, Homo Sapiens
KSANVSSIW

SEQ ID NO: 133185 - protein, 9 aa, Homo Sapiens
KSAQDVQKF

SEQ ID NO: 133186 - protein, 9 aa, Homo Sapiens
KSAQPADGW

SEQ ID NO: 133187 - protein, 9 aa, Homo Sapiens
KSAQPIEKF

SEQ ID NO: 133188 - protein, 9 aa, Homo Sapiens
KSCEKIHFI

SEQ ID NO: 133189 - protein, 9 aa, Homo Sapiens
KSCGLNPKL

SEQ ID NO: 133190 - protein, 9 aa, Homo Sapiens
KSCMNQVTI

SEQ ID NO: 133191 - protein, 9 aa, Homo Sapiens
KSCPERHYW

SEQ ID NO: 133192 - protein, 9 aa, Homo Sapiens
KSCQSFISW

SEQ ID NO: 133193 - protein, 9 aa, Homo Sapiens
KSDDFGQTW

SEQ ID NO: 133194 - protein, 9 aa, Homo Sapiens
KSDGKILVW

SEQ ID NO: 133195 - protein, 9 aa, Homo Sapiens
KSFADINLY

SEQ ID NO: 133196 - protein, 9 aa, Homo Sapiens
KSFDFHFGF

SEQ ID NO: 133197 - protein, 9 aa, Homo Sapiens
KSFDNIKNW

SEQ ID NO: 133198 - protein, 9 aa, Homo Sapiens
KSFDNIRNW

SEQ ID NO: 133199 - protein, 9 aa, Homo Sapiens
KSFEDIHHY

SEQ ID NO: 133200 - protein, 9 aa, Homo Sapiens
KSFEGLFYF

SEQ ID NO: 133201 - protein, 9 aa, Homo Sapiens
KSFENISKW

SEQ ID NO: 133202 - protein, 9 aa, Homo Sapiens
KSFGGSHVM

SEQ ID NO: 133203 - protein, 9 aa, Homo Sapiens
KSFGLFSKW

SEQ ID NO: 133204 - protein, 9 aa, Homo Sapiens
KSFMDFGSW

SEQ ID NO: 133205 - protein, 9 aa, Homo Sapiens
KSFNRHLHF

SEQ ID NO: 133206 - protein, 9 aa, Homo Sapiens
KSFNSVHLL

SEQ ID NO: 133207 - protein, 9 aa, Homo Sapiens
KSFPSIFKF

SEQ ID NO: 133208 - protein, 9 aa, Homo Sapiens
KSFQAIHQF

SEQ ID NO: 133209 - protein, 9 aa, Homo Sapiens
KSFVKVYNY

SEQ ID NO: 133210 - protein, 9 aa, Homo Sapiens
KSGAIIEKW

SEQ ID NO: 133211 - protein, 9 aa, Homo Sapiens
KSGELLATW

SEQ ID NO: 133212 - protein, 9 aa, Homo Sapiens
KSGSPVATF

SEQ ID NO: 133213 - protein, 9 aa, Homo Sapiens
KSHVECARF

SEQ ID NO: 133214 - protein, 9 aa, Homo Sapiens
KSIDDTSNF

SEQ ID NO: 133215 - protein, 9 aa, Homo Sapiens
KSIDLIQKW

SEQ ID NO: 133216 - protein, 9 aa, Homo Sapiens
KSIEEIVSF

SEQ ID NO: 133217 - protein, 9 aa, Homo Sapiens
KSIEELQDW

SEQ ID NO: 133218 - protein, 9 aa, Homo Sapiens
KSIEERVTI

SEQ ID NO: 133219 - protein, 9 aa, Homo Sapiens
KSIELFYKF

SEQ ID NO: 133220 - protein, 9 aa, Homo Sapiens
KSIEPVSSW

SEQ ID NO: 133221 - protein, 9 aa, Homo Sapiens
KSIHIVVTM

SEQ ID NO: 133222 - protein, 9 aa, Homo Sapiens
KSIKNIQKI

SEQ ID NO: 133223 - protein, 9 aa, Homo Sapiens
KSINDYNTW

SEQ ID NO: 133224 - protein, 9 aa, Homo Sapiens
KSIPLVESW

SEQ ID NO: 133225 - protein, 9 aa, Homo Sapiens
KSIPVTQEL

SEQ ID NO: 133226 - protein, 9 aa, Homo Sapiens
KSIVQVETL

SEQ ID NO: 133227 - protein, 9 aa, Homo Sapiens
KSIYPTLEI

SEQ ID NO: 133228 - protein, 9 aa, Homo Sapiens
KSKPFCEKL

SEQ ID NO: 133229 - protein, 9 aa, Homo Sapiens
KSLALLLNY

SEQ ID NO: 133230 - protein, 9 aa, Homo Sapiens
KSLAVKEFF

SEQ ID NO: 133231 - protein, 9 aa, Homo Sapiens
KSLDTTDNW

SEQ ID NO: 133232 - protein, 9 aa, Homo Sapiens
KSLDTTLQF

SEQ ID NO: 133233 - protein, 9 aa, Homo Sapiens
KSLEAFFLY

SEQ ID NO: 133234 - protein, 9 aa, Homo Sapiens
KSLEEAQEW

SEQ ID NO: 133235 - protein, 9 aa, Homo Sapiens
KSLEEIYLF

SEQ ID NO: 133236 - protein, 9 aa, Homo Sapiens
KSLELHEEF

SEQ ID NO: 133237 - protein, 9 aa, Homo Sapiens
KSLENAIEW

SEQ ID NO: 133238 - protein, 9 aa, Homo Sapiens
KSLENQTYF

SEQ ID NO: 133239 - protein, 9 aa, Homo Sapiens
KSLGVHYVF

SEQ ID NO: 133240 - protein, 9 aa, Homo Sapiens
KSLGVTTKF

SEQ ID NO: 133241 - protein, 9 aa, Homo Sapiens
KSLIEKNSW

SEQ ID NO: 133242 - protein, 9 aa, Homo Sapiens
KSLLKIFAW

SEQ ID NO: 133243 - protein, 9 aa, Homo Sapiens
KSLLVVHFW

SEQ ID NO: 133244 - protein, 9 aa, Homo Sapiens
KSLLWTETF

SEQ ID NO: 133245 - protein, 9 aa, Homo Sapiens
KSLPDTELM

SEQ ID NO: 133246 - protein, 9 aa, Homo Sapiens
KSLWKHHEY

SEQ ID NO: 133247 - protein, 9 aa, Homo Sapiens
KSLYHSVEW

SEQ ID NO: 133248 - protein, 9 aa, Homo Sapiens
KSMPTVTQI

SEQ ID NO: 133249 - protein, 9 aa, Homo Sapiens
KSNELFTTF

SEQ ID NO: 133250 - protein, 9 aa, Homo Sapiens
KSNKLLYTF

SEQ ID NO: 133251 - protein, 9 aa, Homo Sapiens
KSNNVEMDW

SEQ ID NO: 133252 - protein, 9 aa, Homo Sapiens
KSNPKPLVL

SEQ ID NO: 133253 - protein, 9 aa, Homo Sapiens
KSNTWSPKY

SEQ ID NO: 133254 - protein, 9 aa, Homo Sapiens
KSQDILLKW

SEQ ID NO: 133255 - protein, 9 aa, Homo Sapiens
KSQDLELSW

SEQ ID NO: 133256 - protein, 9 aa, Homo Sapiens
KSQIFQIFY

SEQ ID NO: 133257 - protein, 9 aa, Homo Sapiens
KSQPLVHLM

SEQ ID NO: 133258 - protein, 9 aa, Homo Sapiens
KSRPEVITF

SEQ ID NO: 133259 - protein, 9 aa, Homo Sapiens
KSSAISLHY

SEQ ID NO: 133260 - protein, 9 aa, Homo Sapiens
KSSATRLLY

SEQ ID NO: 133261 - protein, 9 aa, Homo Sapiens
KSSAVQQLL

SEQ ID NO: 133262 - protein, 9 aa, Homo Sapiens
KSSDIAKTF

SEQ ID NO: 133263 - protein, 9 aa, Homo Sapiens
KSSDKQLRI

SEQ ID NO: 133264 - protein, 9 aa, Homo Sapiens
KSSDPEMRW

SEQ ID NO: 133265 - protein, 9 aa, Homo Sapiens
KSSDVYVSY

SEQ ID NO: 133266 - protein, 9 aa, Homo Sapiens
KSSEVFTTF

SEQ ID NO: 133267 - protein, 9 aa, Homo Sapiens
KSSIGLNTW

SEQ ID NO: 133268 - protein, 9 aa, Homo Sapiens
KSSKIMESF

SEQ ID NO: 133269 - protein, 9 aa, Homo Sapiens
KSSLTQHSW

SEQ ID NO: 133270 - protein, 9 aa, Homo Sapiens
KSSQVQRRF

SEQ ID NO: 133271 - protein, 9 aa, Homo Sapiens
KSSSSYHTW

SEQ ID NO: 133272 - protein, 9 aa, Homo Sapiens
KSSTVLHTF

SEQ ID NO: 133273 - protein, 9 aa, Homo Sapiens
KSSVEVYAW

SEQ ID NO: 133274 - protein, 9 aa, Homo Sapiens
KSSVTVYRW

SEQ ID NO: 133275 - protein, 9 aa, Homo Sapiens
KSTAISLFY

SEQ ID NO: 133276 - protein, 9 aa, Homo Sapiens
KSTCVLEAF

SEQ ID NO: 133277 - protein, 9 aa, Homo Sapiens
KSTDVAKTF

SEQ ID NO: 133278 - protein, 9 aa, Homo Sapiens
KSTLINTLF

SEQ ID NO: 133279 - protein, 9 aa, Homo Sapiens
KSTPVTVVL

SEQ ID NO: 133280 - protein, 9 aa, Homo Sapiens
KSTQFEYAW

SEQ ID NO: 133281 - protein, 9 aa, Homo Sapiens
KSTTESYVF

SEQ ID NO: 133282 - protein, 9 aa, Homo Sapiens
KSTTTGHLI

SEQ ID NO: 133283 - protein, 9 aa, Homo Sapiens
KSTVNGVSW

SEQ ID NO: 133284 - protein, 9 aa, Homo Sapiens
KSVDVTEKL

SEQ ID NO: 133285 - protein, 9 aa, Homo Sapiens
KSVDWLLVF

SEQ ID NO: 133286 - protein, 9 aa, Homo Sapiens
KSVEEISTL

SEQ ID NO: 133287 - protein, 9 aa, Homo Sapiens
KSVEQYYGW

SEQ ID NO: 133288 - protein, 9 aa, Homo Sapiens
KSVGVFEAF

SEQ ID NO: 133289 - protein, 9 aa, Homo Sapiens
KSVKEISSY

SEQ ID NO: 133290 - protein, 9 aa, Homo Sapiens
KSVKEVLHF

SEQ ID NO: 133291 - protein, 9 aa, Homo Sapiens
KSVKVFAEY

SEQ ID NO: 133292 - protein, 9 aa, Homo Sapiens
KSVKVSENF

SEQ ID NO: 133293 - protein, 9 aa, Homo Sapiens
KSVKYTVNF

SEQ ID NO: 133294 - protein, 9 aa, Homo Sapiens
KSVLTNYRF

SEQ ID NO: 133295 - protein, 9 aa, Homo Sapiens
KSVLVKQTI

SEQ ID NO: 133296 - protein, 9 aa, Homo Sapiens
KSVRLDVTL

SEQ ID NO: 133297 - protein, 9 aa, Homo Sapiens
KSVRPGASY

SEQ ID NO: 133298 - protein, 9 aa, Homo Sapiens
KSVSFSDVF

SEQ ID NO: 133299 - protein, 9 aa, Homo Sapiens
KSVTAFFKW

SEQ ID NO: 133300 - protein, 9 aa, Homo Sapiens
KSVTAFFTW

SEQ ID NO: 133301 - protein, 9 aa, Homo Sapiens
KSVTEVDTL

SEQ ID NO: 133302 - protein, 9 aa, Homo Sapiens
KSVTLGYLF

SEQ ID NO: 133303 - protein, 9 aa, Homo Sapiens
KSVTQQIHF

SEQ ID NO: 133304 - protein, 9 aa, Homo Sapiens
KSWADVVKL

SEQ ID NO: 133305 - protein, 9 aa, Homo Sapiens
KSWVFGVHF

SEQ ID NO: 133306 - protein, 9 aa, Homo Sapiens
KSYPETHII

SEQ ID NO: 133307 - protein, 9 aa, Homo Sapiens
KSYSKAFTL

SEQ ID NO: 133308 - protein, 9 aa, Homo Sapiens
KSYVQGVTW

SEQ ID NO: 133309 - protein, 9 aa, Homo Sapiens
KTAAEQFKF

SEQ ID NO: 133310 - protein, 9 aa, Homo Sapiens
KTADVTKVW

SEQ ID NO: 133311 - protein, 9 aa, Homo Sapiens
KTAEAQLAY

SEQ ID NO: 133312 - protein, 9 aa, Homo Sapiens
KTAEDMNLF

SEQ ID NO: 133313 - protein, 9 aa, Homo Sapiens
KTAEELMNF

SEQ ID NO: 133314 - protein, 9 aa, Homo Sapiens
KTAPFDSRF

SEQ ID NO: 133315 - protein, 9 aa, Homo Sapiens
KTCKFVSSF

SEQ ID NO: 133316 - protein, 9 aa, Homo Sapiens
KTCSMKVHW

SEQ ID NO: 133317 - protein, 9 aa, Homo Sapiens
KTDKTLVLL

SEQ ID NO: 133318 - protein, 9 aa, Homo Sapiens
KTDVTVVRF

SEQ ID NO: 133319 - protein, 9 aa, Homo Sapiens
KTETEPVFW

SEQ ID NO: 133320 - protein, 9 aa, Homo Sapiens
KTFEEIWKF

SEQ ID NO: 133321 - protein, 9 aa, Homo Sapiens
KTFPFHFMF

SEQ ID NO: 133322 - protein, 9 aa, Homo Sapiens
KTFPSIHLW

SEQ ID NO: 133323 - protein, 9 aa, Homo Sapiens
KTFPYQHRY

SEQ ID NO: 133324 - protein, 9 aa, Homo Sapiens
KTFRDKNTL

SEQ ID NO: 133325 - protein, 9 aa, Homo Sapiens
KTFTGHREW

SEQ ID NO: 133326 - protein, 9 aa, Homo Sapiens
KTFTTQETI

SEQ ID NO: 133327 - protein, 9 aa, Homo Sapiens
KTFVQKQTL

SEQ ID NO: 133328 - protein, 9 aa, Homo Sapiens
KTGETMIQW

SEQ ID NO: 133329 - protein, 9 aa, Homo Sapiens
KTGLVSSTW

SEQ ID NO: 133330 - protein, 9 aa, Homo Sapiens
KTGPFVVHW

SEQ ID NO: 133331 - protein, 9 aa, Homo Sapiens
KTIDAMDTW

SEQ ID NO: 133332 - protein, 9 aa, Homo Sapiens
KTIEDFQQK

SEQ ID NO: 133333 - protein, 9 aa, Homo Sapiens
KTIEDVREF

SEQ ID NO: 133334 - protein, 9 aa, Homo Sapiens
KTIETSPSL

SEQ ID NO: 133335 - protein, 9 aa, Homo Sapiens
KTIGLREVW

SEQ ID NO: 133336 - protein, 9 aa, Homo Sapiens
KTIIITCSF

SEQ ID NO: 133337 - protein, 9 aa, Homo Sapiens
KTIKLWNTL

SEQ ID NO: 133338 - protein, 9 aa, Homo Sapiens
KTILPLINF

SEQ ID NO: 133339 - protein, 9 aa, Homo Sapiens
KTITQIEEF

SEQ ID NO: 133340 - protein, 9 aa, Homo Sapiens
KTIVMGASF

SEQ ID NO: 133341 - protein, 9 aa, Homo Sapiens
KTKEVIQEW

SEQ ID NO: 133342 - protein, 9 aa, Homo Sapiens
KTLDVDATY

SEQ ID NO: 133343 - protein, 9 aa, Homo Sapiens
KTLEEHSHW

SEQ ID NO: 133344 - protein, 9 aa, Homo Sapiens
KTLERSYLL

SEQ ID NO: 133345 - protein, 9 aa, Homo Sapiens
KTLESQNLF

SEQ ID NO: 133346 - protein, 9 aa, Homo Sapiens
KTLPDILTF

SEQ ID NO: 133347 - protein, 9 aa, Homo Sapiens
KTLYFHIYY

SEQ ID NO: 133348 - protein, 9 aa, Homo Sapiens
KTLYHITLW

SEQ ID NO: 133349 - protein, 9 aa, Homo Sapiens
KTMKQQLQF

SEQ ID NO: 133350 - protein, 9 aa, Homo Sapiens
KTMTDTYLL

SEQ ID NO: 133351 - protein, 9 aa, Homo Sapiens
KTNAIPLTL

SEQ ID NO: 133352 - protein, 9 aa, Homo Sapiens
KTNEMLLNF

SEQ ID NO: 133353 - protein, 9 aa, Homo Sapiens
KTNQVKMKY

SEQ ID NO: 133354 - protein, 9 aa, Homo Sapiens
KTNSLPLRF

SEQ ID NO: 133355 - protein, 9 aa, Homo Sapiens
KTQGPRALW

SEQ ID NO: 133356 - protein, 9 aa, Homo Sapiens
KTQILNEEW

SEQ ID NO: 133357 - protein, 9 aa, Homo Sapiens
KTRWIIEKY

SEQ ID NO: 133358 - protein, 9 aa, Homo Sapiens
KTSDRCLAW

SEQ ID NO: 133359 - protein, 9 aa, Homo Sapiens
KTSGIINKF

SEQ ID NO: 133360 - protein, 9 aa, Homo Sapiens
KTSKIELKF

SEQ ID NO: 133361 - protein, 9 aa, Homo Sapiens
KTSQTVATF

SEQ ID NO: 133362 - protein, 9 aa, Homo Sapiens
KTSRTFFYW

SEQ ID NO: 133363 - protein, 9 aa, Homo Sapiens
KTSVVVGTW

SEQ ID NO: 133364 - protein, 9 aa, Homo Sapiens
KTTECSNTF

SEQ ID NO: 133365 - protein, 9 aa, Homo Sapiens
KTTESHMDW

SEQ ID NO: 133366 - protein, 9 aa, Homo Sapiens
KTTNTVSKF

SEQ ID NO: 133367 - protein, 9 aa, Homo Sapiens
KTVAIHTLW

SEQ ID NO: 133368 - protein, 9 aa, Homo Sapiens
KTVDKFNEW

SEQ ID NO: 133369 - protein, 9 aa, Homo Sapiens
KTVEDYFCF

SEQ ID NO: 133370 - protein, 9 aa, Homo Sapiens
KTVEPLEYY

SEQ ID NO: 133371 - protein, 9 aa, Homo Sapiens
KTVQCKVTL

SEQ ID NO: 133372 - protein, 9 aa, Homo Sapiens
KTVSCFVNF

SEQ ID NO: 133373 - protein, 9 aa, Homo Sapiens
KTVVKELTW

SEQ ID NO: 133374 - protein, 9 aa, Homo Sapiens
KTVVNKDVF

SEQ ID NO: 133375 - protein, 9 aa, Homo Sapiens
KTYHYVPEF

SEQ ID NO: 133376 - protein, 9 aa, Homo Sapiens
KTYSLLHQW

SEQ ID NO: 133377 - protein, 9 aa, Homo Sapiens
KVADPVVTF

SEQ ID NO: 133378 - protein, 9 aa, Homo Sapiens
KVASALEKW

SEQ ID NO: 133379 - protein, 9 aa, Homo Sapiens
KVCDKAFAW

SEQ ID NO: 133380 - protein, 9 aa, Homo Sapiens
KVCDKAFVW

SEQ ID NO: 133381 - protein, 9 aa, Homo Sapiens
KVCGKAFKW

SEQ ID NO: 133382 - protein, 9 aa, Homo Sapiens
KVDDYSQEW

SEQ ID NO: 133383 - protein, 9 aa, Homo Sapiens
KVDIIISEW

SEQ ID NO: 133384 - protein, 9 aa, Homo Sapiens
KVFLIYEGY

SEQ ID NO: 133385 - protein, 9 aa, Homo Sapiens
KVGKFYELY

SEQ ID NO: 133386 - protein, 9 aa, Homo Sapiens
KVIEINPYL

SEQ ID NO: 133387 - protein, 9 aa, Homo Sapiens
KVIGAGKSW

SEQ ID NO: 133388 - protein, 9 aa, Homo Sapiens
KVINAAHSF

SEQ ID NO: 133389 - protein, 9 aa, Homo Sapiens
KVINETWAW

SEQ ID NO: 133390 - protein, 9 aa, Homo Sapiens
KVIPVVNSF

SEQ ID NO: 133391 - protein, 9 aa, Homo Sapiens
KVITCEIAW

SEQ ID NO: 133392 - protein, 9 aa, Homo Sapiens
KVLELFESF

SEQ ID NO: 133393 - protein, 9 aa, Homo Sapiens
KVLPIIQRW

SEQ ID NO: 133394 - protein, 9 aa, Homo Sapiens
KVMPFANLM

SEQ ID NO: 133395 - protein, 9 aa, Homo Sapiens
KVMPQNHSF

SEQ ID NO: 133396 - protein, 9 aa, Homo Sapiens
KVNGKGSLW

SEQ ID NO: 133397 - protein, 9 aa, Homo Sapiens
KVNKIEIHY

SEQ ID NO: 133398 - protein, 9 aa, Homo Sapiens
KVNKYGDTW

SEQ ID NO: 133399 - protein, 9 aa, Homo Sapiens
KVNVAKLRY

SEQ ID NO: 133400 - protein, 9 aa, Homo Sapiens
KVQDITMQW

SEQ ID NO: 133401 - protein, 9 aa, Homo Sapiens
KVRAELERW

SEQ ID NO: 133402 - protein, 9 aa, Homo Sapiens
KVSGVCKRW

SEQ ID NO: 133403 - protein, 9 aa, Homo Sapiens
KVSSINSRF

SEQ ID NO: 133404 - protein, 9 aa, Homo Sapiens
KVSTSRQTW

SEQ ID NO: 133405 - protein, 9 aa, Homo Sapiens
KVSVYLQNW

SEQ ID NO: 133406 - protein, 9 aa, Homo Sapiens
KVTIICIRF

SEQ ID NO: 133407 - protein, 9 aa, Homo Sapiens
KVTRIVLLW

SEQ ID NO: 133408 - protein, 9 aa, Homo Sapiens
KVVGKDYLL

SEQ ID NO: 133409 - protein, 9 aa, Homo Sapiens
KVVKFSYMW

SEQ ID NO: 133410 - protein, 9 aa, Homo Sapiens
KVVKVYQEW

SEQ ID NO: 133411 - protein, 9 aa, Homo Sapiens
KVVNIVPVI

SEQ ID NO: 133412 - protein, 9 aa, Homo Sapiens
KVWGEVGRW

SEQ ID NO: 133413 - protein, 9 aa, Homo Sapiens
KVWYNVENW

SEQ ID NO: 133414 - protein, 9 aa, Homo Sapiens
KVYFIYEGY

SEQ ID NO: 133415 - protein, 9 aa, Homo Sapiens
KVYMFKCVW

SEQ ID NO: 133416 - protein, 9 aa, Homo Sapiens
LAASVISKW

SEQ ID NO: 133417 - protein, 9 aa, Homo Sapiens
LADKVNSSW

SEQ ID NO: 133418 - protein, 9 aa, Homo Sapiens
LADPWRQEW

SEQ ID NO: 133419 - protein, 9 aa, Homo Sapiens
LAGPAATSW

SEQ ID NO: 133420 - protein, 9 aa, Homo Sapiens
LAHGADVNW

SEQ ID NO: 133421 - protein, 9 aa, Homo Sapiens
LALQLAHCW

SEQ ID NO: 133422 - protein, 9 aa, Homo Sapiens
LALVKPEVW

SEQ ID NO: 133423 - protein, 9 aa, Homo Sapiens
LANDVAEQW

SEQ ID NO: 133424 - protein, 9 aa, Homo Sapiens
LANKLYERW

SEQ ID NO: 133425 - protein, 9 aa, Homo Sapiens
LANKTPHTW

SEQ ID NO: 133426 - protein, 9 aa, Homo Sapiens
LANRFQLQL

SEQ ID NO: 133427 - protein, 9 aa, Homo Sapiens
LAQRVLLTW

SEQ ID NO: 133428 - protein, 9 aa, Homo Sapiens
LASKELAAW

SEQ ID NO: 133429 - protein, 9 aa, Homo Sapiens
LATKIQAAW

SEQ ID NO: 133430 - protein, 9 aa, Homo Sapiens
LATTILQHW

SEQ ID NO: 133431 - protein, 9 aa, Homo Sapiens
LAVPEEHVW

SEQ ID NO: 133432 - protein, 9 aa, Homo Sapiens
LAVPFCVNF

SEQ ID NO: 133433 - protein, 9 aa, Homo Sapiens
LAWSGVMEW

SEQ ID NO: 133434 - protein, 9 aa, Homo Sapiens
LDTNADKQL

SEQ ID NO: 133435 - protein, 9 aa, Homo Sapiens
LGGPGSFYW

SEQ ID NO: 133436 - protein, 9 aa, Homo Sapiens
LGNSLLLKY

SEQ ID NO: 133437 - protein, 9 aa, Homo Sapiens
LIVTTPEKW

SEQ ID NO: 133438 - protein, 9 aa, Homo Sapiens
LLNPVIYTW

SEQ ID NO: 133439 - protein, 9 aa, Homo Sapiens
LLSPVSVEW

SEQ ID NO: 133440 - protein, 9 aa, Homo Sapiens
LPINGNGKQ

SEQ ID NO: 133441 - protein, 9 aa, Homo Sapiens
LQVSAKIGF

SEQ ID NO: 133442 - protein, 9 aa, Homo Sapiens
LSAAEVMQW

SEQ ID NO: 133443 - protein, 9 aa, Homo Sapiens
LSALESTKW

SEQ ID NO: 133444 - protein, 9 aa, Homo Sapiens
LSAPIHTQM

SEQ ID NO: 133445 - protein, 9 aa, Homo Sapiens
LSAPIMSRF

SEQ ID NO: 133446 - protein, 9 aa, Homo Sapiens
LSAPNLNSW

SEQ ID NO: 133447 - protein, 9 aa, Homo Sapiens
LSDETKNNW

SEQ ID NO: 133448 - protein, 9 aa, Homo Sapiens
LSDQHPLTW

SEQ ID NO: 133449 - protein, 9 aa, Homo Sapiens
LSDSPGPTW

SEQ ID NO: 133450 - protein, 9 aa, Homo Sapiens
LSDSQLKVW

SEQ ID NO: 133451 - protein, 9 aa, Homo Sapiens
LSEAVHWTW

SEQ ID NO: 133452 - protein, 9 aa, Homo Sapiens
LSFHQGCTI

SEQ ID NO: 133453 - protein, 9 aa, Homo Sapiens
LSFLGGIRW

SEQ ID NO: 133454 - protein, 9 aa, Homo Sapiens
LSGATVTLW

SEQ ID NO: 133455 - protein, 9 aa, Homo Sapiens
LSGPFVQKW

SEQ ID NO: 133456 - protein, 9 aa, Homo Sapiens
LSGRSTPKL

SEQ ID NO: 133457 - protein, 9 aa, Homo Sapiens
LSHKGNEFW

SEQ ID NO: 133458 - protein, 9 aa, Homo Sapiens
LSIHLQHKF

SEQ ID NO: 133459 - protein, 9 aa, Homo Sapiens
LSIITKDLF

SEQ ID NO: 133460 - protein, 9 aa, Homo Sapiens
LSIVDRTTI

SEQ ID NO: 133461 - protein, 9 aa, Homo Sapiens
LSNKISPLM

SEQ ID NO: 133462 - protein, 9 aa, Homo Sapiens
LSNLESTHW

SEQ ID NO: 133463 - protein, 9 aa, Homo Sapiens
LSNTVMPRF

SEQ ID NO: 133464 - protein, 9 aa, Homo Sapiens
LSNVQRLTF

SEQ ID NO: 133465 - protein, 9 aa, Homo Sapiens
LSQKLQMIL

SEQ ID NO: 133466 - protein, 9 aa, Homo Sapiens
LSQPKIVKW

SEQ ID NO: 133467 - protein, 9 aa, Homo Sapiens
LSSEVTKNW

SEQ ID NO: 133468 - protein, 9 aa, Homo Sapiens
LSSPEPLSW

SEQ ID NO: 133469 - protein, 9 aa, Homo Sapiens
LSSTEILKW

SEQ ID NO: 133470 - protein, 9 aa, Homo Sapiens
LSSTVTLEH

SEQ ID NO: 133471 - protein, 9 aa, Homo Sapiens
LSSVTQLHL

SEQ ID NO: 133472 - protein, 9 aa, Homo Sapiens
LSTIISPLF

SEQ ID NO: 133473 - protein, 9 aa, Homo Sapiens
LSTIKQLLW

SEQ ID NO: 133474 - protein, 9 aa, Homo Sapiens
LSTLHTVLW

SEQ ID NO: 133475 - protein, 9 aa, Homo Sapiens
LSTLVRPVF

SEQ ID NO: 133476 - protein, 9 aa, Homo Sapiens
LSTTIQEEF

SEQ ID NO: 133477 - protein, 9 aa, Homo Sapiens
LSTTVQPNL

SEQ ID NO: 133478 - protein, 9 aa, Homo Sapiens
LSVFSTSKW

SEQ ID NO: 133479 - protein, 9 aa, Homo Sapiens
LSVPSPFTW

SEQ ID NO: 133480 - protein, 9 aa, Homo Sapiens
LTFPVAMFW

SEQ ID NO: 133481 - protein, 9 aa, Homo Sapiens
LTIDHVPIW

SEQ ID NO: 133482 - protein, 9 aa, Homo Sapiens
LTLQQTQRW

SEQ ID NO: 133483 - protein, 9 aa, Homo Sapiens
LTMTRNAVW

SEQ ID NO: 133484 - protein, 9 aa, Homo Sapiens
LTNTIHCRL

SEQ ID NO: 133485 - protein, 9 aa, Homo Sapiens
LTPVVVTLW

SEQ ID NO: 133486 - protein, 9 aa, Homo Sapiens
LTSPDSEKW

SEQ ID NO: 133487 - protein, 9 aa, Homo Sapiens
LTSPIEASW

SEQ ID NO: 133488 - protein, 9 aa, Homo Sapiens
LTSTLQQDW

SEQ ID NO: 133489 - protein, 9 aa, Homo Sapiens
LTSVVQTLL

SEQ ID NO: 133490 - protein, 9 aa, Homo Sapiens
LTTEVHPEL

SEQ ID NO: 133491 - protein, 9 aa, Homo Sapiens
LTYENVERW

SEQ ID NO: 133492 - protein, 9 aa, Homo Sapiens
LVHAVQALW

SEQ ID NO: 133493 - protein, 9 aa, Homo Sapiens
LVNNTPLNW

SEQ ID NO: 133494 - protein, 9 aa, Homo Sapiens
LVSDLQQVW

SEQ ID NO: 133495 - protein, 9 aa, Homo Sapiens
LVWQVQEKW

SEQ ID NO: 133496 - protein, 9 aa, Homo Sapiens
MAAKILEEF

SEQ ID NO: 133497 - protein, 9 aa, Homo Sapiens
MAIEAQQKF

SEQ ID NO: 133498 - protein, 9 aa, Homo Sapiens
MAIVGTHKF

SEQ ID NO: 133499 - protein, 9 aa, Homo Sapiens
MANPTALLL

SEQ ID NO: 133500 - protein, 9 aa, Homo Sapiens
MGNPFLTQW

SEQ ID NO: 133501 - protein, 9 aa, Homo Sapiens
MMFAVHCTW

SEQ ID NO: 133502 - protein, 9 aa, Homo Sapiens
MSERQLALW

SEQ ID NO: 133503 - protein, 9 aa, Homo Sapiens
MSERQVALW

SEQ ID NO: 133504 - protein, 9 aa, Homo Sapiens
MSLPLTARW

SEQ ID NO: 133505 - protein, 9 aa, Homo Sapiens
MSLPYRLVF

SEQ ID NO: 133506 - protein, 9 aa, Homo Sapiens
MSNKHGWTW

SEQ ID NO: 133507 - protein, 9 aa, Homo Sapiens
MSTEHRGPV

SEQ ID NO: 133508 - protein, 9 aa, Homo Sapiens
MSVHLSPCF

SEQ ID NO: 133509 - protein, 9 aa, Homo Sapiens
MTDPKLITW

SEQ ID NO: 133510 - protein, 9 aa, Homo Sapiens
MTLKDIYTW

SEQ ID NO: 133511 - protein, 9 aa, Homo Sapiens
MTNGFHMTW

SEQ ID NO: 133512 - protein, 9 aa, Homo Sapiens
MTNPHNHLY

SEQ ID NO: 133513 - protein, 9 aa, Homo Sapiens
MTVKEQQEW

SEQ ID NO: 133514 - protein, 9 aa, Homo Sapiens
MTWSHNDMW

SEQ ID NO: 133515 - protein, 9 aa, Homo Sapiens
MVLDIVQHW

SEQ ID NO: 133516 - protein, 9 aa, Homo Sapiens
NSLVDKTSW

SEQ ID NO: 133517 - protein, 9 aa, Homo Sapiens
NSSAFQHFW

SEQ ID NO: 133518 - protein, 9 aa, Homo Sapiens
NSSAVLLQW

SEQ ID NO: 133519 - protein, 9 aa, Homo Sapiens
NTAVVPQGW

SEQ ID NO: 133520 - protein, 9 aa, Homo Sapiens
NTTAIAEAW

SEQ ID NO: 133521 - protein, 9 aa, Homo Sapiens
NTTAVAEAW

SEQ ID NO: 133522 - protein, 9 aa, Homo Sapiens
PSSSPTHLW

SEQ ID NO: 133523 - protein, 9 aa, Homo Sapiens
QAFPNTNRW

SEQ ID NO: 133524 - protein, 9 aa, Homo Sapiens
QAIKLLVRW

SEQ ID NO: 133525 - protein, 9 aa, Homo Sapiens
QALISQHLW

SEQ ID NO: 133526 - protein, 9 aa, Homo Sapiens
QATRTVPVF

SEQ ID NO: 133527 - protein, 9 aa, Homo Sapiens
QAVPCSVTW

SEQ ID NO: 133528 - protein, 9 aa, Homo Sapiens
QINAKVAEW

SEQ ID NO: 133529 - protein, 9 aa, Homo Sapiens
QITAGRHGD

SEQ ID NO: 133530 - protein, 9 aa, Homo Sapiens
QMVKKNFEW

SEQ ID NO: 133531 - protein, 9 aa, Homo Sapiens
QSAKEQIKW

SEQ ID NO: 133532 - protein, 9 aa, Homo Sapiens
QSAKTQIKL

SEQ ID NO: 133533 - protein, 9 aa, Homo Sapiens
QSFKPETYW

SEQ ID NO: 133534 - protein, 9 aa, Homo Sapiens
QSGIVQLLW

SEQ ID NO: 133535 - protein, 9 aa, Homo Sapiens
QSLKSTAKW

SEQ ID NO: 133536 - protein, 9 aa, Homo Sapiens
QSSHLNVHW

SEQ ID NO: 133537 - protein, 9 aa, Homo Sapiens
QSSPPTVEW

SEQ ID NO: 133538 - protein, 9 aa, Homo Sapiens
QSSWSHFGW

SEQ ID NO: 133539 - protein, 9 aa, Homo Sapiens
QSVEPLTGW

SEQ ID NO: 133540 - protein, 9 aa, Homo Sapiens
QSVHFQTIF

SEQ ID NO: 133541 - protein, 9 aa, Homo Sapiens
QSVQEHCTF

SEQ ID NO: 133542 - protein, 9 aa, Homo Sapiens
QTCRLLLSY

SEQ ID NO: 133543 - protein, 9 aa, Homo Sapiens
QTFSSKTEW

SEQ ID NO: 133544 - protein, 9 aa, Homo Sapiens
QTNDVLLTF

SEQ ID NO: 133545 - protein, 9 aa, Homo Sapiens
QTSRYKLHY

SEQ ID NO: 133546 - protein, 9 aa, Homo Sapiens
QTSSIVECW

SEQ ID NO: 133547 - protein, 9 aa, Homo Sapiens
QTVMITPTF

SEQ ID NO: 133548 - protein, 9 aa, Homo Sapiens
QTVSPAEKW

SEQ ID NO: 133549 - protein, 9 aa, Homo Sapiens
QTYYRIFTW

SEQ ID NO: 133550 - protein, 9 aa, Homo Sapiens
RAADVLVYL

SEQ ID NO: 133551 - protein, 9 aa, Homo Sapiens
RAAFVLPEF

SEQ ID NO: 133552 - protein, 9 aa, Homo Sapiens
RAAIMQALW

SEQ ID NO: 133553 - protein, 9 aa, Homo Sapiens
RAAPFSLEY

SEQ ID NO: 133554 - protein, 9 aa, Homo Sapiens
RACQFLIKF

SEQ ID NO: 133555 - protein, 9 aa, Homo Sapiens
RAIAALSFW

SEQ ID NO: 133556 - protein, 9 aa, Homo Sapiens
RAIELQPHF

SEQ ID NO: 133557 - protein, 9 aa, Homo Sapiens
RAIFLPQAW

SEQ ID NO: 133558 - protein, 9 aa, Homo Sapiens
RAIQFYLEF

SEQ ID NO: 133559 - protein, 9 aa, Homo Sapiens
RAIQINPAF

SEQ ID NO: 133560 - protein, 9 aa, Homo Sapiens
RAIYQCFVW

SEQ ID NO: 133561 - protein, 9 aa, Homo Sapiens
RAIYTIMRW

SEQ ID NO: 133562 - protein, 9 aa, Homo Sapiens
RALKEITTF

SEQ ID NO: 133563 - protein, 9 aa, Homo Sapiens
RAQETFMQW

SEQ ID NO: 133564 - protein, 9 aa, Homo Sapiens
RARTIYERF

SEQ ID NO: 133565 - protein, 9 aa, Homo Sapiens
RASPFLLQY

SEQ ID NO: 133566 - protein, 9 aa, Homo Sapiens
RASQVQSKL

SEQ ID NO: 133567 - protein, 9 aa, Homo Sapiens
RATHVTDFF

SEQ ID NO: 133568 - protein, 9 aa, Homo Sapiens
RATPENYLF

SEQ ID NO: 133569 - protein, 9 aa, Homo Sapiens
RAVEYNALF

SEQ ID NO: 133570 - protein, 9 aa, Homo Sapiens
RAVGLVSTW

SEQ ID NO: 133571 - protein, 9 aa, Homo Sapiens
RAVQLQELW

SEQ ID NO: 133572 - protein, 9 aa, Homo Sapiens
RAYAKDVKF

SEQ ID NO: 133573 - protein, 9 aa, Homo Sapiens
RAYPFHWAW

SEQ ID NO: 133574 - protein, 9 aa, Homo Sapiens
RGADIDQQW

SEQ ID NO: 133575 - protein, 9 aa, Homo Sapiens
RGAGPAPAW

SEQ ID NO: 133576 - protein, 9 aa, Homo Sapiens
RGAQVEEIW

SEQ ID NO: 133577 - protein, 9 aa, Homo Sapiens
RGCDVTFEW

SEQ ID NO: 133578 - protein, 9 aa, Homo Sapiens
RGCDYIVLW

SEQ ID NO: 133579 - protein, 9 aa, Homo Sapiens
RGISVENSW

SEQ ID NO: 133580 - protein, 9 aa, Homo Sapiens
RGNPLVVRF

SEQ ID NO: 133581 - protein, 9 aa, Homo Sapiens
RGTVIVERW

SEQ ID NO: 133582 - protein, 9 aa, Homo Sapiens
RGVPWNFTF

SEQ ID NO: 133583 - protein, 9 aa, Homo Sapiens
RIAPSGDQW

SEQ ID NO: 133584 - protein, 9 aa, Homo Sapiens
RICSKAHSW

SEQ ID NO: 133585 - protein, 9 aa, Homo Sapiens
RIEPSVSLW

SEQ ID NO: 133586 - protein, 9 aa, Homo Sapiens
RIIAKLAAW

SEQ ID NO: 133587 - protein, 9 aa, Homo Sapiens
RIIHLVHRF

SEQ ID NO: 133588 - protein, 9 aa, Homo Sapiens
RIILDKLNW

SEQ ID NO: 133589 - protein, 9 aa, Homo Sapiens
RIINRFHSF

SEQ ID NO: 133590 - protein, 9 aa, Homo Sapiens
RIIYIREQW

SEQ ID NO: 133591 - protein, 9 aa, Homo Sapiens
RILVDQQVW

SEQ ID NO: 133592 - protein, 9 aa, Homo Sapiens
RILVEKRCW

SEQ ID NO: 133593 - protein, 9 aa, Homo Sapiens
RINQTVTFW

SEQ ID NO: 133594 - protein, 9 aa, Homo Sapiens
RITPEFSKW

SEQ ID NO: 133595 - protein, 9 aa, Homo Sapiens
RIVEPYIAW

SEQ ID NO: 133596 - protein, 9 aa, Homo Sapiens
RIVEPYVTW

SEQ ID NO: 133597 - protein, 9 aa, Homo Sapiens
RLDPNVQKW

SEQ ID NO: 133598 - protein, 9 aa, Homo Sapiens
RLFGAVVRW

SEQ ID NO: 133599 - protein, 9 aa, Homo Sapiens
RLFVGEPVW

SEQ ID NO: 133600 - protein, 9 aa, Homo Sapiens
RLLDLHQSW

SEQ ID NO: 133601 - protein, 9 aa, Homo Sapiens
RLNPLVLLL

SEQ ID NO: 133602 - protein, 9 aa, Homo Sapiens
RMAPPQNQW

SEQ ID NO: 133603 - protein, 9 aa, Homo Sapiens
RMEEEQHHW

SEQ ID NO: 133604 - protein, 9 aa, Homo Sapiens
RMFAPTKTW

SEQ ID NO: 133605 - protein, 9 aa, Homo Sapiens
RMFLENETW

SEQ ID NO: 133606 - protein, 9 aa, Homo Sapiens
RMIDIQTRM

SEQ ID NO: 133607 - protein, 9 aa, Homo Sapiens
RMNCVLATY

SEQ ID NO: 133608 - protein, 9 aa, Homo Sapiens
RMNEVISLW

SEQ ID NO: 133609 - protein, 9 aa, Homo Sapiens
RMNPNSPSI

SEQ ID NO: 133610 - protein, 9 aa, Homo Sapiens
RNLPFDFTW

SEQ ID NO: 133611 - protein, 9 aa, Homo Sapiens
RSAAYAARW

SEQ ID NO: 133612 - protein, 9 aa, Homo Sapiens
RSAICIQSW

SEQ ID NO: 133613 - protein, 9 aa, Homo Sapiens
RSAPCSPVL

SEQ ID NO: 133614 - protein, 9 aa, Homo Sapiens
RSAQAIHKF

SEQ ID NO: 133615 - protein, 9 aa, Homo Sapiens
RSAVGFLFW

SEQ ID NO: 133616 - protein, 9 aa, Homo Sapiens
RSAVVEMLI

SEQ ID NO: 133617 - protein, 9 aa, Homo Sapiens
RSCPEEQYW

SEQ ID NO: 133618 - protein, 9 aa, Homo Sapiens
RSDGLLQLW

SEQ ID NO: 133619 - protein, 9 aa, Homo Sapiens
RSDIGEFEW

SEQ ID NO: 133620 - protein, 9 aa, Homo Sapiens
RSDPGHYSF

SEQ ID NO: 133621 - protein, 9 aa, Homo Sapiens
RSDPSIMNW

SEQ ID NO: 133622 - protein, 9 aa, Homo Sapiens
RSEVILEKW

SEQ ID NO: 133623 - protein, 9 aa, Homo Sapiens
RSFFHQHYL

SEQ ID NO: 133624 - protein, 9 aa, Homo Sapiens
RSFHGQCQL

SEQ ID NO: 133625 - protein, 9 aa, Homo Sapiens
RSFLDDPIW

SEQ ID NO: 133626 - protein, 9 aa, Homo Sapiens
RSFLTKLEW

SEQ ID NO: 133627 - protein, 9 aa, Homo Sapiens
RSFPGFQAF

SEQ ID NO: 133628 - protein, 9 aa, Homo Sapiens
RSFQMQYNL

SEQ ID NO: 133629 - protein, 9 aa, Homo Sapiens
RSFVEKHRW

SEQ ID NO: 133630 - protein, 9 aa, Homo Sapiens
RSGPFGQIF

SEQ ID NO: 133631 - protein, 9 aa, Homo Sapiens
RSHDTLVRW

SEQ ID NO: 133632 - protein, 9 aa, Homo Sapiens
RSHGFAAEF

SEQ ID NO: 133633 - protein, 9 aa, Homo Sapiens
RSHPNKQLW

SEQ ID NO: 133634 - protein, 9 aa, Homo Sapiens
RSIAGIDQW

SEQ ID NO: 133635 - protein, 9 aa, Homo Sapiens
RSIGWGEEF

SEQ ID NO: 133636 - protein, 9 aa, Homo Sapiens
RSILAPLAW

SEQ ID NO: 133637 - protein, 9 aa, Homo Sapiens
RSIPVLAKW

SEQ ID NO: 133638 - protein, 9 aa, Homo Sapiens
RSIPVWIKI

SEQ ID NO: 133639 - protein, 9 aa, Homo Sapiens
RSIQQGFCF

SEQ ID NO: 133640 - protein, 9 aa, Homo Sapiens
RSISDKQQW

SEQ ID NO: 133641 - protein, 9 aa, Homo Sapiens
RSIVNQVRF

SEQ ID NO: 133642 - protein, 9 aa, Homo Sapiens
RSKQTKELW

SEQ ID NO: 133643 - protein, 9 aa, Homo Sapiens
RSLAYIHSF

SEQ ID NO: 133644 - protein, 9 aa, Homo Sapiens
RSLDQQMYL

SEQ ID NO: 133645 - protein, 9 aa, Homo Sapiens
RSLEISQSY

SEQ ID NO: 133646 - protein, 9 aa, Homo Sapiens
RSLGFNTQI

SEQ ID NO: 133647 - protein, 9 aa, Homo Sapiens
RSLGVHLSF

SEQ ID NO: 133648 - protein, 9 aa, Homo Sapiens
RSLLQENNW

SEQ ID NO: 133649 - protein, 9 aa, Homo Sapiens
RSLPASQAW

SEQ ID NO: 133650 - protein, 9 aa, Homo Sapiens
RSLPEIWTL

SEQ ID NO: 133651 - protein, 9 aa, Homo Sapiens
RSLQLHLVF

SEQ ID NO: 133652 - protein, 9 aa, Homo Sapiens
RSLQTICSW

SEQ ID NO: 133653 - protein, 9 aa, Homo Sapiens
RSLSTTNVF

SEQ ID NO: 133654 - protein, 9 aa, Homo Sapiens
RSLVPIQLW

SEQ ID NO: 133655 - protein, 9 aa, Homo Sapiens
RSMDQGSTW

SEQ ID NO: 133656 - protein, 9 aa, Homo Sapiens
RSMEDFVTW

SEQ ID NO: 133657 - protein, 9 aa, Homo Sapiens
RSMGLPLQF

SEQ ID NO: 133658 - protein, 9 aa, Homo Sapiens
RSMVLKLTL

SEQ ID NO: 133659 - protein, 9 aa, Homo Sapiens
RSNILTLMY

SEQ ID NO: 133660 - protein, 9 aa, Homo Sapiens
RSNIMTLLF

SEQ ID NO: 133661 - protein, 9 aa, Homo Sapiens
RSNNINTLF

SEQ ID NO: 133662 - protein, 9 aa, Homo Sapiens
RSNSFNSTF

SEQ ID NO: 133663 - protein, 9 aa, Homo Sapiens
RSQEKCYLF

SEQ ID NO: 133664 - protein, 9 aa, Homo Sapiens
RSQPQHFTY

SEQ ID NO: 133665 - protein, 9 aa, Homo Sapiens
RSQVDHVIW

SEQ ID NO: 133666 - protein, 9 aa, Homo Sapiens
RSSDSWEVW

SEQ ID NO: 133667 - protein, 9 aa, Homo Sapiens
RSSGRVYYF

SEQ ID NO: 133668 - protein, 9 aa, Homo Sapiens
RSSNVSYKY

SEQ ID NO: 133669 - protein, 9 aa, Homo Sapiens
RSSPVEYEF

SEQ ID NO: 133670 - protein, 9 aa, Homo Sapiens
RSSTPLPTI

SEQ ID NO: 133671 - protein, 9 aa, Homo Sapiens
RSSVILLTY

SEQ ID NO: 133672 - protein, 9 aa, Homo Sapiens
RSTDRVLQW

SEQ ID NO: 133673 - protein, 9 aa, Homo Sapiens
RSTELDSNW

SEQ ID NO: 133674 - protein, 9 aa, Homo Sapiens
RSTQITVRF

SEQ ID NO: 133675 - protein, 9 aa, Homo Sapiens
RSTQQTTEW

SEQ ID NO: 133676 - protein, 9 aa, Homo Sapiens
RSTVAEHLW

SEQ ID NO: 133677 - protein, 9 aa, Homo Sapiens
RSTVLTPMF

SEQ ID NO: 133678 - protein, 9 aa, Homo Sapiens
RSVDEVNYW

SEQ ID NO: 133679 - protein, 9 aa, Homo Sapiens
RSVDLQTRI

SEQ ID NO: 133680 - protein, 9 aa, Homo Sapiens
RSVLHHFHF

SEQ ID NO: 133681 - protein, 9 aa, Homo Sapiens
RSVPLKATF

SEQ ID NO: 133682 - protein, 9 aa, Homo Sapiens
RSVPTSTVF

SEQ ID NO: 133683 - protein, 9 aa, Homo Sapiens
RSVRLYHLL

SEQ ID NO: 133684 - protein, 9 aa, Homo Sapiens
RSWDHNEFF

SEQ ID NO: 133685 - protein, 9 aa, Homo Sapiens
RSWVEQDHW

SEQ ID NO: 133686 - protein, 9 aa, Homo Sapiens
RSYDYQFRY

SEQ ID NO: 133687 - protein, 9 aa, Homo Sapiens
RSYLQDPIW

SEQ ID NO: 133688 - protein, 9 aa, Homo Sapiens
RSYSQQLFL

SEQ ID NO: 133689 - protein, 9 aa, Homo Sapiens
RTAHTFESW

SEQ ID NO: 133690 - protein, 9 aa, Homo Sapiens
RTAHVILRY

SEQ ID NO: 133691 - protein, 9 aa, Homo Sapiens
RTAITTPNF

SEQ ID NO: 133692 - protein, 9 aa, Homo Sapiens
RTAKLQVTL

SEQ ID NO: 133693 - protein, 9 aa, Homo Sapiens
RTAQEVETY

SEQ ID NO: 133694 - protein, 9 aa, Homo Sapiens
RTATFQQRF

SEQ ID NO: 133695 - protein, 9 aa, Homo Sapiens
RTDGKVFQF

SEQ ID NO: 133696 - protein, 9 aa, Homo Sapiens
RTDGRCLIW

SEQ ID NO: 133697 - protein, 9 aa, Homo Sapiens
RTDSSHQAW

SEQ ID NO: 133698 - protein, 9 aa, Homo Sapiens
RTEKTMATW

SEQ ID NO: 133699 - protein, 9 aa, Homo Sapiens
RTEVVQTLW

SEQ ID NO: 133700 - protein, 9 aa, Homo Sapiens
RTFPDPTSW

SEQ ID NO: 133701 - protein, 9 aa, Homo Sapiens
RTGHILVQW

SEQ ID NO: 133702 - protein, 9 aa, Homo Sapiens
RTGHTVLTW

SEQ ID NO: 133703 - protein, 9 aa, Homo Sapiens
RTIEDFNKF

SEQ ID NO: 133704 - protein, 9 aa, Homo Sapiens
RTKEEVNEW

SEQ ID NO: 133705 - protein, 9 aa, Homo Sapiens
RTLDFDPLL

SEQ ID NO: 133706 - protein, 9 aa, Homo Sapiens
RTLDNQLFF

SEQ ID NO: 133707 - protein, 9 aa, Homo Sapiens
RTLMENQHW

SEQ ID NO: 133708 - protein, 9 aa, Homo Sapiens
RTLPVLLLY

SEQ ID NO: 133709 - protein, 9 aa, Homo Sapiens
RTLRDIETF

SEQ ID NO: 133710 - protein, 9 aa, Homo Sapiens
RTMEIESTF

SEQ ID NO: 133711 - protein, 9 aa, Homo Sapiens
RTMEWVQTI

SEQ ID NO: 133712 - protein, 9 aa, Homo Sapiens
RTNAIKQTF

SEQ ID NO: 133713 - protein, 9 aa, Homo Sapiens
RTNGVLLFI

SEQ ID NO: 133714 - protein, 9 aa, Homo Sapiens
RTNNIELHY

SEQ ID NO: 133715 - protein, 9 aa, Homo Sapiens
RTNTAYQCF

SEQ ID NO: 133716 - protein, 9 aa, Homo Sapiens
RTSDKELYF

SEQ ID NO: 133717 - protein, 9 aa, Homo Sapiens
RTSETNTLF

SEQ ID NO: 133718 - protein, 9 aa, Homo Sapiens
RTSLIGEEW

SEQ ID NO: 133719 - protein, 9 aa, Homo Sapiens
RTSPSGGTW

SEQ ID NO: 133720 - protein, 9 aa, Homo Sapiens
RTSRTLLLL

SEQ ID NO: 133721 - protein, 9 aa, Homo Sapiens
RTSTSQAVF

SEQ ID NO: 133722 - protein, 9 aa, Homo Sapiens
RTTDEVYLF

SEQ ID NO: 133723 - protein, 9 aa, Homo Sapiens
RTTDIVIRI

SEQ ID NO: 133724 - protein, 9 aa, Homo Sapiens
RTTDLLTDW

SEQ ID NO: 133725 - protein, 9 aa, Homo Sapiens
RTTPIAMSF

SEQ ID NO: 133726 - protein, 9 aa, Homo Sapiens
RTTQIYTYF

SEQ ID NO: 133727 - protein, 9 aa, Homo Sapiens
RTTTVESSF

SEQ ID NO: 133728 - protein, 9 aa, Homo Sapiens
RTVAALASW

SEQ ID NO: 133729 - protein, 9 aa, Homo Sapiens
RTVALTALL

SEQ ID NO: 133730 - protein, 9 aa, Homo Sapiens
RTVEDFNKF

SEQ ID NO: 133731 - protein, 9 aa, Homo Sapiens
RTVEKPPKF

SEQ ID NO: 133732 - protein, 9 aa, Homo Sapiens
RTVEKTWKL

SEQ ID NO: 133733 - protein, 9 aa, Homo Sapiens
RTVIIEQSW

SEQ ID NO: 133734 - protein, 9 aa, Homo Sapiens
RTVNVEDSW

SEQ ID NO: 133735 - protein, 9 aa, Homo Sapiens
RTVPFCSTF

SEQ ID NO: 133736 - protein, 9 aa, Homo Sapiens
RTVYFSEQW

SEQ ID NO: 133737 - protein, 9 aa, Homo Sapiens
RTYEHEAMW

SEQ ID NO: 133738 - protein, 9 aa, Homo Sapiens
RTYFVANEW

SEQ ID NO: 133739 - protein, 9 aa, Homo Sapiens
RTYPVQEYF

SEQ ID NO: 133740 - protein, 9 aa, Homo Sapiens
RVAAVLLQF

SEQ ID NO: 133741 - protein, 9 aa, Homo Sapiens
RVAHFGYHW

SEQ ID NO: 133742 - protein, 9 aa, Homo Sapiens
RVCGKAFRW

SEQ ID NO: 133743 - protein, 9 aa, Homo Sapiens
RVDGAVSSW

SEQ ID NO: 133744 - protein, 9 aa, Homo Sapiens
RVEGAQQRW

SEQ ID NO: 133745 - protein, 9 aa, Homo Sapiens
RVFDLPLTW

SEQ ID NO: 133746 - protein, 9 aa, Homo Sapiens
RVFDNQDTW

SEQ ID NO: 133747 - protein, 9 aa, Homo Sapiens
RVFLMDPAW

SEQ ID NO: 133748 - protein, 9 aa, Homo Sapiens
RVFPHEVNW

SEQ ID NO: 133749 - protein, 9 aa, Homo Sapiens
RVHAFLEQW

SEQ ID NO: 133750 - protein, 9 aa, Homo Sapiens
RVHKDGSLW

SEQ ID NO: 133751 - protein, 9 aa, Homo Sapiens
RVHPETYEW

SEQ ID NO: 133752 - protein, 9 aa, Homo Sapiens
RVIDVGSEW

SEQ ID NO: 133753 - protein, 9 aa, Homo Sapiens
RVIEFAAKF

SEQ ID NO: 133754 - protein, 9 aa, Homo Sapiens
RVLISTDVW

SEQ ID NO: 133755 - protein, 9 aa, Homo Sapiens
RVLPCNHEF

SEQ ID NO: 133756 - protein, 9 aa, Homo Sapiens
RVMPSSFFL

SEQ ID NO: 133757 - protein, 9 aa, Homo Sapiens
RVNPVEYSI

SEQ ID NO: 133758 - protein, 9 aa, Homo Sapiens
RVQGFQVEY

SEQ ID NO: 133759 - protein, 9 aa, Homo Sapiens
RVSELQVLL

SEQ ID NO: 133760 - protein, 9 aa, Homo Sapiens
RVSNIRQVF

SEQ ID NO: 133761 - protein, 9 aa, Homo Sapiens
RVSQLQIQF

SEQ ID NO: 133762 - protein, 9 aa, Homo Sapiens
RVTSVVTGF

SEQ ID NO: 133763 - protein, 9 aa, Homo Sapiens
RVVDFDETW

SEQ ID NO: 133764 - protein, 9 aa, Homo Sapiens
RVVDIYSKF

SEQ ID NO: 133765 - protein, 9 aa, Homo Sapiens
RVVELQQTL

SEQ ID NO: 133766 - protein, 9 aa, Homo Sapiens
RVVIFDPSW

SEQ ID NO: 133767 - protein, 9 aa, Homo Sapiens
RVVQQEEGW

SEQ ID NO: 133768 - protein, 9 aa, Homo Sapiens
RVWNLNHLW

SEQ ID NO: 133769 - protein, 9 aa, Homo Sapiens
RVWQWDEKW

SEQ ID NO: 133770 - protein, 9 aa, Homo Sapiens
RVYPQAVYF

SEQ ID NO: 133771 - protein, 9 aa, Homo Sapiens
SAANIQPIF

SEQ ID NO: 133772 - protein, 9 aa, Homo Sapiens
SAAPKPTSW

SEQ ID NO: 133773 - protein, 9 aa, Homo Sapiens
SAAPLFFSW

SEQ ID NO: 133774 - protein, 9 aa, Homo Sapiens
SAARLYYYW

SEQ ID NO: 133775 - protein, 9 aa, Homo Sapiens
SADGTIKLW

SEQ ID NO: 133776 - protein, 9 aa, Homo Sapiens
SADHLIILW

SEQ ID NO: 133777 - protein, 9 aa, Homo Sapiens
SADKTVALW

SEQ ID NO: 133778 - protein, 9 aa, Homo Sapiens
SADKTVKLW

SEQ ID NO: 133779 - protein, 9 aa, Homo Sapiens
SADNTVILW

SEQ ID NO: 133780 - protein, 9 aa, Homo Sapiens
SADRFVYVW

SEQ ID NO: 133781 - protein, 9 aa, Homo Sapiens
SADRTVKLW

SEQ ID NO: 133782 - protein, 9 aa, Homo Sapiens
SADRTVTLW

SEQ ID NO: 133783 - protein, 9 aa, Homo Sapiens
SAIRYQEVW

SEQ ID NO: 133784 - protein, 9 aa, Homo Sapiens
SALRGEPLW

SEQ ID NO: 133785 - protein, 9 aa, Homo Sapiens
SASEVLKEW

SEQ ID NO: 133786 - protein, 9 aa, Homo Sapiens
SASKPLASW

SEQ ID NO: 133787 - protein, 9 aa, Homo Sapiens
SASPFQSAW

SEQ ID NO: 133788 - protein, 9 aa, Homo Sapiens
SATDTSAKW

SEQ ID NO: 133789 - protein, 9 aa, Homo Sapiens
SATEVDSRW

SEQ ID NO: 133790 - protein, 9 aa, Homo Sapiens
SATPSLVTW

SEQ ID NO: 133791 - protein, 9 aa, Homo Sapiens
SAVKVLMKF

SEQ ID NO: 133792 - protein, 9 aa, Homo Sapiens
SAYVDSHKW

SEQ ID NO: 133793 - protein, 9 aa, Homo Sapiens
SIDTTCTIW

SEQ ID NO: 133794 - protein, 9 aa, Homo Sapiens
SINPNNHSW

SEQ ID NO: 133795 - protein, 9 aa, Homo Sapiens
SMHFLVAEW

SEQ ID NO: 133796 - protein, 9 aa, Homo Sapiens
SSAKTILKY

SEQ ID NO: 133797 - protein, 9 aa, Homo Sapiens
SSAYEFVTW

SEQ ID NO: 133798 - protein, 9 aa, Homo Sapiens
SSCSTPLRF

SEQ ID NO: 133799 - protein, 9 aa, Homo Sapiens
SSDSHQPLW

SEQ ID NO: 133800 - protein, 9 aa, Homo Sapiens
SSDTTVKVW

SEQ ID NO: 133801 - protein, 9 aa, Homo Sapiens
SSDTTVLIW

SEQ ID NO: 133802 - protein, 9 aa, Homo Sapiens
SSGPVAESW

SEQ ID NO: 133803 - protein, 9 aa, Homo Sapiens
SSIKGAEEW

SEQ ID NO: 133804 - protein, 9 aa, Homo Sapiens
SSIVDNELW

SEQ ID NO: 133805 - protein, 9 aa, Homo Sapiens
SSLKHLYKW

SEQ ID NO: 133806 - protein, 9 aa, Homo Sapiens
SSLKKKQIW

SEQ ID NO: 133807 - protein, 9 aa, Homo Sapiens
SSLPTVEKW

SEQ ID NO: 133808 - protein, 9 aa, Homo Sapiens
SSLRVPSQW

SEQ ID NO: 133809 - protein, 9 aa, Homo Sapiens
SSMPNAESW

SEQ ID NO: 133810 - protein, 9 aa, Homo Sapiens
SSNPEQLFF

SEQ ID NO: 133811 - protein, 9 aa, Homo Sapiens
SSNVVQLIM

SEQ ID NO: 133812 - protein, 9 aa, Homo Sapiens
SSSDLMSKW

SEQ ID NO: 133813 - protein, 9 aa, Homo Sapiens
SSSDLVSKW

SEQ ID NO: 133814 - protein, 9 aa, Homo Sapiens
SSSKEHVKW

SEQ ID NO: 133815 - protein, 9 aa, Homo Sapiens
SSSQIILKW

SEQ ID NO: 133816 - protein, 9 aa, Homo Sapiens
SSSRIRAAW

SEQ ID NO: 133817 - protein, 9 aa, Homo Sapiens
SSSSIEVHW

SEQ ID NO: 133818 - protein, 9 aa, Homo Sapiens
SSSSVRVEW

SEQ ID NO: 133819 - protein, 9 aa, Homo Sapiens
SSTPHNVSW

SEQ ID NO: 133820 - protein, 9 aa, Homo Sapiens
SSTPIAPVF

SEQ ID NO: 133821 - protein, 9 aa, Homo Sapiens
SSTTVIPTL

SEQ ID NO: 133822 - protein, 9 aa, Homo Sapiens
SSVRAVAVW

SEQ ID NO: 133823 - protein, 9 aa, Homo Sapiens
SSYPNTFEW

SEQ ID NO: 133824 - protein, 9 aa, Homo Sapiens
STAKCLNIW

SEQ ID NO: 133825 - protein, 9 aa, Homo Sapiens
STAPGYYSW

SEQ ID NO: 133826 - protein, 9 aa, Homo Sapiens
STDKTVAVW

SEQ ID NO: 133827 - protein, 9 aa, Homo Sapiens
STDKTVRLW

SEQ ID NO: 133828 - protein, 9 aa, Homo Sapiens
STDRHIRLW

SEQ ID NO: 133829 - protein, 9 aa, Homo Sapiens
STIETVPYW

SEQ ID NO: 133830 - protein, 9 aa, Homo Sapiens
STNKYQLSI

SEQ ID NO: 133831 - protein, 9 aa, Homo Sapiens
SVIEEHANW

SEQ ID NO: 133832 - protein, 9 aa, Homo Sapiens
SVTEIQEKW

SEQ ID NO: 133833 - protein, 9 aa, Homo Sapiens
SVTEVQLRF

SEQ ID NO: 133834 - protein, 9 aa, Homo Sapiens
TAAETHYTY

SEQ ID NO: 133835 - protein, 9 aa, Homo Sapiens
TADITVLRW

SEQ ID NO: 133836 - protein, 9 aa, Homo Sapiens
TAHSEPSLW

SEQ ID NO: 133837 - protein, 9 aa, Homo Sapiens
TAIREVGVW

SEQ ID NO: 133838 - protein, 9 aa, Homo Sapiens
TANGIALLW

SEQ ID NO: 133839 - protein, 9 aa, Homo Sapiens
TANKYQVFF

SEQ ID NO: 133840 - protein, 9 aa, Homo Sapiens
TAVKIAPRY

SEQ ID NO: 133841 - protein, 9 aa, Homo Sapiens
TAVTPQQTW

SEQ ID NO: 133842 - protein, 9 aa, Homo Sapiens
TAVVEDVSW

SEQ ID NO: 133843 - protein, 9 aa, Homo Sapiens
TFTKIVNKW

SEQ ID NO: 133844 - protein, 9 aa, Homo Sapiens
TILVDNNTW

SEQ ID NO: 133845 - protein, 9 aa, Homo Sapiens
TINKVLLQY

SEQ ID NO: 133846 - protein, 9 aa, Homo Sapiens
TIVKVFPTW

SEQ ID NO: 133847 - protein, 9 aa, Homo Sapiens
TMSDVQIHW

SEQ ID NO: 133848 - protein, 9 aa, Homo Sapiens
TSFEQHVLW

SEQ ID NO: 133849 - protein, 9 aa, Homo Sapiens
TSLPDTDTW

SEQ ID NO: 133850 - protein, 9 aa, Homo Sapiens
TSSSLPEAW

SEQ ID NO: 133851 - protein, 9 aa, Homo Sapiens
TSTIVTLKW

SEQ ID NO: 133852 - protein, 9 aa, Homo Sapiens
TSVHPDLMK

SEQ ID NO: 133853 - protein, 9 aa, Homo Sapiens
TSVLENHHW

SEQ ID NO: 133854 - protein, 9 aa, Homo Sapiens
TSVPDHVVW

SEQ ID NO: 133855 - protein, 9 aa, Homo Sapiens
TSVPLPVTW

SEQ ID NO: 133856 - protein, 9 aa, Homo Sapiens
TSYLGKEHW

SEQ ID NO: 133857 - protein, 9 aa, Homo Sapiens
TTLVDNNTW

SEQ ID NO: 133858 - protein, 9 aa, Homo Sapiens
TTSKTDQRW

SEQ ID NO: 133859 - protein, 9 aa, Homo Sapiens
TTTVMNPKF

SEQ ID NO: 133860 - protein, 9 aa, Homo Sapiens
TVHQGDTSW

SEQ ID NO: 133861 - protein, 9 aa, Homo Sapiens
TVIEKTESW

SEQ ID NO: 133862 - protein, 9 aa, Homo Sapiens
TVLTTHHHW

SEQ ID NO: 133863 - protein, 9 aa, Homo Sapiens
TVYPKPEEW

SEQ ID NO: 133864 - protein, 9 aa, Homo Sapiens
TVYVDDASW

SEQ ID NO: 133865 - protein, 9 aa, Homo Sapiens
VAEKLNIPW

SEQ ID NO: 133866 - protein, 9 aa, Homo Sapiens
VALQDHFKW

SEQ ID NO: 133867 - protein, 9 aa, Homo Sapiens
VANLTNLVW

SEQ ID NO: 133868 - protein, 9 aa, Homo Sapiens
VAVGSGLSW

SEQ ID NO: 133869 - protein, 9 aa, Homo Sapiens
VAVTKDPNW

SEQ ID NO: 133870 - protein, 9 aa, Homo Sapiens
VFDPVTKLW

SEQ ID NO: 133871 - protein, 9 aa, Homo Sapiens
VGGEALELR

SEQ ID NO: 133872 - protein, 9 aa, Homo Sapiens
VSAAEQQLW

SEQ ID NO: 133873 - protein, 9 aa, Homo Sapiens
VSADVEERF

SEQ ID NO: 133874 - protein, 9 aa, Homo Sapiens
VSAEETEKW

SEQ ID NO: 133875 - protein, 9 aa, Homo Sapiens
VSAETVEKW

SEQ ID NO: 133876 - protein, 9 aa, Homo Sapiens
VSAGIQTSF

SEQ ID NO: 133877 - protein, 9 aa, Homo Sapiens
VSAPELGLW

SEQ ID NO: 133878 - protein, 9 aa, Homo Sapiens
VSAPEVSRW

SEQ ID NO: 133879 - protein, 9 aa, Homo Sapiens
VSAPSSETF

SEQ ID NO: 133880 - protein, 9 aa, Homo Sapiens
VSDASKPSW

SEQ ID NO: 133881 - protein, 9 aa, Homo Sapiens
VSDPENTTW

SEQ ID NO: 133882 - protein, 9 aa, Homo Sapiens
VSEHQPTTW

SEQ ID NO: 133883 - protein, 9 aa, Homo Sapiens
VSFAEKNGW

SEQ ID NO: 133884 - protein, 9 aa, Homo Sapiens
VSFDSHEEW

SEQ ID NO: 133885 - protein, 9 aa, Homo Sapiens
VSFYNQNKW

SEQ ID NO: 133886 - protein, 9 aa, Homo Sapiens
VSHPNEVSW

SEQ ID NO: 133887 - protein, 9 aa, Homo Sapiens
VSHPQSCHW

SEQ ID NO: 133888 - protein, 9 aa, Homo Sapiens
VSIEERARW

SEQ ID NO: 133889 - protein, 9 aa, Homo Sapiens
VSIRDILSW

SEQ ID NO: 133890 - protein, 9 aa, Homo Sapiens
VSKPDLITW

SEQ ID NO: 133891 - protein, 9 aa, Homo Sapiens
VSLEWLQKW

SEQ ID NO: 133892 - protein, 9 aa, Homo Sapiens
VSMIFPFHW

SEQ ID NO: 133893 - protein, 9 aa, Homo Sapiens
VSMIFPLHW

SEQ ID NO: 133894 - protein, 9 aa, Homo Sapiens
VSNGCQLLL

SEQ ID NO: 133895 - protein, 9 aa, Homo Sapiens
VSNKYGLVF

SEQ ID NO: 133896 - protein, 9 aa, Homo Sapiens
VSNPKSFEY

SEQ ID NO: 133897 - protein, 9 aa, Homo Sapiens
VSNPYHVVI

SEQ ID NO: 133898 - protein, 9 aa, Homo Sapiens
VSNRNKLKW

SEQ ID NO: 133899 - protein, 9 aa, Homo Sapiens
VSQKDEHCW

SEQ ID NO: 133900 - protein, 9 aa, Homo Sapiens
VSSDVQSVF

SEQ ID NO: 133901 - protein, 9 aa, Homo Sapiens
VSSTNGHRW

SEQ ID NO: 133902 - protein, 9 aa, Homo Sapiens
VSTRQTQSW

SEQ ID NO: 133903 - protein, 9 aa, Homo Sapiens
VSTTIDPFW

SEQ ID NO: 133904 - protein, 9 aa, Homo Sapiens
VSVDKQQQW

SEQ ID NO: 133905 - protein, 9 aa, Homo Sapiens
VSVLAGPRW

SEQ ID NO: 133906 - protein, 9 aa, Homo Sapiens
VSVPYVFRY

SEQ ID NO: 133907 - protein, 9 aa, Homo Sapiens
VTAGDPVSW

SEQ ID NO: 133908 - protein, 9 aa, Homo Sapiens
VTDNAVYHW

SEQ ID NO: 133909 - protein, 9 aa, Homo Sapiens
VTFPECVRW

SEQ ID NO: 133910 - protein, 9 aa, Homo Sapiens
VTIRLLETI

SEQ ID NO: 133911 - protein, 9 aa, Homo Sapiens
VTNKSVSVW

SEQ ID NO: 133912 - protein, 9 aa, Homo Sapiens
VTNPHSSQW

SEQ ID NO: 133913 - protein, 9 aa, Homo Sapiens
VTNPHTDAW

SEQ ID NO: 133914 - protein, 9 aa, Homo Sapiens
VTNPLQIMY

SEQ ID NO: 133915 - protein, 9 aa, Homo Sapiens
VTNPYQATI

SEQ ID NO: 133916 - protein, 9 aa, Homo Sapiens
VTQRLNSQW

SEQ ID NO: 133917 - protein, 9 aa, Homo Sapiens
VTSKVIFFW

SEQ ID NO: 133918 - protein, 9 aa, Homo Sapiens
VTSPLTVEW

SEQ ID NO: 133919 - protein, 9 aa, Homo Sapiens
VTTVVNPKY

SEQ ID NO: 133920 - protein, 9 aa, Homo Sapiens
VTYKNVPNW

SEQ ID NO: 133921 - protein, 9 aa, Homo Sapiens
VVDERQYIW

SEQ ID NO: 133922 - protein, 9 aa, Homo Sapiens
VVMPIAHEF

SEQ ID NO: 133923 - protein, 9 aa, Homo Sapiens
VVSSIHSSW

SEQ ID NO: 133924 - protein, 9 aa, Homo Sapiens
VVVRDTAAW

SEQ ID NO: 133925 - protein, 9 aa, Homo Sapiens
WSTKESPRW

SEQ ID NO: 133926 - protein, 9 aa, Homo Sapiens
YAAKVENKW

SEQ ID NO: 133927 - protein, 9 aa, Homo Sapiens
YAGPEVDIW

SEQ ID NO: 133928 - protein, 9 aa, Homo Sapiens
YLFKGNNRW

SEQ ID NO: 133929 - protein, 9 aa, Homo Sapiens
YLNRHLHTW

SEQ ID NO: 133930 - protein, 9 aa, Homo Sapiens
YSIRGQLSW

SEQ ID NO: 133931 - protein, 9 aa, Homo Sapiens
YSLKKRHFF

SEQ ID NO: 133932 - protein, 9 aa, Homo Sapiens
YSLMSSEKW

SEQ ID NO: 133933 - protein, 9 aa, Homo Sapiens
YSLPEFEEW

SEQ ID NO: 133934 - protein, 9 aa, Homo Sapiens
YSNAKVSCW

SEQ ID NO: 133935 - protein, 9 aa, Homo Sapiens
YSNEVVTLW

SEQ ID NO: 133936 - protein, 9 aa, Homo Sapiens
YSVRVSPQM

SEQ ID NO: 133937 - protein, 9 aa, Homo Sapiens
YTIKDTVAW

SEQ ID NO: 133938 - protein, 9 aa, Homo Sapiens
YTNKVITLW

SEQ ID NO: 133939 - protein, 9 aa, Homo Sapiens
YTNRVVTLW

SEQ ID NO: 133940 - protein, 9 aa, Homo Sapiens
YTVGAPHTW

SEQ ID NO: 133941 - protein, 9 aa, Homo Sapiens
YTVRVIDVF

SEQ ID NO: 133942 - protein, 9 aa, Homo Sapiens
YTYKKQVKI

SEQ ID NO: 133943 - protein, 10 aa, Homo Sapiens
AAGHAELAWT

SEQ ID NO: 133944 - protein, 10 aa, Homo Sapiens
AALPDQSFLW

SEQ ID NO: 133945 - protein, 10 aa, Homo Sapiens
AHSNLNGVWH

SEQ ID NO: 133946 - protein, 10 aa, Homo Sapiens
ALAPILDDGW

SEQ ID NO: 133947 - protein, 10 aa, Homo Sapiens
ASARGSGATW

SEQ ID NO: 133948 - protein, 10 aa, Homo Sapiens
ASFNDNIIKW

SEQ ID NO: 133949 - protein, 10 aa, Homo Sapiens
ASFSDYYYKW

SEQ ID NO: 133950 - protein, 10 aa, Homo Sapiens
ASINPLNDHW

SEQ ID NO: 133951 - protein, 10 aa, Homo Sapiens
ASLQEIGDRW

SEQ ID NO: 133952 - protein, 10 aa, Homo Sapiens
ASVTEIQEKW

SEQ ID NO: 133953 - protein, 10 aa, Homo Sapiens
ASYDGTAQVW

SEQ ID NO: 133954 - protein, 10 aa, Homo Sapiens
ASYQDRRQSW

SEQ ID NO: 133955 - protein, 10 aa, Homo Sapiens
ATCGQQVDIW

SEQ ID NO: 133956 - protein, 10 aa, Homo Sapiens
ATILGNTERW

SEQ ID NO: 133957 - protein, 10 aa, Homo Sapiens
ATVKDDLTKW

SEQ ID NO: 133958 - protein, 10 aa, Homo Sapiens
ATVKYLSEKW

SEQ ID NO: 133959 - protein, 10 aa, Homo Sapiens
AVNPRDPPSW

SEQ ID NO: 133960 - protein, 10 aa, Homo Sapiens
CLGVLPTVCW

SEQ ID NO: 133961 - protein, 10 aa, Homo Sapiens
DLSTLQEKMA

SEQ ID NO: 133962 - protein, 10 aa, Homo Sapiens
DTNADKQLSF

SEQ ID NO: 133963 - protein, 10 aa, Homo Sapiens
ENLRILSSPW

SEQ ID NO: 133964 - protein, 10 aa, Homo Sapiens
ESLRSHFEQW

SEQ ID NO: 133965 - protein, 10 aa, Homo Sapiens
FSGEELDKLW

SEQ ID NO: 133966 - protein, 10 aa, Homo Sapiens
FSLKESIMKW

SEQ ID NO: 133967 - protein, 10 aa, Homo Sapiens
FSLQAPAPLM

SEQ ID NO: 133968 - protein, 10 aa, Homo Sapiens
FTLREVQERW

SEQ ID NO: 133969 - protein, 10 aa, Homo Sapiens
GAYKYIQELW

SEQ ID NO: 133970 - protein, 10 aa, Homo Sapiens
GPPPPPGKPQ

SEQ ID NO: 133971 - protein, 10 aa, Homo Sapiens
GSFHGSPYEW

SEQ ID NO: 133972 - protein, 10 aa, Homo Sapiens
GSHRWQGETW

SEQ ID NO: 133973 - protein, 10 aa, Homo Sapiens
GSIPEDHEDW

SEQ ID NO: 133974 - protein, 10 aa, Homo Sapiens
HACALAASLW

SEQ ID NO: 133975 - protein, 10 aa, Homo Sapiens
HAFDGFEVNW

SEQ ID NO: 133976 - protein, 10 aa, Homo Sapiens
HIWPDDITKW

SEQ ID NO: 133977 - protein, 10 aa, Homo Sapiens
HLNPIILPLW

SEQ ID NO: 133978 - protein, 10 aa, Homo Sapiens
HSAHTKLQTW

SEQ ID NO: 133979 - protein, 10 aa, Homo Sapiens
HSAVVEDVAW

SEQ ID NO: 133980 - protein, 10 aa, Homo Sapiens
HSCEVKGIEW

SEQ ID NO: 133981 - protein, 10 aa, Homo Sapiens
HSCPESVKKW

SEQ ID NO: 133982 - protein, 10 aa, Homo Sapiens
HSDMIYNVSW

SEQ ID NO: 133983 - protein, 10 aa, Homo Sapiens
HSDNPSQLIW

SEQ ID NO: 133984 - protein, 10 aa, Homo Sapiens
HSFSGSQQKW

SEQ ID NO: 133985 - protein, 10 aa, Homo Sapiens
HSGPGLLQLW

SEQ ID NO: 133986 - protein, 10 aa, Homo Sapiens
HSGPVVAMVW

SEQ ID NO: 133987 - protein, 10 aa, Homo Sapiens
HSITSDNHKW

SEQ ID NO: 133988 - protein, 10 aa, Homo Sapiens
HSMDPPTFTF

SEQ ID NO: 133989 - protein, 10 aa, Homo Sapiens
HSMLDINALF

SEQ ID NO: 133990 - protein, 10 aa, Homo Sapiens
HSMSDPGVSY

SEQ ID NO: 133991 - protein, 10 aa, Homo Sapiens
HSNPGDPALW

SEQ ID NO: 133992 - protein, 10 aa, Homo Sapiens
HSQEVTSVCW

SEQ ID NO: 133993 - protein, 10 aa, Homo Sapiens
HSVAQAGVQW

SEQ ID NO: 133994 - protein, 10 aa, Homo Sapiens
HSVTQAGVQW

SEQ ID NO: 133995 - protein, 10 aa, Homo Sapiens
HTAKISDFSW

SEQ ID NO: 133996 - protein, 10 aa, Homo Sapiens
HTAPPENKTW

SEQ ID NO: 133997 - protein, 10 aa, Homo Sapiens
HTAPVLDIAW

SEQ ID NO: 133998 - protein, 10 aa, Homo Sapiens
HTAVVEDVSW

SEQ ID NO: 133999 - protein, 10 aa, Homo Sapiens
HTDGPLASSW

SEQ ID NO: 134000 - protein, 10 aa, Homo Sapiens
HTFPNATDYW

SEQ ID NO: 134001 - protein, 10 aa, Homo Sapiens
HTGPVLDVCW

SEQ ID NO: 134002 - protein, 10 aa, Homo Sapiens
HTIGCNAVSW

SEQ ID NO: 134003 - protein, 10 aa, Homo Sapiens
HTLDDRTQLW

SEQ ID NO: 134004 - protein, 10 aa, Homo Sapiens
HTMTDDVTFW

SEQ ID NO: 134005 - protein, 10 aa, Homo Sapiens
HTNEVNAIKW

SEQ ID NO: 134006 - protein, 10 aa, Homo Sapiens
HVAPVTSVEW

SEQ ID NO: 134007 - protein, 10 aa, Homo Sapiens
HVNPYIGLFF

SEQ ID NO: 134008 - protein, 10 aa, Homo Sapiens
HVNRNGDVHW

SEQ ID NO: 134009 - protein, 10 aa, Homo Sapiens
IAANEENRKW

SEQ ID NO: 134010 - protein, 10 aa, Homo Sapiens
IIWREENGTW

SEQ ID NO: 134011 - protein, 10 aa, Homo Sapiens
ISAPDSQVRF

SEQ ID NO: 134012 - protein, 10 aa, Homo Sapiens
ISASSLTSKW

SEQ ID NO: 134013 - protein, 10 aa, Homo Sapiens
ISATEVDSRW

SEQ ID NO: 134014 - protein, 10 aa, Homo Sapiens
ISDPDVRHTW

SEQ ID NO: 134015 - protein, 10 aa, Homo Sapiens
ISEHESNLVW

SEQ ID NO: 134016 - protein, 10 aa, Homo Sapiens
ISEKQHEVYW

SEQ ID NO: 134017 - protein, 10 aa, Homo Sapiens
ISFHNIHNTF

SEQ ID NO: 134018 - protein, 10 aa, Homo Sapiens
ISFYEERLTW

SEQ ID NO: 134019 - protein, 10 aa, Homo Sapiens
ISIRTSSQTF

SEQ ID NO: 134020 - protein, 10 aa, Homo Sapiens
ISLSEPRMLW

SEQ ID NO: 134021 - protein, 10 aa, Homo Sapiens
ISMPDFDLHL

SEQ ID NO: 134022 - protein, 10 aa, Homo Sapiens
ISNPEHLTEW

SEQ ID NO: 134023 - protein, 10 aa, Homo Sapiens
ISQPASGNTF

SEQ ID NO: 134024 - protein, 10 aa, Homo Sapiens
ISSSDLVSKW

SEQ ID NO: 134025 - protein, 10 aa, Homo Sapiens
ISTDGKICSW

SEQ ID NO: 134026 - protein, 10 aa, Homo Sapiens
ISVPGLQTNW

SEQ ID NO: 134027 - protein, 10 aa, Homo Sapiens
ISVRANTENW

SEQ ID NO: 134028 - protein, 10 aa, Homo Sapiens
ISYSEHDSLW

SEQ ID NO: 134029 - protein, 10 aa, Homo Sapiens
ISYSGHDSFW

SEQ ID NO: 134030 - protein, 10 aa, Homo Sapiens
ITFPNKEIAW

SEQ ID NO: 134031 - protein, 10 aa, Homo Sapiens
ITKADAAEFW

SEQ ID NO: 134032 - protein, 10 aa, Homo Sapiens
ITLPTEASTW

SEQ ID NO: 134033 - protein, 10 aa, Homo Sapiens
ITVDGKPPTW

SEQ ID NO: 134034 - protein, 10 aa, Homo Sapiens
IVPRLLFEDW

SEQ ID NO: 134035 - protein, 10 aa, Homo Sapiens
KAATIGQIGW

SEQ ID NO: 134036 - protein, 10 aa, Homo Sapiens
KAFDEKKQKW

SEQ ID NO: 134037 - protein, 10 aa, Homo Sapiens
KAIADRGWRF

SEQ ID NO: 134038 - protein, 10 aa, Homo Sapiens
KAIPDTRLTI

SEQ ID NO: 134039 - protein, 10 aa, Homo Sapiens
KAISSIHSLW

SEQ ID NO: 134040 - protein, 10 aa, Homo Sapiens
KALNHLREIW

SEQ ID NO: 134041 - protein, 10 aa, Homo Sapiens
KANPHNYDAW

SEQ ID NO: 134042 - protein, 10 aa, Homo Sapiens
KANPVNCVFF

SEQ ID NO: 134043 - protein, 10 aa, Homo Sapiens
KAVDIVKQVW

SEQ ID NO: 134044 - protein, 10 aa, Homo Sapiens
KAVIDLNNRW

SEQ ID NO: 134045 - protein, 10 aa, Homo Sapiens
KAVKTGSICW

SEQ ID NO: 134046 - protein, 10 aa, Homo Sapiens
KAVQEGNIQW

SEQ ID NO: 134047 - protein, 10 aa, Homo Sapiens
KAWAEYVVEW

SEQ ID NO: 134048 - protein, 10 aa, Homo Sapiens
KAWRGTLARW

SEQ ID NO: 134049 - protein, 10 aa, Homo Sapiens
KAYDRVEQEW

SEQ ID NO: 134050 - protein, 10 aa, Homo Sapiens
KAYSVQGDKW

SEQ ID NO: 134051 - protein, 10 aa, Homo Sapiens
KFIDPIYQVW

SEQ ID NO: 134052 - protein, 10 aa, Homo Sapiens
KGFGKEHAKW

SEQ ID NO: 134053 - protein, 10 aa, Homo Sapiens
KGFSDEDNTW

SEQ ID NO: 134054 - protein, 10 aa, Homo Sapiens
KGFSEEHNTW

SEQ ID NO: 134055 - protein, 10 aa, Homo Sapiens
KGFTDADNTW

SEQ ID NO: 134056 - protein, 10 aa, Homo Sapiens
KIDPSTLQMW

SEQ ID NO: 134057 - protein, 10 aa, Homo Sapiens
KIEKEIQQKW

SEQ ID NO: 134058 - protein, 10 aa, Homo Sapiens
KIIEDLGVHF

SEQ ID NO: 134059 - protein, 10 aa, Homo Sapiens
KLIDVTNIYW

SEQ ID NO: 134060 - protein, 10 aa, Homo Sapiens
KLLDLKEPTW

SEQ ID NO: 134061 - protein, 10 aa, Homo Sapiens
KLLEGLKLMA

SEQ ID NO: 134062 - protein, 10 aa, Homo Sapiens
KLLPGIEVLW

SEQ ID NO: 134063 - protein, 10 aa, Homo Sapiens
KLMPGRIQLW

SEQ ID NO: 134064 - protein, 10 aa, Homo Sapiens
KLPVHTEISW

SEQ ID NO: 134065 - protein, 10 aa, Homo Sapiens
KLTSTQVKIW

SEQ ID NO: 134066 - protein, 10 aa, Homo Sapiens
KLYPGNQVLW

SEQ ID NO: 134067 - protein, 10 aa, Homo Sapiens
KMAPPDLPHW

SEQ ID NO: 134068 - protein, 10 aa, Homo Sapiens
KMVSDINNGW

SEQ ID NO: 134069 - protein, 10 aa, Homo Sapiens
KQMPDVNVSW

SEQ ID NO: 134070 - protein, 10 aa, Homo Sapiens
KSAEKEISLW

SEQ ID NO: 134071 - protein, 10 aa, Homo Sapiens
KSAKDALLLW

SEQ ID NO: 134072 - protein, 10 aa, Homo Sapiens
KSAPELKTGI

SEQ ID NO: 134073 - protein, 10 aa, Homo Sapiens
KSAPSDSLTY

SEQ ID NO: 134074 - protein, 10 aa, Homo Sapiens
KSATDTSAKW

SEQ ID NO: 134075 - protein, 10 aa, Homo Sapiens
KSCSKLFQRW

SEQ ID NO: 134076 - protein, 10 aa, Homo Sapiens
KSEALKDRHW

SEQ ID NO: 134077 - protein, 10 aa, Homo Sapiens
KSENAGAQGW

SEQ ID NO: 134078 - protein, 10 aa, Homo Sapiens
KSFEGNVFMY

SEQ ID NO: 134079 - protein, 10 aa, Homo Sapiens
KSFEKAKESW

SEQ ID NO: 134080 - protein, 10 aa, Homo Sapiens
KSFPHPIDKW

SEQ ID NO: 134081 - protein, 10 aa, Homo Sapiens
KSFSESGINY

SEQ ID NO: 134082 - protein, 10 aa, Homo Sapiens
KSGPVVSLGW

SEQ ID NO: 134083 - protein, 10 aa, Homo Sapiens
KSHPFTNPRW

SEQ ID NO: 134084 - protein, 10 aa, Homo Sapiens
KSHYDEAYKW

SEQ ID NO: 134085 - protein, 10 aa, Homo Sapiens
KSIDELNSAW

SEQ ID NO: 134086 - protein, 10 aa, Homo Sapiens
KSIDEMNNAW

SEQ ID NO: 134087 - protein, 10 aa, Homo Sapiens
KSIEFLSSKW

SEQ ID NO: 134088 - protein, 10 aa, Homo Sapiens
KSIGDIFLKY

SEQ ID NO: 134089 - protein, 10 aa, Homo Sapiens
KSITEINANF

SEQ ID NO: 134090 - protein, 10 aa, Homo Sapiens
KSITIIGGGF

SEQ ID NO: 134091 - protein, 10 aa, Homo Sapiens
KSKGSQTEEW

SEQ ID NO: 134092 - protein, 10 aa, Homo Sapiens
KSLDLLTMKN

SEQ ID NO: 134093 - protein, 10 aa, Homo Sapiens
KSLFDRKHYF

SEQ ID NO: 134094 - protein, 10 aa, Homo Sapiens
KSLIEEGGDW

SEQ ID NO: 134095 - protein, 10 aa, Homo Sapiens
KSLIIVHPSW

SEQ ID NO: 134096 - protein, 10 aa, Homo Sapiens
KSLNIFGSSW

SEQ ID NO: 134097 - protein, 10 aa, Homo Sapiens
KSLPAEINRM

SEQ ID NO: 134098 - protein, 10 aa, Homo Sapiens
KSLPASLSFL

SEQ ID NO: 134099 - protein, 10 aa, Homo Sapiens
KSLPVSVPVW

SEQ ID NO: 134100 - protein, 10 aa, Homo Sapiens
KSLSAERERW

SEQ ID NO: 134101 - protein, 10 aa, Homo Sapiens
KSLSLNPFLW

SEQ ID NO: 134102 - protein, 10 aa, Homo Sapiens
KSLTEEAENW

SEQ ID NO: 134103 - protein, 10 aa, Homo Sapiens
KSLYAIFSQF

SEQ ID NO: 134104 - protein, 10 aa, Homo Sapiens
KSMYGVYNTF

SEQ ID NO: 134105 - protein, 10 aa, Homo Sapiens
KSNEDLHKLW

SEQ ID NO: 134106 - protein, 10 aa, Homo Sapiens
KSNQTDAIKW

SEQ ID NO: 134107 - protein, 10 aa, Homo Sapiens
KSSIAGSSTW

SEQ ID NO: 134108 - protein, 10 aa, Homo Sapiens
KSTPYTAVRW

SEQ ID NO: 134109 - protein, 10 aa, Homo Sapiens
KSVDDHIVRF

SEQ ID NO: 134110 - protein, 10 aa, Homo Sapiens
KSVENLGVSY

SEQ ID NO: 134111 - protein, 10 aa, Homo Sapiens
KSVFVKNVGW

SEQ ID NO: 134112 - protein, 10 aa, Homo Sapiens
KSVIDYQTHF

SEQ ID NO: 134113 - protein, 10 aa, Homo Sapiens
KSVQNSITQW

SEQ ID NO: 134114 - protein, 10 aa, Homo Sapiens
KSVSFSDVFF

SEQ ID NO: 134115 - protein, 10 aa, Homo Sapiens
KSVTADTEMW

SEQ ID NO: 134116 - protein, 10 aa, Homo Sapiens
KTAEEIKQIW

SEQ ID NO: 134117 - protein, 10 aa, Homo Sapiens
KTEASETRKW

SEQ ID NO: 134118 - protein, 10 aa, Homo Sapiens
KTENVMVTSW

SEQ ID NO: 134119 - protein, 10 aa, Homo Sapiens
KTFPHPIDKW

SEQ ID NO: 134120 - protein, 10 aa, Homo Sapiens
KTHLMSEEEW

SEQ ID NO: 134121 - protein, 10 aa, Homo Sapiens
KTHPYNPLWA

SEQ ID NO: 134122 - protein, 10 aa, Homo Sapiens
KTIDICHDHF

SEQ ID NO: 134123 - protein, 10 aa, Homo Sapiens
KTIEGIYEKF

SEQ ID NO: 134124 - protein, 10 aa, Homo Sapiens
KTIGGGDDSF

SEQ ID NO: 134125 - protein, 10 aa, Homo Sapiens
KTLAEINQKW

SEQ ID NO: 134126 - protein, 10 aa, Homo Sapiens
KTLEDNSEKW

SEQ ID NO: 134127 - protein, 10 aa, Homo Sapiens
KTLHDTRTHF

SEQ ID NO: 134128 - protein, 10 aa, Homo Sapiens
KTLPADVQNY

SEQ ID NO: 134129 - protein, 10 aa, Homo Sapiens
KTLPFYKDYF

SEQ ID NO: 134130 - protein, 10 aa, Homo Sapiens
KTLSDIFLLF

SEQ ID NO: 134131 - protein, 10 aa, Homo Sapiens
KTLSTFKESW

SEQ ID NO: 134132 - protein, 10 aa, Homo Sapiens
KTLTDISNQW

SEQ ID NO: 134133 - protein, 10 aa, Homo Sapiens
KTMDPSCLKW

SEQ ID NO: 134134 - protein, 10 aa, Homo Sapiens
KTNIQKEATW

SEQ ID NO: 134135 - protein, 10 aa, Homo Sapiens
KTNTFQGVIF

SEQ ID NO: 134136 - protein, 10 aa, Homo Sapiens
KTPEKEPPLW

SEQ ID NO: 134137 - protein, 10 aa, Homo Sapiens
KTPVDGQYVW

SEQ ID NO: 134138 - protein, 10 aa, Homo Sapiens
KTQGGHVYMW

SEQ ID NO: 134139 - protein, 10 aa, Homo Sapiens
KTSDSTFLVF

SEQ ID NO: 134140 - protein, 10 aa, Homo Sapiens
KTVAGGAWTY

SEQ ID NO: 134141 - protein, 10 aa, Homo Sapiens
KTVIDSQTHY

SEQ ID NO: 134142 - protein, 10 aa, Homo Sapiens
KTYGEIFEKF

SEQ ID NO: 134143 - protein, 10 aa, Homo Sapiens
KVFESWMHHW

SEQ ID NO: 134144 - protein, 10 aa, Homo Sapiens
KVHPVIPAMW

SEQ ID NO: 134145 - protein, 10 aa, Homo Sapiens
KVIAEDEVLW

SEQ ID NO: 134146 - protein, 10 aa, Homo Sapiens
KVLEEHGEWW

SEQ ID NO: 134147 - protein, 10 aa, Homo Sapiens
KVLIDIREYW

SEQ ID NO: 134148 - protein, 10 aa, Homo Sapiens
KVLPPLEQVW

SEQ ID NO: 134149 - protein, 10 aa, Homo Sapiens
KVMPYVDILF

SEQ ID NO: 134150 - protein, 10 aa, Homo Sapiens
KVQDFQGNLW

SEQ ID NO: 134151 - protein, 10 aa, Homo Sapiens
LAADGKSTTW

SEQ ID NO: 134152 - protein, 10 aa, Homo Sapiens
LACGVAKVLW

SEQ ID NO: 134153 - protein, 10 aa, Homo Sapiens
LALPPGAEHW

SEQ ID NO: 134154 - protein, 10 aa, Homo Sapiens
LAVGDNNSKW

SEQ ID NO: 134155 - protein, 10 aa, Homo Sapiens
LEVDNKEALW

SEQ ID NO: 134156 - protein, 10 aa, Homo Sapiens
LSAHGIVVAW

SEQ ID NO: 134157 - protein, 10 aa, Homo Sapiens
LSALCLLGAW

SEQ ID NO: 134158 - protein, 10 aa, Homo Sapiens
LSALDKGSTH

SEQ ID NO: 134159 - protein, 10 aa, Homo Sapiens
LSARDFGERW

SEQ ID NO: 134160 - protein, 10 aa, Homo Sapiens
LSFIRDEVTW

SEQ ID NO: 134161 - protein, 10 aa, Homo Sapiens
LSIPDIKTAF

SEQ ID NO: 134162 - protein, 10 aa, Homo Sapiens
LSLPADLTKM

SEQ ID NO: 134163 - protein, 10 aa, Homo Sapiens
LSLPDIKVYL

SEQ ID NO: 134164 - protein, 10 aa, Homo Sapiens
LSLRDITSSW

SEQ ID NO: 134165 - protein, 10 aa, Homo Sapiens
LSMPASLGRM

SEQ ID NO: 134166 - protein, 10 aa, Homo Sapiens
LSNAKDVAHW

SEQ ID NO: 134167 - protein, 10 aa, Homo Sapiens
LSSPDDAVIW

SEQ ID NO: 134168 - protein, 10 aa, Homo Sapiens
LSSPDYQIRW

SEQ ID NO: 134169 - protein, 10 aa, Homo Sapiens
LSSRGSCDSL

SEQ ID NO: 134170 - protein, 10 aa, Homo Sapiens
LSTHDPNITW

SEQ ID NO: 134171 - protein, 10 aa, Homo Sapiens
LSTPEGKWQW

SEQ ID NO: 134172 - protein, 10 aa, Homo Sapiens
LSTSIPEAQW

SEQ ID NO: 134173 - protein, 10 aa, Homo Sapiens
LSVKEPQLVW

SEQ ID NO: 134174 - protein, 10 aa, Homo Sapiens
LSVKGTLQQF

SEQ ID NO: 134175 - protein, 10 aa, Homo Sapiens
LSVQPYSQEW

SEQ ID NO: 134176 - protein, 10 aa, Homo Sapiens
LTIATGTGNW

SEQ ID NO: 134177 - protein, 10 aa, Homo Sapiens
LTMSDVQIHW

SEQ ID NO: 134178 - protein, 10 aa, Homo Sapiens
LTNKGELFVW

SEQ ID NO: 134179 - protein, 10 aa, Homo Sapiens
LTWPEGKVLW

SEQ ID NO: 134180 - protein, 10 aa, Homo Sapiens
LVAEVPKEHW

SEQ ID NO: 134181 - protein, 10 aa, Homo Sapiens
MAFQNDVYEW

SEQ ID NO: 134182 - protein, 10 aa, Homo Sapiens
MSESELGRKW

SEQ ID NO: 134183 - protein, 10 aa, Homo Sapiens
MTTRELQQYW

SEQ ID NO: 134184 - protein, 10 aa, Homo Sapiens
NSGPVVAMVW

SEQ ID NO: 134185 - protein, 10 aa, Homo Sapiens
NSIKELNERW

SEQ ID NO: 134186 - protein, 10 aa, Homo Sapiens
PAASSFGSPG

SEQ ID NO: 134187 - protein, 10 aa, Homo Sapiens
QMEKIVRITW

SEQ ID NO: 134188 - protein, 10 aa, Homo Sapiens
QSITSGKHYW

SEQ ID NO: 134189 - protein, 10 aa, Homo Sapiens
QSLKDSEQKW

SEQ ID NO: 134190 - protein, 10 aa, Homo Sapiens
QSLKELLQNW

SEQ ID NO: 134191 - protein, 10 aa, Homo Sapiens
QSLPDFGISY

SEQ ID NO: 134192 - protein, 10 aa, Homo Sapiens
QSVALLEQKW

SEQ ID NO: 134193 - protein, 10 aa, Homo Sapiens
QTVKDSRTVY

SEQ ID NO: 134194 - protein, 10 aa, Homo Sapiens
RAAADGSLQW

SEQ ID NO: 134195 - protein, 10 aa, Homo Sapiens
RAADCEVEQW

SEQ ID NO: 134196 - protein, 10 aa, Homo Sapiens
RAAEPVRVVW

SEQ ID NO: 134197 - protein, 10 aa, Homo Sapiens
RAAPDPPPLF

SEQ ID NO: 134198 - protein, 10 aa, Homo Sapiens
RAFEDVKVFW

SEQ ID NO: 134199 - protein, 10 aa, Homo Sapiens
RAIDSIHQLW

SEQ ID NO: 134200 - protein, 10 aa, Homo Sapiens
RAIDTDSNLW

SEQ ID NO: 134201 - protein, 10 aa, Homo Sapiens
RAIEALLQYW

SEQ ID NO: 134202 - protein, 10 aa, Homo Sapiens
RAIKQLDYEW

SEQ ID NO: 134203 - protein, 10 aa, Homo Sapiens
RAMQDMQLLW

SEQ ID NO: 134204 - protein, 10 aa, Homo Sapiens
RAVDDGVNTF

SEQ ID NO: 134205 - protein, 10 aa, Homo Sapiens
RAVGHEPEHW

SEQ ID NO: 134206 - protein, 10 aa, Homo Sapiens
RGIDIPEVNW

SEQ ID NO: 134207 - protein, 10 aa, Homo Sapiens
RGVGDIKILW

SEQ ID NO: 134208 - protein, 10 aa, Homo Sapiens
RGYPDSESTW

SEQ ID NO: 134209 - protein, 10 aa, Homo Sapiens
RIESVIKELW

SEQ ID NO: 134210 - protein, 10 aa, Homo Sapiens
RIFEDYTVSW

SEQ ID NO: 134211 - protein, 10 aa, Homo Sapiens
RILDLIDDAW

SEQ ID NO: 134212 - protein, 10 aa, Homo Sapiens
RILGSDTESW

SEQ ID NO: 134213 - protein, 10 aa, Homo Sapiens
RLIPQPAFQW

SEQ ID NO: 134214 - protein, 10 aa, Homo Sapiens
RMISLIESGW

SEQ ID NO: 134215 - protein, 10 aa, Homo Sapiens
RMLGQCTQTW

SEQ ID NO: 134216 - protein, 10 aa, Homo Sapiens
RMLSFQQMTW

SEQ ID NO: 134217 - protein, 10 aa, Homo Sapiens
RMYPLKPTWW

SEQ ID NO: 134218 - protein, 10 aa, Homo Sapiens
RSADEPMTTF

SEQ ID NO: 134219 - protein, 10 aa, Homo Sapiens
RSAPPGPFAW

SEQ ID NO: 134220 - protein, 10 aa, Homo Sapiens
RSAPSEGDEW

SEQ ID NO: 134221 - protein, 10 aa, Homo Sapiens
RSARDTAQIF

SEQ ID NO: 134222 - protein, 10 aa, Homo Sapiens
RSATCAQVNW

SEQ ID NO: 134223 - protein, 10 aa, Homo Sapiens
RSCDAKVDVW

SEQ ID NO: 134224 - protein, 10 aa, Homo Sapiens
RSCTVEAVRW

SEQ ID NO: 134225 - protein, 10 aa, Homo Sapiens
RSESHMEWTW

SEQ ID NO: 134226 - protein, 10 aa, Homo Sapiens
RSFCDLTDEW

SEQ ID NO: 134227 - protein, 10 aa, Homo Sapiens
RSFKETTNRW

SEQ ID NO: 134228 - protein, 10 aa, Homo Sapiens
RSGPAGTCRW

SEQ ID NO: 134229 - protein, 10 aa, Homo Sapiens
RSGQNGNQTW

SEQ ID NO: 134230 - protein, 10 aa, Homo Sapiens
RSIEEVYYLW

SEQ ID NO: 134231 - protein, 10 aa, Homo Sapiens
RSIKEKISMW

SEQ ID NO: 134232 - protein, 10 aa, Homo Sapiens
RSIPAITRYW

SEQ ID NO: 134233 - protein, 10 aa, Homo Sapiens
RSIQADGLVW

SEQ ID NO: 134234 - protein, 10 aa, Homo Sapiens
RSIQLDGLVW

SEQ ID NO: 134235 - protein, 10 aa, Homo Sapiens
RSLKDALFKW

SEQ ID NO: 134236 - protein, 10 aa, Homo Sapiens
RSLKDHKVSF

SEQ ID NO: 134237 - protein, 10 aa, Homo Sapiens
RSLNQTGVQW

SEQ ID NO: 134238 - protein, 10 aa, Homo Sapiens
RSLPEPLMTY

SEQ ID NO: 134239 - protein, 10 aa, Homo Sapiens
RSLPIVFDEF

SEQ ID NO: 134240 - protein, 10 aa, Homo Sapiens
RSLPRDTSNW

SEQ ID NO: 134241 - protein, 10 aa, Homo Sapiens
RSLTTLSEQW

SEQ ID NO: 134242 - protein, 10 aa, Homo Sapiens
RSLVPAAVVW

SEQ ID NO: 134243 - protein, 10 aa, Homo Sapiens
RSLWGPYAGW

SEQ ID NO: 134244 - protein, 10 aa, Homo Sapiens
RSMQLDYTTW

SEQ ID NO: 134245 - protein, 10 aa, Homo Sapiens
RSNGSYVDGW

SEQ ID NO: 134246 - protein, 10 aa, Homo Sapiens
RSQSSELTKW

SEQ ID NO: 134247 - protein, 10 aa, Homo Sapiens
RSRDISREEW

SEQ ID NO: 134248 - protein, 10 aa, Homo Sapiens
RSRVDQEERW

SEQ ID NO: 134249 - protein, 10 aa, Homo Sapiens
RSSQTGDWTW

SEQ ID NO: 134250 - protein, 10 aa, Homo Sapiens
RSSSLSDFSW

SEQ ID NO: 134251 - protein, 10 aa, Homo Sapiens
RSTHEAVARW

SEQ ID NO: 134252 - protein, 10 aa, Homo Sapiens
RSVAQAGVQW

SEQ ID NO: 134253 - protein, 10 aa, Homo Sapiens
RSVDVTNTTF

SEQ ID NO: 134254 - protein, 10 aa, Homo Sapiens
RSVEDLKERY

SEQ ID NO: 134255 - protein, 10 aa, Homo Sapiens
RSVEEPREFW

SEQ ID NO: 134256 - protein, 10 aa, Homo Sapiens
RSVLDNRARF

SEQ ID NO: 134257 - protein, 10 aa, Homo Sapiens
RSVNIKEICW

SEQ ID NO: 134258 - protein, 10 aa, Homo Sapiens
RSVPTNKVCF

SEQ ID NO: 134259 - protein, 10 aa, Homo Sapiens
RSVPTSTVFY

SEQ ID NO: 134260 - protein, 10 aa, Homo Sapiens
RSVQVIGGIW

SEQ ID NO: 134261 - protein, 10 aa, Homo Sapiens
RSVTQAGVQW

SEQ ID NO: 134262 - protein, 10 aa, Homo Sapiens
RSYQLEGVNW

SEQ ID NO: 134263 - protein, 10 aa, Homo Sapiens
RSYSESEKQW

SEQ ID NO: 134264 - protein, 10 aa, Homo Sapiens
RTAKALQAHW

SEQ ID NO: 134265 - protein, 10 aa, Homo Sapiens
RTAPFHLDLW

SEQ ID NO: 134266 - protein, 10 aa, Homo Sapiens
RTAQLAKIKW

SEQ ID NO: 134267 - protein, 10 aa, Homo Sapiens
RTCEWTGLKF

SEQ ID NO: 134268 - protein, 10 aa, Homo Sapiens
RTCQVKTGTW

SEQ ID NO: 134269 - protein, 10 aa, Homo Sapiens
RTEAILKASW

SEQ ID NO: 134270 - protein, 10 aa, Homo Sapiens
RTEEMKWRQW

SEQ ID NO: 134271 - protein, 10 aa, Homo Sapiens
RTFTDHVMLF

SEQ ID NO: 134272 - protein, 10 aa, Homo Sapiens
RTILVDNNTW

SEQ ID NO: 134273 - protein, 10 aa, Homo Sapiens
RTIQELFEVY

SEQ ID NO: 134274 - protein, 10 aa, Homo Sapiens
RTLLESCVKW

SEQ ID NO: 134275 - protein, 10 aa, Homo Sapiens
RTLPTKEFLW

SEQ ID NO: 134276 - protein, 10 aa, Homo Sapiens
RTMELLTQNW

SEQ ID NO: 134277 - protein, 10 aa, Homo Sapiens
RTMNIKSATW

SEQ ID NO: 134278 - protein, 10 aa, Homo Sapiens
RTNPICSMTW

SEQ ID NO: 134279 - protein, 10 aa, Homo Sapiens
RTTHLHNDLW

SEQ ID NO: 134280 - protein, 10 aa, Homo Sapiens
RTTLVDNNTW

SEQ ID NO: 134281 - protein, 10 aa, Homo Sapiens
RTVPGALGAW

SEQ ID NO: 134282 - protein, 10 aa, Homo Sapiens
RVDPDVAQHW

SEQ ID NO: 134283 - protein, 10 aa, Homo Sapiens
RVENVKGAVW

SEQ ID NO: 134284 - protein, 10 aa, Homo Sapiens
RVFPDKGYSF

SEQ ID NO: 134285 - protein, 10 aa, Homo Sapiens
RVFPEKGYSF

SEQ ID NO: 134286 - protein, 10 aa, Homo Sapiens
RVINEEYKIW

SEQ ID NO: 134287 - protein, 10 aa, Homo Sapiens
RVLKEDKERW

SEQ ID NO: 134288 - protein, 10 aa, Homo Sapiens
RVSPALGITW

SEQ ID NO: 134289 - protein, 10 aa, Homo Sapiens
SAQGSESHSL

SEQ ID NO: 134290 - protein, 10 aa, Homo Sapiens
SAYDSKADIW

SEQ ID NO: 134291 - protein, 10 aa, Homo Sapiens
SDPDEVARRW

SEQ ID NO: 134292 - protein, 10 aa, Homo Sapiens
SIDPNTYITW

SEQ ID NO: 134293 - protein, 10 aa, Homo Sapiens
SKSVGQILLW

SEQ ID NO: 134294 - protein, 10 aa, Homo Sapiens
SPSSSPTHLW

SEQ ID NO: 134295 - protein, 10 aa, Homo Sapiens
SSACLIGDAW

SEQ ID NO: 134296 - protein, 10 aa, Homo Sapiens
SSFASSHEVW

SEQ ID NO: 134297 - protein, 10 aa, Homo Sapiens
SSGPSDKMKW

SEQ ID NO: 134298 - protein, 10 aa, Homo Sapiens
SSLGAPVHLW

SEQ ID NO: 134299 - protein, 10 aa, Homo Sapiens
STAREIECFW

SEQ ID NO: 134300 - protein, 10 aa, Homo Sapiens
STDGSCTVRW

SEQ ID NO: 134301 - protein, 10 aa, Homo Sapiens
STLRELGQTW

SEQ ID NO: 134302 - protein, 10 aa, Homo Sapiens
SVIKNLQSRW

SEQ ID NO: 134303 - protein, 10 aa, Homo Sapiens
TAQSDNKITW

SEQ ID NO: 134304 - protein, 10 aa, Homo Sapiens
TIPDIKKDRW

SEQ ID NO: 134305 - protein, 10 aa, Homo Sapiens
TSDPGGLASW

SEQ ID NO: 134306 - protein, 10 aa, Homo Sapiens
TSLPLDFGTW

SEQ ID NO: 134307 - protein, 10 aa, Homo Sapiens
TSLVSDGETW

SEQ ID NO: 134308 - protein, 10 aa, Homo Sapiens
TSSSSVRVEW

SEQ ID NO: 134309 - protein, 10 aa, Homo Sapiens
TVDIPENVDI

SEQ ID NO: 134310 - protein, 10 aa, Homo Sapiens
TVDPCHKFTW

SEQ ID NO: 134311 - protein, 10 aa, Homo Sapiens
VAIKDKQVKY

SEQ ID NO: 134312 - protein, 10 aa, Homo Sapiens
VIVPADPTLW

SEQ ID NO: 134313 - protein, 10 aa, Homo Sapiens
VLDPHTSHSW

SEQ ID NO: 134314 - protein, 10 aa, Homo Sapiens
VSAKEKYYVW

SEQ ID NO: 134315 - protein, 10 aa, Homo Sapiens
VSDPLSDLKW

SEQ ID NO: 134316 - protein, 10 aa, Homo Sapiens
VSEAGTHQEW

SEQ ID NO: 134317 - protein, 10 aa, Homo Sapiens
VSGPSGSDLW

SEQ ID NO: 134318 - protein, 10 aa, Homo Sapiens
VSHPDAGAAW

SEQ ID NO: 134319 - protein, 10 aa, Homo Sapiens
VSIFPDSGHF

SEQ ID NO: 134320 - protein, 10 aa, Homo Sapiens
VSILESLDKW

SEQ ID NO: 134321 - protein, 10 aa, Homo Sapiens
VSLDETQHIW

SEQ ID NO: 134322 - protein, 10 aa, Homo Sapiens
VSQKISKTRW

SEQ ID NO: 134323 - protein, 10 aa, Homo Sapiens
VSVPDTGSIW

SEQ ID NO: 134324 - protein, 10 aa, Homo Sapiens
VSWDEKGMTW

SEQ ID NO: 134325 - protein, 10 aa, Homo Sapiens
VTARLVGVLW

SEQ ID NO: 134326 - protein, 10 aa, Homo Sapiens
VTIRDYGVSW

SEQ ID NO: 134327 - protein, 10 aa, Homo Sapiens
VTNKSQIRTW

SEQ ID NO: 134328 - protein, 10 aa, Homo Sapiens
VTVPANVQRW

SEQ ID NO: 134329 - protein, 10 aa, Homo Sapiens
YACRVNHVTL

SEQ ID NO: 134330 - protein, 10 aa, Homo Sapiens
YADKNLIAKW

SEQ ID NO: 134331 - protein, 10 aa, Homo Sapiens
YSESLVHESW

SEQ ID NO: 134332 - protein, 10 aa, Homo Sapiens
YSVDENGQRW

SEQ ID NO: 134333 - protein, 10 aa, Homo Sapiens
YSVKGQEDGW

SEQ ID NO: 134334 - protein, 10 aa, Homo Sapiens
YTNHFTQEQW

SEQ ID NO: 134335 - protein, 10 aa, Homo Sapiens
YTVKISNYGW

SEQ ID NO: 134336 - protein, 11 aa, Homo Sapiens
AACPDPSLSVW

SEQ ID NO: 134337 - protein, 11 aa, Homo Sapiens
AACPVLVGNKW

SEQ ID NO: 134338 - protein, 11 aa, Homo Sapiens
AAFNKDALLNW

SEQ ID NO: 134339 - protein, 11 aa, Homo Sapiens
AAFPAEKESEW

SEQ ID NO: 134340 - protein, 11 aa, Homo Sapiens
AALDSRKNYNW

SEQ ID NO: 134341 - protein, 11 aa, Homo Sapiens
AAWRDEDDYTW

SEQ ID NO: 134342 - protein, 11 aa, Homo Sapiens
AEQRGELAIKD

SEQ ID NO: 134343 - protein, 11 aa, Homo Sapiens
AREGNHKPIDY

SEQ ID NO: 134344 - protein, 11 aa, Homo Sapiens
ASGIRGAQAGW

SEQ ID NO: 134345 - protein, 11 aa, Homo Sapiens
ASIKDPKDLKF

SEQ ID NO: 134346 - protein, 11 aa, Homo Sapiens
ASITSEVFNKF

SEQ ID NO: 134347 - protein, 11 aa, Homo Sapiens
ASLDLMIRLLE

SEQ ID NO: 134348 - protein, 11 aa, Homo Sapiens
ASLPSELIVHI

SEQ ID NO: 134349 - protein, 11 aa, Homo Sapiens
ASLQNERDHLW

SEQ ID NO: 134350 - protein, 11 aa, Homo Sapiens
ASMPRDIYQDY

SEQ ID NO: 134351 - protein, 11 aa, Homo Sapiens
ASVSEHQPTTW

SEQ ID NO: 134352 - protein, 11 aa, Homo Sapiens
ASYSGKAADVW

SEQ ID NO: 134353 - protein, 11 aa, Homo Sapiens
ATDPNILGRTW

SEQ ID NO: 134354 - protein, 11 aa, Homo Sapiens
ATFHQRGIALW

SEQ ID NO: 134355 - protein, 11 aa, Homo Sapiens
ATIKDIREHEW

SEQ ID NO: 134356 - protein, 11 aa, Homo Sapiens
ATVASGIPAGW

SEQ ID NO: 134357 - protein, 11 aa, Homo Sapiens
ATVPNTIVVNW

SEQ ID NO: 134358 - protein, 11 aa, Homo Sapiens
AVSTIETVPYW

SEQ ID NO: 134359 - protein, 11 aa, Homo Sapiens
DTGRPSTTVRY

SEQ ID NO: 134360 - protein, 11 aa, Homo Sapiens
FAYKDQNENRW

SEQ ID NO: 134361 - protein, 11 aa, Homo Sapiens
FGDPASSLFRW

SEQ ID NO: 134362 - protein, 11 aa, Homo Sapiens
FSDKESGKQKF

SEQ ID NO: 134363 - protein, 11 aa, Homo Sapiens
GLSSILDAARW

SEQ ID NO: 134364 - protein, 11 aa, Homo Sapiens
GSDTSDIVHIW

SEQ ID NO: 134365 - protein, 11 aa, Homo Sapiens
GTFEYEYSQRW

SEQ ID NO: 134366 - protein, 11 aa, Homo Sapiens
HSEAKTSGLLW

SEQ ID NO: 134367 - protein, 11 aa, Homo Sapiens
HSFNQSSSSQW

SEQ ID NO: 134368 - protein, 11 aa, Homo Sapiens
HSFYPTPALQW

SEQ ID NO: 134369 - protein, 11 aa, Homo Sapiens
HSMRQAELAQW

SEQ ID NO: 134370 - protein, 11 aa, Homo Sapiens
HSVTASGAEHW

SEQ ID NO: 134371 - protein, 11 aa, Homo Sapiens
HSYPNPEYDNW

SEQ ID NO: 134372 - protein, 11 aa, Homo Sapiens
HTAPSGVGSSW

SEQ ID NO: 134373 - protein, 11 aa, Homo Sapiens
HTFFDHQDQVW

SEQ ID NO: 134374 - protein, 11 aa, Homo Sapiens
HTNQDHVHAVW

SEQ ID NO: 134375 - protein, 11 aa, Homo Sapiens
ISAPDKRIYQF

SEQ ID NO: 134376 - protein, 11 aa, Homo Sapiens
ISDHEATLRCW

SEQ ID NO: 134377 - protein, 11 aa, Homo Sapiens
ISDSNPFLTQW

SEQ ID NO: 134378 - protein, 11 aa, Homo Sapiens
ISKKHTLGEVW

SEQ ID NO: 134379 - protein, 11 aa, Homo Sapiens
ISKPVGFGEEF

SEQ ID NO: 134380 - protein, 11 aa, Homo Sapiens
ISLPTSKNWTF

SEQ ID NO: 134381 - protein, 11 aa, Homo Sapiens
ISMANDLKEVW

SEQ ID NO: 134382 - protein, 11 aa, Homo Sapiens
ISNPVTKEMLF

SEQ ID NO: 134383 - protein, 11 aa, Homo Sapiens
ISVHDSVISQW

SEQ ID NO: 134384 - protein, 11 aa, Homo Sapiens
ITIPDIKKDRW

SEQ ID NO: 134385 - protein, 11 aa, Homo Sapiens
ITQKALQSQSW

SEQ ID NO: 134386 - protein, 11 aa, Homo Sapiens
ITQKEFMNQHW

SEQ ID NO: 134387 - protein, 11 aa, Homo Sapiens
IVDPNGLARLW

SEQ ID NO: 134388 - protein, 11 aa, Homo Sapiens
KAAKDKGFAKW

SEQ ID NO: 134389 - protein, 11 aa, Homo Sapiens
KAFPHSSSLRY

SEQ ID NO: 134390 - protein, 11 aa, Homo Sapiens
KAHLTSAADIW

SEQ ID NO: 134391 - protein, 11 aa, Homo Sapiens
KAIEEGVNHMW

SEQ ID NO: 134392 - protein, 11 aa, Homo Sapiens
KAITTSLTTKW

SEQ ID NO: 134393 - protein, 11 aa, Homo Sapiens
KALKEKEKASW

SEQ ID NO: 134394 - protein, 11 aa, Homo Sapiens
KALPSPAATIW

SEQ ID NO: 134395 - protein, 11 aa, Homo Sapiens
KAQQDKLNTRW

SEQ ID NO: 134396 - protein, 11 aa, Homo Sapiens
KASGFEESMKW

SEQ ID NO: 134397 - protein, 11 aa, Homo Sapiens
KAVDCLLDSKW

SEQ ID NO: 134398 - protein, 11 aa, Homo Sapiens
KGDPQSPGRHW

SEQ ID NO: 134399 - protein, 11 aa, Homo Sapiens
KGFYDKDSSGW

SEQ ID NO: 134400 - protein, 11 aa, Homo Sapiens
KIHPQTIIAGW

SEQ ID NO: 134401 - protein, 11 aa, Homo Sapiens
KIQPDTIIQVW

SEQ ID NO: 134402 - protein, 11 aa, Homo Sapiens
KIYENEDQLLW

SEQ ID NO: 134403 - protein, 11 aa, Homo Sapiens
KLKPFIDREWW

SEQ ID NO: 134404 - protein, 11 aa, Homo Sapiens
KLSPEELLLRW

SEQ ID NO: 134405 - protein, 11 aa, Homo Sapiens
KLYEEKTGNAW

SEQ ID NO: 134406 - protein, 11 aa, Homo Sapiens
KNINIPTLFQW

SEQ ID NO: 134407 - protein, 11 aa, Homo Sapiens
KSANSELGGIW

SEQ ID NO: 134408 - protein, 11 aa, Homo Sapiens
KSCGIQDIFVF

SEQ ID NO: 134409 - protein, 11 aa, Homo Sapiens
KSDASLLGSLW

SEQ ID NO: 134410 - protein, 11 aa, Homo Sapiens
KSEEITTGSAW

SEQ ID NO: 134411 - protein, 11 aa, Homo Sapiens
KSFEGNVFMYY

SEQ ID NO: 134412 - protein, 11 aa, Homo Sapiens
KSFETDTNLNF

SEQ ID NO: 134413 - protein, 11 aa, Homo Sapiens
KSFGSAQEFAW

SEQ ID NO: 134414 - protein, 11 aa, Homo Sapiens
KSFGWPSFITY

SEQ ID NO: 134415 - protein, 11 aa, Homo Sapiens
KSFIQKKMQNW

SEQ ID NO: 134416 - protein, 11 aa, Homo Sapiens
KSFLPEVVNTW

SEQ ID NO: 134417 - protein, 11 aa, Homo Sapiens
KSFPDTGSLNL

SEQ ID NO: 134418 - protein, 11 aa, Homo Sapiens
KSFSDTLKTYF

SEQ ID NO: 134419 - protein, 11 aa, Homo Sapiens
KSFSKSDLVNW

SEQ ID NO: 134420 - protein, 11 aa, Homo Sapiens
KSIANQIQEDW

SEQ ID NO: 134421 - protein, 11 aa, Homo Sapiens
KSIDAGPVDAW

SEQ ID NO: 134422 - protein, 11 aa, Homo Sapiens
KSIEDFAHSSF

SEQ ID NO: 134423 - protein, 11 aa, Homo Sapiens
KSIPSAEVEKW

SEQ ID NO: 134424 - protein, 11 aa, Homo Sapiens
KSKAMTGVEQW

SEQ ID NO: 134425 - protein, 11 aa, Homo Sapiens
KSKLDAEVSKW

SEQ ID NO: 134426 - protein, 11 aa, Homo Sapiens
KSLDEAIDMRF

SEQ ID NO: 134427 - protein, 11 aa, Homo Sapiens
KSLKENLARCW

SEQ ID NO: 134428 - protein, 11 aa, Homo Sapiens
KSLKVDPRACF

SEQ ID NO: 134429 - protein, 11 aa, Homo Sapiens
KSLPCFEPYEF

SEQ ID NO: 134430 - protein, 11 aa, Homo Sapiens
KSLPEEDVAEI

SEQ ID NO: 134431 - protein, 11 aa, Homo Sapiens
KSLPEFPDSGF

SEQ ID NO: 134432 - protein, 11 aa, Homo Sapiens
KSLPKATVESW

SEQ ID NO: 134433 - protein, 11 aa, Homo Sapiens
KSLPSEASEQY

SEQ ID NO: 134434 - protein, 11 aa, Homo Sapiens
KSMETHIMHTF

SEQ ID NO: 134435 - protein, 11 aa, Homo Sapiens
KSNEDQSMGNW

SEQ ID NO: 134436 - protein, 11 aa, Homo Sapiens
KSRPLGAEDLW

SEQ ID NO: 134437 - protein, 11 aa, Homo Sapiens
KSSPQIPHQTY

SEQ ID NO: 134438 - protein, 11 aa, Homo Sapiens
KSTPTGLFGYW

SEQ ID NO: 134439 - protein, 11 aa, Homo Sapiens
KSTSGLTDITW

SEQ ID NO: 134440 - protein, 11 aa, Homo Sapiens
KSVGKIEHSFW

SEQ ID NO: 134441 - protein, 11 aa, Homo Sapiens
KSVSAAEQQLW

SEQ ID NO: 134442 - protein, 11 aa, Homo Sapiens
KSVTAHLAAKW

SEQ ID NO: 134443 - protein, 11 aa, Homo Sapiens
KSWPEGHFATI

SEQ ID NO: 134444 - protein, 11 aa, Homo Sapiens
KSYELPDGQVI

SEQ ID NO: 134445 - protein, 11 aa, Homo Sapiens
KSYLGSEADVW

SEQ ID NO: 134446 - protein, 11 aa, Homo Sapiens
KSYPGSQSQLF

SEQ ID NO: 134447 - protein, 11 aa, Homo Sapiens
KSYPNEEKDAW

SEQ ID NO: 134448 - protein, 11 aa, Homo Sapiens
KTASQVHLMKF

SEQ ID NO: 134449 - protein, 11 aa, Homo Sapiens
KTAVICQLDYW

SEQ ID NO: 134450 - protein, 11 aa, Homo Sapiens
KTDPVDIYKSW

SEQ ID NO: 134451 - protein, 11 aa, Homo Sapiens
KTFLHDPLVEW

SEQ ID NO: 134452 - protein, 11 aa, Homo Sapiens
KTHEITQLESW

SEQ ID NO: 134453 - protein, 11 aa, Homo Sapiens
KTLPADVQNYY

SEQ ID NO: 134454 - protein, 11 aa, Homo Sapiens
KTLVNPANVTF

SEQ ID NO: 134455 - protein, 11 aa, Homo Sapiens
KTMEQLENVYF

SEQ ID NO: 134456 - protein, 11 aa, Homo Sapiens
KTMVGHRTEVW

SEQ ID NO: 134457 - protein, 11 aa, Homo Sapiens
KTNGLSEDLIW

SEQ ID NO: 134458 - protein, 11 aa, Homo Sapiens
KTVSAVCSLAW

SEQ ID NO: 134459 - protein, 11 aa, Homo Sapiens
KTVYTGIDHHW

SEQ ID NO: 134460 - protein, 11 aa, Homo Sapiens
KTWAEIRQQRW

SEQ ID NO: 134461 - protein, 11 aa, Homo Sapiens
KTYPVNTPERW

SEQ ID NO: 134462 - protein, 11 aa, Homo Sapiens
KTYSNEVVTLW

SEQ ID NO: 134463 - protein, 11 aa, Homo Sapiens
KVDPAKDRELW

SEQ ID NO: 134464 - protein, 11 aa, Homo Sapiens
KVFAEDQDMQY

SEQ ID NO: 134465 - protein, 11 aa, Homo Sapiens
KVIHELANERW

SEQ ID NO: 134466 - protein, 11 aa, Homo Sapiens
KVIHEQVNHRW

SEQ ID NO: 134467 - protein, 11 aa, Homo Sapiens
KVLDDMEGNQW

SEQ ID NO: 134468 - protein, 11 aa, Homo Sapiens
KVLNEECDQNW

SEQ ID NO: 134469 - protein, 11 aa, Homo Sapiens
KVLPPNHRVVW

SEQ ID NO: 134470 - protein, 11 aa, Homo Sapiens
KVLSPKYLGSW

SEQ ID NO: 134471 - protein, 11 aa, Homo Sapiens
KVSPEEITSLW

SEQ ID NO: 134472 - protein, 11 aa, Homo Sapiens
KVYENDDQLLW

SEQ ID NO: 134473 - protein, 11 aa, Homo Sapiens
KVYENEDQLLW

SEQ ID NO: 134474 - protein, 11 aa, Homo Sapiens
LADPDEVARRW

SEQ ID NO: 134475 - protein, 11 aa, Homo Sapiens
LMDPSGNAHKW

SEQ ID NO: 134476 - protein, 11 aa, Homo Sapiens
LSALPADTQAW

SEQ ID NO: 134477 - protein, 11 aa, Homo Sapiens
LSDPDEVARRW

SEQ ID NO: 134478 - protein, 11 aa, Homo Sapiens
LSFDAPGRLLW

SEQ ID NO: 134479 - protein, 11 aa, Homo Sapiens
LSFGDAAQTLW

SEQ ID NO: 134480 - protein, 11 aa, Homo Sapiens
LSQVEGEHQLW

SEQ ID NO: 134481 - protein, 11 aa, Homo Sapiens
LSSDDANVLVW

SEQ ID NO: 134482 - protein, 11 aa, Homo Sapiens
LTAPSSPGSSW

SEQ ID NO: 134483 - protein, 11 aa, Homo Sapiens
LTVKLPDGYEF

SEQ ID NO: 134484 - protein, 11 aa, Homo Sapiens
LVDPLNMHVTW

SEQ ID NO: 134485 - protein, 11 aa, Homo Sapiens
MTDPDEVARRW

SEQ ID NO: 134486 - protein, 11 aa, Homo Sapiens
QAIRNDETGLW

SEQ ID NO: 134487 - protein, 11 aa, Homo Sapiens
QALQDSRNYGW

SEQ ID NO: 134488 - protein, 11 aa, Homo Sapiens
QAWRAATLEGW

SEQ ID NO: 134489 - protein, 11 aa, Homo Sapiens
QSDPSGAYFAW

SEQ ID NO: 134490 - protein, 11 aa, Homo Sapiens
QSVPASTGLGW

SEQ ID NO: 134491 - protein, 11 aa, Homo Sapiens
QTDPSGTYHAW

SEQ ID NO: 134492 - protein, 11 aa, Homo Sapiens
QTIRLPAQSIW

SEQ ID NO: 134493 - protein, 11 aa, Homo Sapiens
RAADAVEDLRW

SEQ ID NO: 134494 - protein, 11 aa, Homo Sapiens
RAAKPEQIQKW

SEQ ID NO: 134495 - protein, 11 aa, Homo Sapiens
RAALSDTVALW

SEQ ID NO: 134496 - protein, 11 aa, Homo Sapiens
RACPAVVRATF

SEQ ID NO: 134497 - protein, 11 aa, Homo Sapiens
RAFQAHKEENW

SEQ ID NO: 134498 - protein, 11 aa, Homo Sapiens
RAFTCDDLFRF

SEQ ID NO: 134499 - protein, 11 aa, Homo Sapiens
RAIAAHERQAW

SEQ ID NO: 134500 - protein, 11 aa, Homo Sapiens
RALEAEKRALW

SEQ ID NO: 134501 - protein, 11 aa, Homo Sapiens
RALGTEVIQLF

SEQ ID NO: 134502 - protein, 11 aa, Homo Sapiens
RALGWGSLYAW

SEQ ID NO: 134503 - protein, 11 aa, Homo Sapiens
RALPSLDIVVW

SEQ ID NO: 134504 - protein, 11 aa, Homo Sapiens
RALQASALNAW

SEQ ID NO: 134505 - protein, 11 aa, Homo Sapiens
RAVREDLGGCW

SEQ ID NO: 134506 - protein, 11 aa, Homo Sapiens
RFVPLPASAKW

SEQ ID NO: 134507 - protein, 11 aa, Homo Sapiens
RILPQDVILKF

SEQ ID NO: 134508 - protein, 11 aa, Homo Sapiens
RIVSVDKQQQW

SEQ ID NO: 134509 - protein, 11 aa, Homo Sapiens
RLFDEGTISKW

SEQ ID NO: 134510 - protein, 11 aa, Homo Sapiens
RSDPNSESLYF

SEQ ID NO: 134511 - protein, 11 aa, Homo Sapiens
RSFGWDSSEAW

SEQ ID NO: 134512 - protein, 11 aa, Homo Sapiens
RSFIFKGEDNW

SEQ ID NO: 134513 - protein, 11 aa, Homo Sapiens
RSIAECAVFTW

SEQ ID NO: 134514 - protein, 11 aa, Homo Sapiens
RSIESTLDDLF

SEQ ID NO: 134515 - protein, 11 aa, Homo Sapiens
RSIPAITRYWF

SEQ ID NO: 134516 - protein, 11 aa, Homo Sapiens
RSIPVNEKDTL

SEQ ID NO: 134517 - protein, 11 aa, Homo Sapiens
RSISQGLTWTW

SEQ ID NO: 134518 - protein, 11 aa, Homo Sapiens
RSLPDPNLITF

SEQ ID NO: 134519 - protein, 11 aa, Homo Sapiens
RSLPHITDVSW

SEQ ID NO: 134520 - protein, 11 aa, Homo Sapiens
RSLTAVTCTVW

SEQ ID NO: 134521 - protein, 11 aa, Homo Sapiens
RSNPKLKDLYI

SEQ ID NO: 134522 - protein, 11 aa, Homo Sapiens
RSQMSMPFQQW

SEQ ID NO: 134523 - protein, 11 aa, Homo Sapiens
RSQVVIPILQW

SEQ ID NO: 134524 - protein, 11 aa, Homo Sapiens
RSSSYLDNLVW

SEQ ID NO: 134525 - protein, 11 aa, Homo Sapiens
RSSYLANEILW

SEQ ID NO: 134526 - protein, 11 aa, Homo Sapiens
RSTELDSNWNW

SEQ ID NO: 134527 - protein, 11 aa, Homo Sapiens
RSYQDPSNAQF

SEQ ID NO: 134528 - protein, 11 aa, Homo Sapiens
RSYYSVQTAEW

SEQ ID NO: 134529 - protein, 11 aa, Homo Sapiens
RTFSSLHVERW

SEQ ID NO: 134530 - protein, 11 aa, Homo Sapiens
RTILQHLSEAW

SEQ ID NO: 134531 - protein, 11 aa, Homo Sapiens
RTINDQDFFLY

SEQ ID NO: 134532 - protein, 11 aa, Homo Sapiens
RTIQTPIGSTW

SEQ ID NO: 134533 - protein, 11 aa, Homo Sapiens
RTLGTPDEVVW

SEQ ID NO: 134534 - protein, 11 aa, Homo Sapiens
RTLPTNTLMGF

SEQ ID NO: 134535 - protein, 11 aa, Homo Sapiens
RTLPVDSSHGF

SEQ ID NO: 134536 - protein, 11 aa, Homo Sapiens
RTNPNSGDFRF

SEQ ID NO: 134537 - protein, 11 aa, Homo Sapiens
RTRNEELAQTW

SEQ ID NO: 134538 - protein, 11 aa, Homo Sapiens
RTSGLCVPLTW

SEQ ID NO: 134539 - protein, 11 aa, Homo Sapiens
RTTPATELDAW

SEQ ID NO: 134540 - protein, 11 aa, Homo Sapiens
RTVYPEEHSRW

SEQ ID NO: 134541 - protein, 11 aa, Homo Sapiens
RVCQQPGLSLW

SEQ ID NO: 134542 - protein, 11 aa, Homo Sapiens
RVDPNGSRYLL

SEQ ID NO: 134543 - protein, 11 aa, Homo Sapiens
RVDTSPTPVSW

SEQ ID NO: 134544 - protein, 11 aa, Homo Sapiens
RVFEDESGKHW

SEQ ID NO: 134545 - protein, 11 aa, Homo Sapiens
RVISELQEACW

SEQ ID NO: 134546 - protein, 11 aa, Homo Sapiens
RVLPPSHRVTW

SEQ ID NO: 134547 - protein, 11 aa, Homo Sapiens
RVLPYPFTHHW

SEQ ID NO: 134548 - protein, 11 aa, Homo Sapiens
RVVDGAVGAQW

SEQ ID NO: 134549 - protein, 11 aa, Homo Sapiens
RVYQSLCPTSW

SEQ ID NO: 134550 - protein, 11 aa, Homo Sapiens
SALGPDIICRW

SEQ ID NO: 134551 - protein, 11 aa, Homo Sapiens
SASPDATIRIW

SEQ ID NO: 134552 - protein, 11 aa, Homo Sapiens
SGSSDGTIRLW

SEQ ID NO: 134553 - protein, 11 aa, Homo Sapiens
SPSSVTGNALW

SEQ ID NO: 134554 - protein, 11 aa, Homo Sapiens
SSATDAAIRVW

SEQ ID NO: 134555 - protein, 11 aa, Homo Sapiens
TSDPLARLQMF

SEQ ID NO: 134556 - protein, 11 aa, Homo Sapiens
TSENITQKVVW

SEQ ID NO: 134557 - protein, 11 aa, Homo Sapiens
TSYRDFLGTNW

SEQ ID NO: 134558 - protein, 11 aa, Homo Sapiens
TTVPNTIVVSW

SEQ ID NO: 134559 - protein, 11 aa, Homo Sapiens
VAIRDGAYSLF

SEQ ID NO: 134560 - protein, 11 aa, Homo Sapiens
VGLPAAGKTTW

SEQ ID NO: 134561 - protein, 11 aa, Homo Sapiens
VSAPAGGKASW

SEQ ID NO: 134562 - protein, 11 aa, Homo Sapiens
VSDHEATLRCW

SEQ ID NO: 134563 - protein, 11 aa, Homo Sapiens
VSEPGDPKVTW

SEQ ID NO: 134564 - protein, 11 aa, Homo Sapiens
VSFEEDDKIRW

SEQ ID NO: 134565 - protein, 11 aa, Homo Sapiens
VSFPDVEKAEW

SEQ ID NO: 134566 - protein, 11 aa, Homo Sapiens
VSLPAPGVPAW

SEQ ID NO: 134567 - protein, 11 aa, Homo Sapiens
VSLPSHLNISY

SEQ ID NO: 134568 - protein, 11 aa, Homo Sapiens
VSLQASSGHMW

SEQ ID NO: 134569 - protein, 11 aa, Homo Sapiens
VSYRNPAEGTW

SEQ ID NO: 134570 - protein, 11 aa, Homo Sapiens
VTIHEKQKESW

SEQ ID NO: 134571 - protein, 11 aa, Homo Sapiens
VTIPSTCSEIW

SEQ ID NO: 134572 - protein, 11 aa, Homo Sapiens
VTLHDQGTAQW

SEQ ID NO: 134573 - protein, 11 aa, Homo Sapiens
VVSPHEDMRTW

SEQ ID NO: 134574 - protein, 11 aa, Homo Sapiens
VVVPAEWIKNW

SEQ ID NO: 134575 - protein, 11 aa, Homo Sapiens
YACPALIKSIW

SEQ ID NO: 134576 - protein, 11 aa, Homo Sapiens
YGFRPDEPYYY

SEQ ID NO: 134577 - protein, 11 aa, Homo Sapiens
YMDPTGKTRTW

SEQ ID NO: 134578 - protein, 8 aa, Homo Sapiens
AANDARLL

SEQ ID NO: 134579 - protein, 8 aa, Homo Sapiens
AANIPRSI

SEQ ID NO: 134580 - protein, 8 aa, Homo Sapiens
AAQVARVL

SEQ ID NO: 134581 - protein, 8 aa, Homo Sapiens
AELAARIL

SEQ ID NO: 134582 - protein, 8 aa, Homo Sapiens
AGNIARTI

SEQ ID NO: 134583 - protein, 8 aa, Homo Sapiens
ASFLARRL

SEQ ID NO: 134584 - protein, 8 aa, Homo Sapiens
ASLGARHI

SEQ ID NO: 134585 - protein, 8 aa, Homo Sapiens
ASLKAKLL

SEQ ID NO: 134586 - protein, 8 aa, Homo Sapiens
ASMPSRTI

SEQ ID NO: 134587 - protein, 8 aa, Homo Sapiens
ASQSARFY

SEQ ID NO: 134588 - protein, 8 aa, Homo Sapiens
AVSLQRKL

SEQ ID NO: 134589 - protein, 8 aa, Homo Sapiens
EEQLQQIR

SEQ ID NO: 134590 - protein, 8 aa, Homo Sapiens
FANNPREL

SEQ ID NO: 134591 - protein, 8 aa, Homo Sapiens
FSADPRHI

SEQ ID NO: 134592 - protein, 8 aa, Homo Sapiens
FSATPRYM

SEQ ID NO: 134593 - protein, 8 aa, Homo Sapiens
FSNAARVL

SEQ ID NO: 134594 - protein, 8 aa, Homo Sapiens
FSNVGRKI

SEQ ID NO: 134595 - protein, 8 aa, Homo Sapiens
FSQPARSF

SEQ ID NO: 134596 - protein, 8 aa, Homo Sapiens
FTQPSRLL

SEQ ID NO: 134597 - protein, 8 aa, Homo Sapiens
HANLARAL

SEQ ID NO: 134598 - protein, 8 aa, Homo Sapiens
HSAEPRLL

SEQ ID NO: 134599 - protein, 8 aa, Homo Sapiens
HSQSPRVI

SEQ ID NO: 134600 - protein, 8 aa, Homo Sapiens
HSTLPRTL

SEQ ID NO: 134601 - protein, 8 aa, Homo Sapiens
HSYLSRLI

SEQ ID NO: 134602 - protein, 8 aa, Homo Sapiens
HTHIPRLI

SEQ ID NO: 134603 - protein, 8 aa, Homo Sapiens
HTHVPRLI

SEQ ID NO: 134604 - protein, 8 aa, Homo Sapiens
HTNLPRSI

SEQ ID NO: 134605 - protein, 8 aa, Homo Sapiens
HTNLSRKI

SEQ ID NO: 134606 - protein, 8 aa, Homo Sapiens
IAKQSVTI

SEQ ID NO: 134607 - protein, 8 aa, Homo Sapiens
IAQLARQY

SEQ ID NO: 134608 - protein, 8 aa, Homo Sapiens
IGTKGRLI

SEQ ID NO: 134609 - protein, 8 aa, Homo Sapiens
IQQTARSI

SEQ ID NO: 134610 - protein, 8 aa, Homo Sapiens
ISAKARYF

SEQ ID NO: 134611 - protein, 8 aa, Homo Sapiens
ISKTARLL

SEQ ID NO: 134612 - protein, 8 aa, Homo Sapiens
ISNSPRVI

SEQ ID NO: 134613 - protein, 8 aa, Homo Sapiens
ISNTAISI

SEQ ID NO: 134614 - protein, 8 aa, Homo Sapiens
ISQIVSSI

SEQ ID NO: 134615 - protein, 8 aa, Homo Sapiens
ISQVGRVY

SEQ ID NO: 134616 - protein, 8 aa, Homo Sapiens
ISRTPVLM

SEQ ID NO: 134617 - protein, 8 aa, Homo Sapiens
ISVTARRL

SEQ ID NO: 134618 - protein, 8 aa, Homo Sapiens
ITVVARQI

SEQ ID NO: 134619 - protein, 8 aa, Homo Sapiens
KAAPSRLF

SEQ ID NO: 134620 - protein, 8 aa, Homo Sapiens
KAEKARLL

SEQ ID NO: 134621 - protein, 8 aa, Homo Sapiens
KAGLPRSI

SEQ ID NO: 134622 - protein, 8 aa, Homo Sapiens
KAKGPVTI

SEQ ID NO: 134623 - protein, 8 aa, Homo Sapiens
KAKVAIKI

SEQ ID NO: 134624 - protein, 8 aa, Homo Sapiens
KAMLAKLM

SEQ ID NO: 134625 - protein, 8 aa, Homo Sapiens
KARLPLRL

SEQ ID NO: 134626 - protein, 8 aa, Homo Sapiens
KFQEARKL

SEQ ID NO: 134627 - protein, 8 aa, Homo Sapiens
KGLSARII

SEQ ID NO: 134628 - protein, 8 aa, Homo Sapiens
KLQRARLL

SEQ ID NO: 134629 - protein, 8 aa, Homo Sapiens
KSALALRW

SEQ ID NO: 134630 - protein, 8 aa, Homo Sapiens
KSFILQKY

SEQ ID NO: 134631 - protein, 8 aa, Homo Sapiens
KSFKAALI

SEQ ID NO: 134632 - protein, 8 aa, Homo Sapiens
KSHRVLKW

SEQ ID NO: 134633 - protein, 8 aa, Homo Sapiens
KSHVGRLL

SEQ ID NO: 134634 - protein, 8 aa, Homo Sapiens
KSIEVRKF

SEQ ID NO: 134635 - protein, 8 aa, Homo Sapiens
KSILSRHL

SEQ ID NO: 134636 - protein, 8 aa, Homo Sapiens
KSKIVSEI

SEQ ID NO: 134637 - protein, 8 aa, Homo Sapiens
KSLQAIKI

SEQ ID NO: 134638 - protein, 8 aa, Homo Sapiens
KSLTAHVI

SEQ ID NO: 134639 - protein, 8 aa, Homo Sapiens
KSLVAFKI

SEQ ID NO: 134640 - protein, 8 aa, Homo Sapiens
KSMISRKL

SEQ ID NO: 134641 - protein, 8 aa, Homo Sapiens
KSNLARVF

SEQ ID NO: 134642 - protein, 8 aa, Homo Sapiens
KSTIANLM

SEQ ID NO: 134643 - protein, 8 aa, Homo Sapiens
KSVDGRQI

SEQ ID NO: 134644 - protein, 8 aa, Homo Sapiens
KSVDPRLI

SEQ ID NO: 134645 - protein, 8 aa, Homo Sapiens
KTIKAQIW

SEQ ID NO: 134646 - protein, 8 aa, Homo Sapiens
KTKKPLLI

SEQ ID NO: 134647 - protein, 8 aa, Homo Sapiens
KTLSPREL

SEQ ID NO: 134648 - protein, 8 aa, Homo Sapiens
KTLTPRKL

SEQ ID NO: 134649 - protein, 8 aa, Homo Sapiens
KTRQAFYL

SEQ ID NO: 134650 - protein, 8 aa, Homo Sapiens
KTSLLRPV

SEQ ID NO: 134651 - protein, 8 aa, Homo Sapiens
KTTVARLI

SEQ ID NO: 134652 - protein, 8 aa, Homo Sapiens
KTVEGREL

SEQ ID NO: 134653 - protein, 8 aa, Homo Sapiens
KTWRPRYF

SEQ ID NO: 134654 - protein, 8 aa, Homo Sapiens
KTWSSRLW

SEQ ID NO: 134655 - protein, 8 aa, Homo Sapiens
KTYPAHAF

SEQ ID NO: 134656 - protein, 8 aa, Homo Sapiens
KVILARQY

SEQ ID NO: 134657 - protein, 8 aa, Homo Sapiens
LAAAARCL

SEQ ID NO: 134658 - protein, 8 aa, Homo Sapiens
LAAEARAI

SEQ ID NO: 134659 - protein, 8 aa, Homo Sapiens
LAFTARKM

SEQ ID NO: 134660 - protein, 8 aa, Homo Sapiens
LAKKPHII

SEQ ID NO: 134661 - protein, 8 aa, Homo Sapiens
LAQEARNI

SEQ ID NO: 134662 - protein, 8 aa, Homo Sapiens
LLSYPRLL

SEQ ID NO: 134663 - protein, 8 aa, Homo Sapiens
LSAEPRYL

SEQ ID NO: 134664 - protein, 8 aa, Homo Sapiens
LSAPARLY

SEQ ID NO: 134665 - protein, 8 aa, Homo Sapiens
LSIPYRLI

SEQ ID NO: 134666 - protein, 8 aa, Homo Sapiens
LSKKPLRY

SEQ ID NO: 134667 - protein, 8 aa, Homo Sapiens
LSLVARLI

SEQ ID NO: 134668 - protein, 8 aa, Homo Sapiens
LSNLPRSF

SEQ ID NO: 134669 - protein, 8 aa, Homo Sapiens
LSQEGRSL

SEQ ID NO: 134670 - protein, 8 aa, Homo Sapiens
LSSQSRQW

SEQ ID NO: 134671 - protein, 8 aa, Homo Sapiens
LSSTPRVI

SEQ ID NO: 134672 - protein, 8 aa, Homo Sapiens
LSTAPRSL

SEQ ID NO: 134673 - protein, 8 aa, Homo Sapiens
LSWKAHRL

SEQ ID NO: 134674 - protein, 8 aa, Homo Sapiens
LTAAARLL

SEQ ID NO: 134675 - protein, 8 aa, Homo Sapiens
LTADARLL

SEQ ID NO: 134676 - protein, 8 aa, Homo Sapiens
LTAQPRLM

SEQ ID NO: 134677 - protein, 8 aa, Homo Sapiens
LTNMSRTL

SEQ ID NO: 134678 - protein, 8 aa, Homo Sapiens
LTRQPFAI

SEQ ID NO: 134679 - protein, 8 aa, Homo Sapiens
LTSTPREI

SEQ ID NO: 134680 - protein, 8 aa, Homo Sapiens
LTTIARTI

SEQ ID NO: 134681 - protein, 8 aa, Homo Sapiens
NVPGEIVE

SEQ ID NO: 134682 - protein, 8 aa, Homo Sapiens
QAIKARNI

SEQ ID NO: 134683 - protein, 8 aa, Homo Sapiens
QALEARLV

SEQ ID NO: 134684 - protein, 8 aa, Homo Sapiens
QALLARNI

SEQ ID NO: 134685 - protein, 8 aa, Homo Sapiens
QAMKARQI

SEQ ID NO: 134686 - protein, 8 aa, Homo Sapiens
QSLHARTL

SEQ ID NO: 134687 - protein, 8 aa, Homo Sapiens
QSMPSREL

SEQ ID NO: 134688 - protein, 8 aa, Homo Sapiens
QTTAPRLL

SEQ ID NO: 134689 - protein, 8 aa, Homo Sapiens
QTTKARFL

SEQ ID NO: 134690 - protein, 8 aa, Homo Sapiens
RALLARLL

SEQ ID NO: 134691 - protein, 8 aa, Homo Sapiens
RALVARLL

SEQ ID NO: 134692 - protein, 8 aa, Homo Sapiens
RALVGREL

SEQ ID NO: 134693 - protein, 8 aa, Homo Sapiens
RGLIARKL

SEQ ID NO: 134694 - protein, 8 aa, Homo Sapiens
RINLPRNI

SEQ ID NO: 134695 - protein, 8 aa, Homo Sapiens
RQLPARTL

SEQ ID NO: 134696 - protein, 8 aa, Homo Sapiens
RSAPARVI

SEQ ID NO: 134697 - protein, 8 aa, Homo Sapiens
RSFIAKRL

SEQ ID NO: 134698 - protein, 8 aa, Homo Sapiens
RSFKAQVF

SEQ ID NO: 134699 - protein, 8 aa, Homo Sapiens
RSHLAALW

SEQ ID NO: 134700 - protein, 8 aa, Homo Sapiens
RSHLGRYL

SEQ ID NO: 134701 - protein, 8 aa, Homo Sapiens
RSISVNQW

SEQ ID NO: 134702 - protein, 8 aa, Homo Sapiens
RSIVPHVF

SEQ ID NO: 134703 - protein, 8 aa, Homo Sapiens
RSLEARII

SEQ ID NO: 134704 - protein, 8 aa, Homo Sapiens
RSLLARTV

SEQ ID NO: 134705 - protein, 8 aa, Homo Sapiens
RSLLGRSL

SEQ ID NO: 134706 - protein, 8 aa, Homo Sapiens
RSLNPRKL

SEQ ID NO: 134707 - protein, 8 aa, Homo Sapiens
RSLQGRAL

SEQ ID NO: 134708 - protein, 8 aa, Homo Sapiens
RSLWGRLL

SEQ ID NO: 134709 - protein, 8 aa, Homo Sapiens
RSMKGLRW

SEQ ID NO: 134710 - protein, 8 aa, Homo Sapiens
RSMNSRVF

SEQ ID NO: 134711 - protein, 8 aa, Homo Sapiens
RSRQPIYM

SEQ ID NO: 134712 - protein, 8 aa, Homo Sapiens
RTALPRIF

SEQ ID NO: 134713 - protein, 8 aa, Homo Sapiens
RTFEPRLL

SEQ ID NO: 134714 - protein, 8 aa, Homo Sapiens
RTFSSRLI

SEQ ID NO: 134715 - protein, 8 aa, Homo Sapiens
RTGPPRLL

SEQ ID NO: 134716 - protein, 8 aa, Homo Sapiens
RTLIPRYF

SEQ ID NO: 134717 - protein, 8 aa, Homo Sapiens
RTLLARLV

SEQ ID NO: 134718 - protein, 8 aa, Homo Sapiens
RTLPSRVF

SEQ ID NO: 134719 - protein, 8 aa, Homo Sapiens
RTMLVRKI

SEQ ID NO: 134720 - protein, 8 aa, Homo Sapiens
RTMQARGF

SEQ ID NO: 134721 - protein, 8 aa, Homo Sapiens
SIKIVKKL

SEQ ID NO: 134722 - protein, 8 aa, Homo Sapiens
SSKVQRLL

SEQ ID NO: 134723 - protein, 8 aa, Homo Sapiens
SSTTARVI

SEQ ID NO: 134724 - protein, 8 aa, Homo Sapiens
STDVAKTF

SEQ ID NO: 134725 - protein, 8 aa, Homo Sapiens
STITSREI

SEQ ID NO: 134726 - protein, 8 aa, Homo Sapiens
STTKARLF

SEQ ID NO: 134727 - protein, 8 aa, Homo Sapiens
TALAARTW

SEQ ID NO: 134728 - protein, 8 aa, Homo Sapiens
TAQQPRLF

SEQ ID NO: 134729 - protein, 8 aa, Homo Sapiens
TEELAYLK

SEQ ID NO: 134730 - protein, 8 aa, Homo Sapiens
TFRIKRFL

SEQ ID NO: 134731 - protein, 8 aa, Homo Sapiens
TSAYARLI

SEQ ID NO: 134732 - protein, 8 aa, Homo Sapiens
TSLQAREL

SEQ ID NO: 134733 - protein, 8 aa, Homo Sapiens
TSQLARHW

SEQ ID NO: 134734 - protein, 8 aa, Homo Sapiens
VALAARKI

SEQ ID NO: 134735 - protein, 8 aa, Homo Sapiens
VQNIARQL

SEQ ID NO: 134736 - protein, 8 aa, Homo Sapiens
VSAQSRFL

SEQ ID NO: 134737 - protein, 8 aa, Homo Sapiens
VSAYPRQL

SEQ ID NO: 134738 - protein, 8 aa, Homo Sapiens
VSLRRAVL

SEQ ID NO: 134739 - protein, 8 aa, Homo Sapiens
VSMIALER

SEQ ID NO: 134740 - protein, 8 aa, Homo Sapiens
VSNAPRLI

SEQ ID NO: 134741 - protein, 8 aa, Homo Sapiens
VTTIARNW

SEQ ID NO: 134742 - protein, 8 aa, Homo Sapiens
VVQKPRQI

SEQ ID NO: 134743 - protein, 8 aa, Homo Sapiens
YAARARLL

SEQ ID NO: 134744 - protein, 8 aa, Homo Sapiens
YAQVARLF

SEQ ID NO: 134745 - protein, 8 aa, Homo Sapiens
YSYPARRW

SEQ ID NO: 134746 - protein, 9 aa, Homo Sapiens
AAIKIIRQL

SEQ ID NO: 134747 - protein, 9 aa, Homo Sapiens
ARLDLERKI

SEQ ID NO: 134748 - protein, 9 aa, Homo Sapiens
ASAVVVWEW

SEQ ID NO: 134749 - protein, 9 aa, Homo Sapiens
ASFDGTFLW

SEQ ID NO: 134750 - protein, 9 aa, Homo Sapiens
ASFHRVQAL

SEQ ID NO: 134751 - protein, 9 aa, Homo Sapiens
ASFPGANII

SEQ ID NO: 134752 - protein, 9 aa, Homo Sapiens
ASLDISRKW

SEQ ID NO: 134753 - protein, 9 aa, Homo Sapiens
ASLNLLRYL

SEQ ID NO: 134754 - protein, 9 aa, Homo Sapiens
ASLYLLRVL

SEQ ID NO: 134755 - protein, 9 aa, Homo Sapiens
ASSTTARVI

SEQ ID NO: 134756 - protein, 9 aa, Homo Sapiens
ASVRSSPTL

SEQ ID NO: 134757 - protein, 9 aa, Homo Sapiens
ASVYIYRYF

SEQ ID NO: 134758 - protein, 9 aa, Homo Sapiens
ATIKTKRTI

SEQ ID NO: 134759 - protein, 9 aa, Homo Sapiens
ATIPNARQF

SEQ ID NO: 134760 - protein, 9 aa, Homo Sapiens
ATLRTSRLL

SEQ ID NO: 134761 - protein, 9 aa, Homo Sapiens
ATNPISRVL

SEQ ID NO: 134762 - protein, 9 aa, Homo Sapiens
FAKRNVKLI

SEQ ID NO: 134763 - protein, 9 aa, Homo Sapiens
FSFKKPFKL

SEQ ID NO: 134764 - protein, 9 aa, Homo Sapiens
FSFKKSFKL

SEQ ID NO: 134765 - protein, 9 aa, Homo Sapiens
FSKRDAQVI

SEQ ID NO: 134766 - protein, 9 aa, Homo Sapiens
FSKRIQKSI

SEQ ID NO: 134767 - protein, 9 aa, Homo Sapiens
FSKRQQPKF

SEQ ID NO: 134768 - protein, 9 aa, Homo Sapiens
FTNRNPRNL

SEQ ID NO: 134769 - protein, 9 aa, Homo Sapiens
FTSKFPRQI

SEQ ID NO: 134770 - protein, 9 aa, Homo Sapiens
FTYKGLRAL

SEQ ID NO: 134771 - protein, 9 aa, Homo Sapiens
GAGGGFGSR

SEQ ID NO: 134772 - protein, 9 aa, Homo Sapiens
GSFSGVRKL

SEQ ID NO: 134773 - protein, 9 aa, Homo Sapiens
GSIQVRWFL

SEQ ID NO: 134774 - protein, 9 aa, Homo Sapiens
GSTDRQVTI

SEQ ID NO: 134775 - protein, 9 aa, Homo Sapiens
GTFRGTRYF

SEQ ID NO: 134776 - protein, 9 aa, Homo Sapiens
GTYDKKVTI

SEQ ID NO: 134777 - protein, 9 aa, Homo Sapiens
GVMALQRKL

SEQ ID NO: 134778 - protein, 9 aa, Homo Sapiens
HALALAWTF

SEQ ID NO: 134779 - protein, 9 aa, Homo Sapiens
HPVLPARSI

SEQ ID NO: 134780 - protein, 9 aa, Homo Sapiens
HSFPLQFTL

SEQ ID NO: 134781 - protein, 9 aa, Homo Sapiens
HSIFSIRIL

SEQ ID NO: 134782 - protein, 9 aa, Homo Sapiens
HSLFLDRLM

SEQ ID NO: 134783 - protein, 9 aa, Homo Sapiens
HSLTQQRLL

SEQ ID NO: 134784 - protein, 9 aa, Homo Sapiens
HSMKPHPAI

SEQ ID NO: 134785 - protein, 9 aa, Homo Sapiens
HSNPSAFNI

SEQ ID NO: 134786 - protein, 9 aa, Homo Sapiens
HSTLVPHEW

SEQ ID NO: 134787 - protein, 9 aa, Homo Sapiens
HSVDQSWSW

SEQ ID NO: 134788 - protein, 9 aa, Homo Sapiens
HSYADMREL

SEQ ID NO: 134789 - protein, 9 aa, Homo Sapiens
HTRELAFQI

SEQ ID NO: 134790 - protein, 9 aa, Homo Sapiens
HTVHVLRYF

SEQ ID NO: 134791 - protein, 9 aa, Homo Sapiens
HTWNGIRHL

SEQ ID NO: 134792 - protein, 9 aa, Homo Sapiens
IIFVPVPQL

SEQ ID NO: 134793 - protein, 9 aa, Homo Sapiens
ISANIFRTL

SEQ ID NO: 134794 - protein, 9 aa, Homo Sapiens
ISDKVLKKI

SEQ ID NO: 134795 - protein, 9 aa, Homo Sapiens
ISFHFTPVL

SEQ ID NO: 134796 - protein, 9 aa, Homo Sapiens
ISFPSGKKI

SEQ ID NO: 134797 - protein, 9 aa, Homo Sapiens
ISFTVKYTY

SEQ ID NO: 134798 - protein, 9 aa, Homo Sapiens
ISIPIGFLF

SEQ ID NO: 134799 - protein, 9 aa, Homo Sapiens
ISKPDVITL

SEQ ID NO: 134800 - protein, 9 aa, Homo Sapiens
ISKQFHHQL

SEQ ID NO: 134801 - protein, 9 aa, Homo Sapiens
ISLAPIHKL

SEQ ID NO: 134802 - protein, 9 aa, Homo Sapiens
ISLKENRHW

SEQ ID NO: 134803 - protein, 9 aa, Homo Sapiens
ISLKKLIVR

SEQ ID NO: 134804 - protein, 9 aa, Homo Sapiens
ISNPVTKEM

SEQ ID NO: 134805 - protein, 9 aa, Homo Sapiens
ISRHQEQFI

SEQ ID NO: 134806 - protein, 9 aa, Homo Sapiens
ISRVKSVRL

SEQ ID NO: 134807 - protein, 9 aa, Homo Sapiens
ISSTVQRQL

SEQ ID NO: 134808 - protein, 9 aa, Homo Sapiens
ISTPVIRTF

SEQ ID NO: 134809 - protein, 9 aa, Homo Sapiens
ISVNIFRTL

SEQ ID NO: 134810 - protein, 9 aa, Homo Sapiens
ISVPIFKQF

SEQ ID NO: 134811 - protein, 9 aa, Homo Sapiens
ITFPGIKLI

SEQ ID NO: 134812 - protein, 9 aa, Homo Sapiens
ITKTVVENI

SEQ ID NO: 134813 - protein, 9 aa, Homo Sapiens
ITNHIHVRI

SEQ ID NO: 134814 - protein, 9 aa, Homo Sapiens
ITQETARLL

SEQ ID NO: 134815 - protein, 9 aa, Homo Sapiens
ITTDVLYTI

SEQ ID NO: 134816 - protein, 9 aa, Homo Sapiens
ITTTVTRVL

SEQ ID NO: 134817 - protein, 9 aa, Homo Sapiens
KAARLVRSL

SEQ ID NO: 134818 - protein, 9 aa, Homo Sapiens
KACDYIREL

SEQ ID NO: 134819 - protein, 9 aa, Homo Sapiens
KACVVKREF

SEQ ID NO: 134820 - protein, 9 aa, Homo Sapiens
KACYLPWVI

SEQ ID NO: 134821 - protein, 9 aa, Homo Sapiens
KAFDRPSLF

SEQ ID NO: 134822 - protein, 9 aa, Homo Sapiens
KAFNLRISF

SEQ ID NO: 134823 - protein, 9 aa, Homo Sapiens
KAFPEHFTY

SEQ ID NO: 134824 - protein, 9 aa, Homo Sapiens
KAFPFHIIF

SEQ ID NO: 134825 - protein, 9 aa, Homo Sapiens
KAFPKAYLL

SEQ ID NO: 134826 - protein, 9 aa, Homo Sapiens
KAIDYIRFL

SEQ ID NO: 134827 - protein, 9 aa, Homo Sapiens
KAIEKNVLF

SEQ ID NO: 134828 - protein, 9 aa, Homo Sapiens
KAINFNFGY

SEQ ID NO: 134829 - protein, 9 aa, Homo Sapiens
KAIVLQKTI

SEQ ID NO: 134830 - protein, 9 aa, Homo Sapiens
KAKITAYVI

SEQ ID NO: 134831 - protein, 9 aa, Homo Sapiens
KAKPVTTNL

SEQ ID NO: 134832 - protein, 9 aa, Homo Sapiens
KAKQLTPRI

SEQ ID NO: 134833 - protein, 9 aa, Homo Sapiens
KAKTDSINI

SEQ ID NO: 134834 - protein, 9 aa, Homo Sapiens
KAKTIQQTL

SEQ ID NO: 134835 - protein, 9 aa, Homo Sapiens
KALELERKL

SEQ ID NO: 134836 - protein, 9 aa, Homo Sapiens
KALEVFPEF

SEQ ID NO: 134837 - protein, 9 aa, Homo Sapiens
KALEYLRQI

SEQ ID NO: 134838 - protein, 9 aa, Homo Sapiens
KALGFAKML

SEQ ID NO: 134839 - protein, 9 aa, Homo Sapiens
KALKIKREL

SEQ ID NO: 134840 - protein, 9 aa, Homo Sapiens
KALQAHWQL

SEQ ID NO: 134841 - protein, 9 aa, Homo Sapiens
KAMELIREL

SEQ ID NO: 134842 - protein, 9 aa, Homo Sapiens
KAMPLQPSI

SEQ ID NO: 134843 - protein, 9 aa, Homo Sapiens
KANPTTRLW

SEQ ID NO: 134844 - protein, 9 aa, Homo Sapiens
KAQHISRFI

SEQ ID NO: 134845 - protein, 9 aa, Homo Sapiens
KAREKVPKL

SEQ ID NO: 134846 - protein, 9 aa, Homo Sapiens
KARPDLERI

SEQ ID NO: 134847 - protein, 9 aa, Homo Sapiens
KARPFADLL

SEQ ID NO: 134848 - protein, 9 aa, Homo Sapiens
KARPFFNEF

SEQ ID NO: 134849 - protein, 9 aa, Homo Sapiens
KARPNIPVY

SEQ ID NO: 134850 - protein, 9 aa, Homo Sapiens
KATNVVRLL

SEQ ID NO: 134851 - protein, 9 aa, Homo Sapiens
KAVFTDRQL

SEQ ID NO: 134852 - protein, 9 aa, Homo Sapiens
KAVFVARVL

SEQ ID NO: 134853 - protein, 9 aa, Homo Sapiens
KAVSLQRKL

SEQ ID NO: 134854 - protein, 9 aa, Homo Sapiens
KAYKAYRLL

SEQ ID NO: 134855 - protein, 9 aa, Homo Sapiens
KAYSEAHEI

SEQ ID NO: 134856 - protein, 9 aa, Homo Sapiens
KGCPFHRII

SEQ ID NO: 134857 - protein, 9 aa, Homo Sapiens
KGFLFLHTL

SEQ ID NO: 134858 - protein, 9 aa, Homo Sapiens
KGQSTPRLF

SEQ ID NO: 134859 - protein, 9 aa, Homo Sapiens
KGSCFHRII

SEQ ID NO: 134860 - protein, 9 aa, Homo Sapiens
KILEIIRVI

SEQ ID NO: 134861 - protein, 9 aa, Homo Sapiens
KINEKPQVI

SEQ ID NO: 134862 - protein, 9 aa, Homo Sapiens
KIYPLPHMY

SEQ ID NO: 134863 - protein, 9 aa, Homo Sapiens
KLKVSLQTL

SEQ ID NO: 134864 - protein, 9 aa, Homo Sapiens
KSAIPHPLI

SEQ ID NO: 134865 - protein, 9 aa, Homo Sapiens
KSALLERAL

SEQ ID NO: 134866 - protein, 9 aa, Homo Sapiens
KSALVFITF

SEQ ID NO: 134867 - protein, 9 aa, Homo Sapiens
KSALVHRYL

SEQ ID NO: 134868 - protein, 9 aa, Homo Sapiens
KSCDLLLFL

SEQ ID NO: 134869 - protein, 9 aa, Homo Sapiens
KSCEKIHFI

SEQ ID NO: 134870 - protein, 9 aa, Homo Sapiens
KSCGLNPKL

SEQ ID NO: 134871 - protein, 9 aa, Homo Sapiens
KSCMNQVTI

SEQ ID NO: 134872 - protein, 9 aa, Homo Sapiens
KSCVIVLRI

SEQ ID NO: 134873 - protein, 9 aa, Homo Sapiens
KSFADINLY

SEQ ID NO: 134874 - protein, 9 aa, Homo Sapiens
KSFAKARNI

SEQ ID NO: 134875 - protein, 9 aa, Homo Sapiens
KSFDFHFGF

SEQ ID NO: 134876 - protein, 9 aa, Homo Sapiens
KSFDNIRNW

SEQ ID NO: 134877 - protein, 9 aa, Homo Sapiens
KSFEAPATI

SEQ ID NO: 134878 - protein, 9 aa, Homo Sapiens
KSFEGLFYF

SEQ ID NO: 134879 - protein, 9 aa, Homo Sapiens
KSFEKLMKI

SEQ ID NO: 134880 - protein, 9 aa, Homo Sapiens
KSFENISKW

SEQ ID NO: 134881 - protein, 9 aa, Homo Sapiens
KSFFEAKKL

SEQ ID NO: 134882 - protein, 9 aa, Homo Sapiens
KSFFKRKTI

SEQ ID NO: 134883 - protein, 9 aa, Homo Sapiens
KSFGGSHVM

SEQ ID NO: 134884 - protein, 9 aa, Homo Sapiens
KSFINSETI

SEQ ID NO: 134885 - protein, 9 aa, Homo Sapiens
KSFIRKQNL

SEQ ID NO: 134886 - protein, 9 aa, Homo Sapiens
KSFLGVKEL

SEQ ID NO: 134887 - protein, 9 aa, Homo Sapiens
KSFLHKQTL

SEQ ID NO: 134888 - protein, 9 aa, Homo Sapiens
KSFNFDRVF

SEQ ID NO: 134889 - protein, 9 aa, Homo Sapiens
KSFNMQRKL

SEQ ID NO: 134890 - protein, 9 aa, Homo Sapiens
KSFNSVHLL

SEQ ID NO: 134891 - protein, 9 aa, Homo Sapiens
KSFPGGKEY

SEQ ID NO: 134892 - protein, 9 aa, Homo Sapiens
KSFPSIFKF

SEQ ID NO: 134893 - protein, 9 aa, Homo Sapiens
KSFQAIHQF

SEQ ID NO: 134894 - protein, 9 aa, Homo Sapiens
KSFQLQVSL

SEQ ID NO: 134895 - protein, 9 aa, Homo Sapiens
KSFQYSHNL

SEQ ID NO: 134896 - protein, 9 aa, Homo Sapiens
KSFSEDRLI

SEQ ID NO: 134897 - protein, 9 aa, Homo Sapiens
KSFSFVRVI

SEQ ID NO: 134898 - protein, 9 aa, Homo Sapiens
KSFSGSYRL

SEQ ID NO: 134899 - protein, 9 aa, Homo Sapiens
KSFSQKTTL

SEQ ID NO: 134900 - protein, 9 aa, Homo Sapiens
KSFSQQRSL

SEQ ID NO: 134901 - protein, 9 aa, Homo Sapiens
KSFSYKRNL

SEQ ID NO: 134902 - protein, 9 aa, Homo Sapiens
KSFTHSSTF

SEQ ID NO: 134903 - protein, 9 aa, Homo Sapiens
KSFVCAWNL

SEQ ID NO: 134904 - protein, 9 aa, Homo Sapiens
KSFVKPPSL

SEQ ID NO: 134905 - protein, 9 aa, Homo Sapiens
KSFVKVYNY

SEQ ID NO: 134906 - protein, 9 aa, Homo Sapiens
KSFVQKQHL

SEQ ID NO: 134907 - protein, 9 aa, Homo Sapiens
KSFVTKRSL

SEQ ID NO: 134908 - protein, 9 aa, Homo Sapiens
KSFYDARLL

SEQ ID NO: 134909 - protein, 9 aa, Homo Sapiens
KSFYQFQHY

SEQ ID NO: 134910 - protein, 9 aa, Homo Sapiens
KSHIFFWTW

SEQ ID NO: 134911 - protein, 9 aa, Homo Sapiens
KSIAKADLI

SEQ ID NO: 134912 - protein, 9 aa, Homo Sapiens
KSIDCIRAF

SEQ ID NO: 134913 - protein, 9 aa, Homo Sapiens
KSIDLIQKW

SEQ ID NO: 134914 - protein, 9 aa, Homo Sapiens
KSIEERVTI

SEQ ID NO: 134915 - protein, 9 aa, Homo Sapiens
KSIELFYKF

SEQ ID NO: 134916 - protein, 9 aa, Homo Sapiens
KSIHHARVL

SEQ ID NO: 134917 - protein, 9 aa, Homo Sapiens
KSIHIVVTM

SEQ ID NO: 134918 - protein, 9 aa, Homo Sapiens
KSIHLSINF

SEQ ID NO: 134919 - protein, 9 aa, Homo Sapiens
KSIKIAWAL

SEQ ID NO: 134920 - protein, 9 aa, Homo Sapiens
KSIKIVKKL

SEQ ID NO: 134921 - protein, 9 aa, Homo Sapiens
KSIKNIQKI

SEQ ID NO: 134922 - protein, 9 aa, Homo Sapiens
KSIPVTQEL

SEQ ID NO: 134923 - protein, 9 aa, Homo Sapiens
KSIQAAFKF

SEQ ID NO: 134924 - protein, 9 aa, Homo Sapiens
KSITNPRYL

SEQ ID NO: 134925 - protein, 9 aa, Homo Sapiens
KSIVIMVHI

SEQ ID NO: 134926 - protein, 9 aa, Homo Sapiens
KSIVQVETL

SEQ ID NO: 134927 - protein, 9 aa, Homo Sapiens
KSIWNNRWL

SEQ ID NO: 134928 - protein, 9 aa, Homo Sapiens
KSKDFVQVM

SEQ ID NO: 134929 - protein, 9 aa, Homo Sapiens
KSKDVIKTI

SEQ ID NO: 134930 - protein, 9 aa, Homo Sapiens
KSKEFAQII

SEQ ID NO: 134931 - protein, 9 aa, Homo Sapiens
KSKEIEAKI

SEQ ID NO: 134932 - protein, 9 aa, Homo Sapiens
KSKEISQFL

SEQ ID NO: 134933 - protein, 9 aa, Homo Sapiens
KSKGWVNTL

SEQ ID NO: 134934 - protein, 9 aa, Homo Sapiens
KSKILKQVI

SEQ ID NO: 134935 - protein, 9 aa, Homo Sapiens
KSKLDIWNI

SEQ ID NO: 134936 - protein, 9 aa, Homo Sapiens
KSKNILFVI

SEQ ID NO: 134937 - protein, 9 aa, Homo Sapiens
KSKPDKQLI

SEQ ID NO: 134938 - protein, 9 aa, Homo Sapiens
KSKPFCEKL

SEQ ID NO: 134939 - protein, 9 aa, Homo Sapiens
KSKPIFWNL

SEQ ID NO: 134940 - protein, 9 aa, Homo Sapiens
KSKPMTQIL

SEQ ID NO: 134941 - protein, 9 aa, Homo Sapiens
KSKPVPLKL

SEQ ID NO: 134942 - protein, 9 aa, Homo Sapiens
KSKSFFDNI

SEQ ID NO: 134943 - protein, 9 aa, Homo Sapiens
KSKTLQEFL

SEQ ID NO: 134944 - protein, 9 aa, Homo Sapiens
KSKYFESKF

SEQ ID NO: 134945 - protein, 9 aa, Homo Sapiens
KSLAKTFHL

SEQ ID NO: 134946 - protein, 9 aa, Homo Sapiens
KSLCLKLLL

SEQ ID NO: 134947 - protein, 9 aa, Homo Sapiens
KSLDFGFTI

SEQ ID NO: 134948 - protein, 9 aa, Homo Sapiens
KSLEAFFLY

SEQ ID NO: 134949 - protein, 9 aa, Homo Sapiens
KSLEKSELI

SEQ ID NO: 134950 - protein, 9 aa, Homo Sapiens
KSLENAIEW

SEQ ID NO: 134951 - protein, 9 aa, Homo Sapiens
KSLFLGQKL

SEQ ID NO: 134952 - protein, 9 aa, Homo Sapiens
KSLFLIIKI

SEQ ID NO: 134953 - protein, 9 aa, Homo Sapiens
KSLGMERLL

SEQ ID NO: 134954 - protein, 9 aa, Homo Sapiens
KSLITTHHL

SEQ ID NO: 134955 - protein, 9 aa, Homo Sapiens
KSLKILRNM

SEQ ID NO: 134956 - protein, 9 aa, Homo Sapiens
KSLKQNINL

SEQ ID NO: 134957 - protein, 9 aa, Homo Sapiens
KSLLFVNTL

SEQ ID NO: 134958 - protein, 9 aa, Homo Sapiens
KSLLVVHFW

SEQ ID NO: 134959 - protein, 9 aa, Homo Sapiens
KSLLWTETF

SEQ ID NO: 134960 - protein, 9 aa, Homo Sapiens
KSLMIKREL

SEQ ID NO: 134961 - protein, 9 aa, Homo Sapiens
KSLPLVRKI

SEQ ID NO: 134962 - protein, 9 aa, Homo Sapiens
KSLQMIRQL

SEQ ID NO: 134963 - protein, 9 aa, Homo Sapiens
KSLQTLRSF

SEQ ID NO: 134964 - protein, 9 aa, Homo Sapiens
KSLWKSSTI

SEQ ID NO: 134965 - protein, 9 aa, Homo Sapiens
KSMAERAAI

SEQ ID NO: 134966 - protein, 9 aa, Homo Sapiens
KSMDAIRSL

SEQ ID NO: 134967 - protein, 9 aa, Homo Sapiens
KSMFLARVL

SEQ ID NO: 134968 - protein, 9 aa, Homo Sapiens
KSMKVVKLF

SEQ ID NO: 134969 - protein, 9 aa, Homo Sapiens
KSMLFKREL

SEQ ID NO: 134970 - protein, 9 aa, Homo Sapiens
KSMNKSIHI

SEQ ID NO: 134971 - protein, 9 aa, Homo Sapiens
KSMPTVTQI

SEQ ID NO: 134972 - protein, 9 aa, Homo Sapiens
KSMSVERTF

SEQ ID NO: 134973 - protein, 9 aa, Homo Sapiens
KSNPIIRTV

SEQ ID NO: 134974 - protein, 9 aa, Homo Sapiens
KSNPKPLVL

SEQ ID NO: 134975 - protein, 9 aa, Homo Sapiens
KSQEQVHLL

SEQ ID NO: 134976 - protein, 9 aa, Homo Sapiens
KSQIPLSKI

SEQ ID NO: 134977 - protein, 9 aa, Homo Sapiens
KSQVDAQLL

SEQ ID NO: 134978 - protein, 9 aa, Homo Sapiens
KSRDLSLLI

SEQ ID NO: 134979 - protein, 9 aa, Homo Sapiens
KSRDYEREI

SEQ ID NO: 134980 - protein, 9 aa, Homo Sapiens
KSRLFEFSL

SEQ ID NO: 134981 - protein, 9 aa, Homo Sapiens
KSRQELNTI

SEQ ID NO: 134982 - protein, 9 aa, Homo Sapiens
KSRQFLQFF

SEQ ID NO: 134983 - protein, 9 aa, Homo Sapiens
KSRVVLPYL

SEQ ID NO: 134984 - protein, 9 aa, Homo Sapiens
KSSDIAKTF

SEQ ID NO: 134985 - protein, 9 aa, Homo Sapiens
KSSLIHRFL

SEQ ID NO: 134986 - protein, 9 aa, Homo Sapiens
KSSNVVRSF

SEQ ID NO: 134987 - protein, 9 aa, Homo Sapiens
KSSQPKPVI

SEQ ID NO: 134988 - protein, 9 aa, Homo Sapiens
KSSTVLHTF

SEQ ID NO: 134989 - protein, 9 aa, Homo Sapiens
KSTAISLFY

SEQ ID NO: 134990 - protein, 9 aa, Homo Sapiens
KSTDVAKTF

SEQ ID NO: 134991 - protein, 9 aa, Homo Sapiens
KSTEFPRKI

SEQ ID NO: 134992 - protein, 9 aa, Homo Sapiens
KSTSLTFHW

SEQ ID NO: 134993 - protein, 9 aa, Homo Sapiens
KSTTCTRFF

SEQ ID NO: 134994 - protein, 9 aa, Homo Sapiens
KSTTTGHLI

SEQ ID NO: 134995 - protein, 9 aa, Homo Sapiens
KSTVNKWTL

SEQ ID NO: 134996 - protein, 9 aa, Homo Sapiens
KSVFITRKL

SEQ ID NO: 134997 - protein, 9 aa, Homo Sapiens
KSVKIYRLI

SEQ ID NO: 134998 - protein, 9 aa, Homo Sapiens
KSVLVKQTI

SEQ ID NO: 134999 - protein, 9 aa, Homo Sapiens
KSVTAFFKW

SEQ ID NO: 135000 - protein, 9 aa, Homo Sapiens
KSVTAFFTW

SEQ ID NO: 135001 - protein, 9 aa, Homo Sapiens
KSVTLGYLF

SEQ ID NO: 135002 - protein, 9 aa, Homo Sapiens
KSVVSYWNL

SEQ ID NO: 135003 - protein, 9 aa, Homo Sapiens
KSVYWENTL

SEQ ID NO: 135004 - protein, 9 aa, Homo Sapiens
KSYAGEKIL

SEQ ID NO: 135005 - protein, 9 aa, Homo Sapiens
KSYAGYQTL

SEQ ID NO: 135006 - protein, 9 aa, Homo Sapiens
KSYDRNYRL

SEQ ID NO: 135007 - protein, 9 aa, Homo Sapiens
KSYELIRKI

SEQ ID NO: 135008 - protein, 9 aa, Homo Sapiens
KSYKGRQII

SEQ ID NO: 135009 - protein, 9 aa, Homo Sapiens
KSYLRCITF

SEQ ID NO: 135010 - protein, 9 aa, Homo Sapiens
KSYNICFEL

SEQ ID NO: 135011 - protein, 9 aa, Homo Sapiens
KSYNQRVHL

SEQ ID NO: 135012 - protein, 9 aa, Homo Sapiens
KSYPETHII

SEQ ID NO: 135013 - protein, 9 aa, Homo Sapiens
KSYQSFQTF

SEQ ID NO: 135014 - protein, 9 aa, Homo Sapiens
KSYSKAFTL

SEQ ID NO: 135015 - protein, 9 aa, Homo Sapiens
KSYVKYQVI

SEQ ID NO: 135016 - protein, 9 aa, Homo Sapiens
KSYVQGVTW

SEQ ID NO: 135017 - protein, 9 aa, Homo Sapiens
KSYYHVYKL

SEQ ID NO: 135018 - protein, 9 aa, Homo Sapiens
KSYYLRNTF

SEQ ID NO: 135019 - protein, 9 aa, Homo Sapiens
KSYYTVHLL

SEQ ID NO: 135020 - protein, 9 aa, Homo Sapiens
KSYYTVRQL

SEQ ID NO: 135021 - protein, 9 aa, Homo Sapiens
KTADVTKVW

SEQ ID NO: 135022 - protein, 9 aa, Homo Sapiens
KTAVVVGTI

SEQ ID NO: 135023 - protein, 9 aa, Homo Sapiens
KTFAEARLI

SEQ ID NO: 135024 - protein, 9 aa, Homo Sapiens
KTFHPVPNL

SEQ ID NO: 135025 - protein, 9 aa, Homo Sapiens
KTFPFHFMF

SEQ ID NO: 135026 - protein, 9 aa, Homo Sapiens
KTFPYQHRY

SEQ ID NO: 135027 - protein, 9 aa, Homo Sapiens
KTFRIKRFL

SEQ ID NO: 135028 - protein, 9 aa, Homo Sapiens
KTFTGHREW

SEQ ID NO: 135029 - protein, 9 aa, Homo Sapiens
KTFTIKRFL

SEQ ID NO: 135030 - protein, 9 aa, Homo Sapiens
KTFTTQETI

SEQ ID NO: 135031 - protein, 9 aa, Homo Sapiens
KTFVHTVHL

SEQ ID NO: 135032 - protein, 9 aa, Homo Sapiens
KTFVQKQTL

SEQ ID NO: 135033 - protein, 9 aa, Homo Sapiens
KTFVQKSTL

SEQ ID NO: 135034 - protein, 9 aa, Homo Sapiens
KTIDNQRVY

SEQ ID NO: 135035 - protein, 9 aa, Homo Sapiens
KTIEDVREF

SEQ ID NO: 135036 - protein, 9 aa, Homo Sapiens
KTIHKYVHL

SEQ ID NO: 135037 - protein, 9 aa, Homo Sapiens
KTIKLWNTL

SEQ ID NO: 135038 - protein, 9 aa, Homo Sapiens
KTIKSLRVL

SEQ ID NO: 135039 - protein, 9 aa, Homo Sapiens
KTIMLKRIY

SEQ ID NO: 135040 - protein, 9 aa, Homo Sapiens
KTKALQTVI

SEQ ID NO: 135041 - protein, 9 aa, Homo Sapiens
KTKDIVNGL

SEQ ID NO: 135042 - protein, 9 aa, Homo Sapiens
KTKEIEQVY

SEQ ID NO: 135043 - protein, 9 aa, Homo Sapiens
KTKETIQVL

SEQ ID NO: 135044 - protein, 9 aa, Homo Sapiens
KTKEVIQEW

SEQ ID NO: 135045 - protein, 9 aa, Homo Sapiens
KTKFEQHTI

SEQ ID NO: 135046 - protein, 9 aa, Homo Sapiens
KTKGFDYLL

SEQ ID NO: 135047 - protein, 9 aa, Homo Sapiens
KTKGFEVYL

SEQ ID NO: 135048 - protein, 9 aa, Homo Sapiens
KTKGFHTTI

SEQ ID NO: 135049 - protein, 9 aa, Homo Sapiens
KTKPFQLQL

SEQ ID NO: 135050 - protein, 9 aa, Homo Sapiens
KTKPHLFYI

SEQ ID NO: 135051 - protein, 9 aa, Homo Sapiens
KTKPIHTII

SEQ ID NO: 135052 - protein, 9 aa, Homo Sapiens
KTKPLTPSI

SEQ ID NO: 135053 - protein, 9 aa, Homo Sapiens
KTKQVIQGL

SEQ ID NO: 135054 - protein, 9 aa, Homo Sapiens
KTKSFFDNI

SEQ ID NO: 135055 - protein, 9 aa, Homo Sapiens
KTLDQIRTI

SEQ ID NO: 135056 - protein, 9 aa, Homo Sapiens
KTLELPHVF

SEQ ID NO: 135057 - protein, 9 aa, Homo Sapiens
KTLERSYLL

SEQ ID NO: 135058 - protein, 9 aa, Homo Sapiens
KTLFILRGL

SEQ ID NO: 135059 - protein, 9 aa, Homo Sapiens
KTLKEIRTL

SEQ ID NO: 135060 - protein, 9 aa, Homo Sapiens
KTLLFVRLL

SEQ ID NO: 135061 - protein, 9 aa, Homo Sapiens
KTLQEVHFL

SEQ ID NO: 135062 - protein, 9 aa, Homo Sapiens
KTMHNLRLL

SEQ ID NO: 135063 - protein, 9 aa, Homo Sapiens
KTNILLRYL

SEQ ID NO: 135064 - protein, 9 aa, Homo Sapiens
KTNPKIQSI

SEQ ID NO: 135065 - protein, 9 aa, Homo Sapiens
KTNQLQRII

SEQ ID NO: 135066 - protein, 9 aa, Homo Sapiens
KTQGPRALW

SEQ ID NO: 135067 - protein, 9 aa, Homo Sapiens
KTRHLALNL

SEQ ID NO: 135068 - protein, 9 aa, Homo Sapiens
KTRHVNILL

SEQ ID NO: 135069 - protein, 9 aa, Homo Sapiens
KTRLINQVL

SEQ ID NO: 135070 - protein, 9 aa, Homo Sapiens
KTRMEERRL

SEQ ID NO: 135071 - protein, 9 aa, Homo Sapiens
KTRQIISTI

SEQ ID NO: 135072 - protein, 9 aa, Homo Sapiens
KTRSVEQTL

SEQ ID NO: 135073 - protein, 9 aa, Homo Sapiens
KTRTNVPTF

SEQ ID NO: 135074 - protein, 9 aa, Homo Sapiens
KTRYIFDLF

SEQ ID NO: 135075 - protein, 9 aa, Homo Sapiens
KTTFVKRHL

SEQ ID NO: 135076 - protein, 9 aa, Homo Sapiens
KTVAIHTLW

SEQ ID NO: 135077 - protein, 9 aa, Homo Sapiens
KTVPQKVTI

SEQ ID NO: 135078 - protein, 9 aa, Homo Sapiens
KTWHKGTLI

SEQ ID NO: 135079 - protein, 9 aa, Homo Sapiens
KTYFKAAKL

SEQ ID NO: 135080 - protein, 9 aa, Homo Sapiens
KTYPLGRIL

SEQ ID NO: 135081 - protein, 9 aa, Homo Sapiens
KTYSLLHQW

SEQ ID NO: 135082 - protein, 9 aa, Homo Sapiens
KVAEVTKKF

SEQ ID NO: 135083 - protein, 9 aa, Homo Sapiens
KVCKIHRML

SEQ ID NO: 135084 - protein, 9 aa, Homo Sapiens
KVFNKKRLL

SEQ ID NO: 135085 - protein, 9 aa, Homo Sapiens
KVFNQKRYL

SEQ ID NO: 135086 - protein, 9 aa, Homo Sapiens
KVIKIAWAL

SEQ ID NO: 135087 - protein, 9 aa, Homo Sapiens
KVINAAHSF

SEQ ID NO: 135088 - protein, 9 aa, Homo Sapiens
KVIPVTRSL

SEQ ID NO: 135089 - protein, 9 aa, Homo Sapiens
KVKEFCENL

SEQ ID NO: 135090 - protein, 9 aa, Homo Sapiens
KVKELAETI

SEQ ID NO: 135091 - protein, 9 aa, Homo Sapiens
KVKPNLQTF

SEQ ID NO: 135092 - protein, 9 aa, Homo Sapiens
KVKQFDFLF

SEQ ID NO: 135093 - protein, 9 aa, Homo Sapiens
KVKTDTVLI

SEQ ID NO: 135094 - protein, 9 aa, Homo Sapiens
KVLELQRKL

SEQ ID NO: 135095 - protein, 9 aa, Homo Sapiens
KVNKIVRTL

SEQ ID NO: 135096 - protein, 9 aa, Homo Sapiens
KVQEFQRLL

SEQ ID NO: 135097 - protein, 9 aa, Homo Sapiens
KVTELLRTF

SEQ ID NO: 135098 - protein, 9 aa, Homo Sapiens
KVTTVKKFF

SEQ ID NO: 135099 - protein, 9 aa, Homo Sapiens
KVVDVVRNL

SEQ ID NO: 135100 - protein, 9 aa, Homo Sapiens
LACPLLRQL

SEQ ID NO: 135101 - protein, 9 aa, Homo Sapiens
LARAILRKN

SEQ ID NO: 135102 - protein, 9 aa, Homo Sapiens
LSCTLNRYL

SEQ ID NO: 135103 - protein, 9 aa, Homo Sapiens
LSFFMARVF

SEQ ID NO: 135104 - protein, 9 aa, Homo Sapiens
LSFHQGCTI

SEQ ID NO: 135105 - protein, 9 aa, Homo Sapiens
LSGAIVSLS

SEQ ID NO: 135106 - protein, 9 aa, Homo Sapiens
LSIHLQHKF

SEQ ID NO: 135107 - protein, 9 aa, Homo Sapiens
LSKPFTNTL

SEQ ID NO: 135108 - protein, 9 aa, Homo Sapiens
LSKPNPPSL

SEQ ID NO: 135109 - protein, 9 aa, Homo Sapiens
LSLKVLRKL

SEQ ID NO: 135110 - protein, 9 aa, Homo Sapiens
LSLPLNREL

SEQ ID NO: 135111 - protein, 9 aa, Homo Sapiens
LSLTLLHLL

SEQ ID NO: 135112 - protein, 9 aa, Homo Sapiens
LSMIIIRTL

SEQ ID NO: 135113 - protein, 9 aa, Homo Sapiens
LSNAQARVI

SEQ ID NO: 135114 - protein, 9 aa, Homo Sapiens
LSNKTPRSL

SEQ ID NO: 135115 - protein, 9 aa, Homo Sapiens
LSNPDPRLL

SEQ ID NO: 135116 - protein, 9 aa, Homo Sapiens
LSQPILLEL

SEQ ID NO: 135117 - protein, 9 aa, Homo Sapiens
LSQPTPATL

SEQ ID NO: 135118 - protein, 9 aa, Homo Sapiens
LSSPVQRTL

SEQ ID NO: 135119 - protein, 9 aa, Homo Sapiens
LSSSVIREL

SEQ ID NO: 135120 - protein, 9 aa, Homo Sapiens
LSTTVKREL

SEQ ID NO: 135121 - protein, 9 aa, Homo Sapiens
LTIPVQRLL

SEQ ID NO: 135122 - protein, 9 aa, Homo Sapiens
LTKISFHLK

SEQ ID NO: 135123 - protein, 9 aa, Homo Sapiens
LTKKIKQCL

SEQ ID NO: 135124 - protein, 9 aa, Homo Sapiens
LTKQEFQTL

SEQ ID NO: 135125 - protein, 9 aa, Homo Sapiens
LTLKSHRLL

SEQ ID NO: 135126 - protein, 9 aa, Homo Sapiens
LTNGSGRYI

SEQ ID NO: 135127 - protein, 9 aa, Homo Sapiens
LTYASPPLI

SEQ ID NO: 135128 - protein, 9 aa, Homo Sapiens
LTYQLCHTY

SEQ ID NO: 135129 - protein, 9 aa, Homo Sapiens
LVNICLNVL

SEQ ID NO: 135130 - protein, 9 aa, Homo Sapiens
MAAGTPILR

SEQ ID NO: 135131 - protein, 9 aa, Homo Sapiens
MARKINFLM

SEQ ID NO: 135132 - protein, 9 aa, Homo Sapiens
MSNKACRYF

SEQ ID NO: 135133 - protein, 9 aa, Homo Sapiens
MSYEEKRQL

SEQ ID NO: 135134 - protein, 9 aa, Homo Sapiens
MTYKHPHVL

SEQ ID NO: 135135 - protein, 9 aa, Homo Sapiens
PSSNKPRVI

SEQ ID NO: 135136 - protein, 9 aa, Homo Sapiens
QATQAARKL

SEQ ID NO: 135137 - protein, 9 aa, Homo Sapiens
QSFTGSRTY

SEQ ID NO: 135138 - protein, 9 aa, Homo Sapiens
QSIRIQRML

SEQ ID NO: 135139 - protein, 9 aa, Homo Sapiens
QSLQIFRKW

SEQ ID NO: 135140 - protein, 9 aa, Homo Sapiens
QSLRFEHKL

SEQ ID NO: 135141 - protein, 9 aa, Homo Sapiens
QSLRLVRKL

SEQ ID NO: 135142 - protein, 9 aa, Homo Sapiens
QSMKIMHEI

SEQ ID NO: 135143 - protein, 9 aa, Homo Sapiens
QSTDIIRYL

SEQ ID NO: 135144 - protein, 9 aa, Homo Sapiens
QTSKTQRLL

SEQ ID NO: 135145 - protein, 9 aa, Homo Sapiens
RAADIRRKL

SEQ ID NO: 135146 - protein, 9 aa, Homo Sapiens
RAAQLQRKF

SEQ ID NO: 135147 - protein, 9 aa, Homo Sapiens
RAAVVIRTL

SEQ ID NO: 135148 - protein, 9 aa, Homo Sapiens
RAIDKCWKI

SEQ ID NO: 135149 - protein, 9 aa, Homo Sapiens
RAKATRISI

SEQ ID NO: 135150 - protein, 9 aa, Homo Sapiens
RAKTVVLHI

SEQ ID NO: 135151 - protein, 9 aa, Homo Sapiens
RALELTRRL

SEQ ID NO: 135152 - protein, 9 aa, Homo Sapiens
RALKEIRKF

SEQ ID NO: 135153 - protein, 9 aa, Homo Sapiens
RALPHHRVI

SEQ ID NO: 135154 - protein, 9 aa, Homo Sapiens
RALSIQRLW

SEQ ID NO: 135155 - protein, 9 aa, Homo Sapiens
RANVNARTF

SEQ ID NO: 135156 - protein, 9 aa, Homo Sapiens
RAREYNARL

SEQ ID NO: 135157 - protein, 9 aa, Homo Sapiens
RARQLNYTI

SEQ ID NO: 135158 - protein, 9 aa, Homo Sapiens
RARTIYERF

SEQ ID NO: 135159 - protein, 9 aa, Homo Sapiens
RAWQERRLL

SEQ ID NO: 135160 - protein, 9 aa, Homo Sapiens
RAYPAAITI

SEQ ID NO: 135161 - protein, 9 aa, Homo Sapiens
RIHFPLATY

SEQ ID NO: 135162 - protein, 9 aa, Homo Sapiens
RIHVCLYFI

SEQ ID NO: 135163 - protein, 9 aa, Homo Sapiens
RLYPGQRHL

SEQ ID NO: 135164 - protein, 9 aa, Homo Sapiens
RSALVNNTI

SEQ ID NO: 135165 - protein, 9 aa, Homo Sapiens
RSAPVYKRI

SEQ ID NO: 135166 - protein, 9 aa, Homo Sapiens
RSFFHQHYL

SEQ ID NO: 135167 - protein, 9 aa, Homo Sapiens
RSFHEVREF

SEQ ID NO: 135168 - protein, 9 aa, Homo Sapiens
RSFHRTQDL

SEQ ID NO: 135169 - protein, 9 aa, Homo Sapiens
RSFLKSCHF

SEQ ID NO: 135170 - protein, 9 aa, Homo Sapiens
RSFPSVREL

SEQ ID NO: 135171 - protein, 9 aa, Homo Sapiens
RSFQGPVLI

SEQ ID NO: 135172 - protein, 9 aa, Homo Sapiens
RSFQMQYNL

SEQ ID NO: 135173 - protein, 9 aa, Homo Sapiens
RSHVVQRVL

SEQ ID NO: 135174 - protein, 9 aa, Homo Sapiens
RSIDLNRLI

SEQ ID NO: 135175 - protein, 9 aa, Homo Sapiens
RSIDLTVKL

SEQ ID NO: 135176 - protein, 9 aa, Homo Sapiens
RSIHIFDTL

SEQ ID NO: 135177 - protein, 9 aa, Homo Sapiens
RSIIFANYI

SEQ ID NO: 135178 - protein, 9 aa, Homo Sapiens
RSIILNHVI

SEQ ID NO: 135179 - protein, 9 aa, Homo Sapiens
RSINKLIRI

SEQ ID NO: 135180 - protein, 9 aa, Homo Sapiens
RSIPTHREI

SEQ ID NO: 135181 - protein, 9 aa, Homo Sapiens
RSIPVWIKI

SEQ ID NO: 135182 - protein, 9 aa, Homo Sapiens
RSIQQGFCF

SEQ ID NO: 135183 - protein, 9 aa, Homo Sapiens
RSIRLPETI

SEQ ID NO: 135184 - protein, 9 aa, Homo Sapiens
RSITLHHRI

SEQ ID NO: 135185 - protein, 9 aa, Homo Sapiens
RSKAIRYTW

SEQ ID NO: 135186 - protein, 9 aa, Homo Sapiens
RSKDTCIVI

SEQ ID NO: 135187 - protein, 9 aa, Homo Sapiens
RSKDTDALI

SEQ ID NO: 135188 - protein, 9 aa, Homo Sapiens
RSKKLSVLI

SEQ ID NO: 135189 - protein, 9 aa, Homo Sapiens
RSKPLFHHF

SEQ ID NO: 135190 - protein, 9 aa, Homo Sapiens
RSKQEFQFF

SEQ ID NO: 135191 - protein, 9 aa, Homo Sapiens
RSLAYIHSF

SEQ ID NO: 135192 - protein, 9 aa, Homo Sapiens
RSLEGGFKI

SEQ ID NO: 135193 - protein, 9 aa, Homo Sapiens
RSLFIDRTI

SEQ ID NO: 135194 - protein, 9 aa, Homo Sapiens
RSLFLGRIL

SEQ ID NO: 135195 - protein, 9 aa, Homo Sapiens
RSLGFNTQI

SEQ ID NO: 135196 - protein, 9 aa, Homo Sapiens
RSLGGTRLF

SEQ ID NO: 135197 - protein, 9 aa, Homo Sapiens
RSLHLEASL

SEQ ID NO: 135198 - protein, 9 aa, Homo Sapiens
RSLHLQKSL

SEQ ID NO: 135199 - protein, 9 aa, Homo Sapiens
RSLKLAYTL

SEQ ID NO: 135200 - protein, 9 aa, Homo Sapiens
RSLKVWRTL

SEQ ID NO: 135201 - protein, 9 aa, Homo Sapiens
RSLLADRLL

SEQ ID NO: 135202 - protein, 9 aa, Homo Sapiens
RSLLLQKKL

SEQ ID NO: 135203 - protein, 9 aa, Homo Sapiens
RSLLQENNW

SEQ ID NO: 135204 - protein, 9 aa, Homo Sapiens
RSLLVNRSL

SEQ ID NO: 135205 - protein, 9 aa, Homo Sapiens
RSLNPPLTI

SEQ ID NO: 135206 - protein, 9 aa, Homo Sapiens
RSLPEIWTL

SEQ ID NO: 135207 - protein, 9 aa, Homo Sapiens
RSLQTICSW

SEQ ID NO: 135208 - protein, 9 aa, Homo Sapiens
RSLSTTNVF

SEQ ID NO: 135209 - protein, 9 aa, Homo Sapiens
RSLTHPPTI

SEQ ID NO: 135210 - protein, 9 aa, Homo Sapiens
RSLWKDVTF

SEQ ID NO: 135211 - protein, 9 aa, Homo Sapiens
RSMVFARHL

SEQ ID NO: 135212 - protein, 9 aa, Homo Sapiens
RSNPSVFVI

SEQ ID NO: 135213 - protein, 9 aa, Homo Sapiens
RSQEKCYLF

SEQ ID NO: 135214 - protein, 9 aa, Homo Sapiens
RSRATIFEI

SEQ ID NO: 135215 - protein, 9 aa, Homo Sapiens
RSRDTCIVI

SEQ ID NO: 135216 - protein, 9 aa, Homo Sapiens
RSRDYQPLL

SEQ ID NO: 135217 - protein, 9 aa, Homo Sapiens
RSREFLDFL

SEQ ID NO: 135218 - protein, 9 aa, Homo Sapiens
RSRIPMETL

SEQ ID NO: 135219 - protein, 9 aa, Homo Sapiens
RSRPEYFRI

SEQ ID NO: 135220 - protein, 9 aa, Homo Sapiens
RSRPHTRLF

SEQ ID NO: 135221 - protein, 9 aa, Homo Sapiens
RSRSFDYNY

SEQ ID NO: 135222 - protein, 9 aa, Homo Sapiens
RSRSLAPVL

SEQ ID NO: 135223 - protein, 9 aa, Homo Sapiens
RSRTIVHTL

SEQ ID NO: 135224 - protein, 9 aa, Homo Sapiens
RSSQFARKL

SEQ ID NO: 135225 - protein, 9 aa, Homo Sapiens
RSTDSIRLL

SEQ ID NO: 135226 - protein, 9 aa, Homo Sapiens
RSTQLIRHL

SEQ ID NO: 135227 - protein, 9 aa, Homo Sapiens
RSWGGCRSL

SEQ ID NO: 135228 - protein, 9 aa, Homo Sapiens
RSYPHLRRV

SEQ ID NO: 135229 - protein, 9 aa, Homo Sapiens
RSYSRLETL

SEQ ID NO: 135230 - protein, 9 aa, Homo Sapiens
RSYTLIRKL

SEQ ID NO: 135231 - protein, 9 aa, Homo Sapiens
RSYWKEVLL

SEQ ID NO: 135232 - protein, 9 aa, Homo Sapiens
RTCTLLREM

SEQ ID NO: 135233 - protein, 9 aa, Homo Sapiens
RTFHIFYYL

SEQ ID NO: 135234 - protein, 9 aa, Homo Sapiens
RTFLHTVCF

SEQ ID NO: 135235 - protein, 9 aa, Homo Sapiens
RTFLLTYVL

SEQ ID NO: 135236 - protein, 9 aa, Homo Sapiens
RTFPDPTSW

SEQ ID NO: 135237 - protein, 9 aa, Homo Sapiens
RTFTLKHSL

SEQ ID NO: 135238 - protein, 9 aa, Homo Sapiens
RTIGFFYTL

SEQ ID NO: 135239 - protein, 9 aa, Homo Sapiens
RTIREVRTL

SEQ ID NO: 135240 - protein, 9 aa, Homo Sapiens
RTIVIRRDY

SEQ ID NO: 135241 - protein, 9 aa, Homo Sapiens
RTIVLQESI

SEQ ID NO: 135242 - protein, 9 aa, Homo Sapiens
RTKQVLHTF

SEQ ID NO: 135243 - protein, 9 aa, Homo Sapiens
RTLAEARRL

SEQ ID NO: 135244 - protein, 9 aa, Homo Sapiens
RTLAIARNL

SEQ ID NO: 135245 - protein, 9 aa, Homo Sapiens
RTLAVERLL

SEQ ID NO: 135246 - protein, 9 aa, Homo Sapiens
RTLEQARQL

SEQ ID NO: 135247 - protein, 9 aa, Homo Sapiens
RTLHHNWRY

SEQ ID NO: 135248 - protein, 9 aa, Homo Sapiens
RTLPTPRTL

SEQ ID NO: 135249 - protein, 9 aa, Homo Sapiens
RTMEWVQTI

SEQ ID NO: 135250 - protein, 9 aa, Homo Sapiens
RTTEILHHL

SEQ ID NO: 135251 - protein, 9 aa, Homo Sapiens
RTTNLIRHF

SEQ ID NO: 135252 - protein, 9 aa, Homo Sapiens
RTTVVARKL

SEQ ID NO: 135253 - protein, 9 aa, Homo Sapiens
RTTYIKRVI

SEQ ID NO: 135254 - protein, 9 aa, Homo Sapiens
RTVEKPPKF

SEQ ID NO: 135255 - protein, 9 aa, Homo Sapiens
RTVEKTWKL

SEQ ID NO: 135256 - protein, 9 aa, Homo Sapiens
RTVQSFRHL

SEQ ID NO: 135257 - protein, 9 aa, Homo Sapiens
RTVRIWRQY

SEQ ID NO: 135258 - protein, 9 aa, Homo Sapiens
RTVVRTVTL

SEQ ID NO: 135259 - protein, 9 aa, Homo Sapiens
RTWAERRQF

SEQ ID NO: 135260 - protein, 9 aa, Homo Sapiens
RTYRELRLL

SEQ ID NO: 135261 - protein, 9 aa, Homo Sapiens
RVCEILRRL

SEQ ID NO: 135262 - protein, 9 aa, Homo Sapiens
RVIDLLRVI

SEQ ID NO: 135263 - protein, 9 aa, Homo Sapiens
RVQKIRPSI

SEQ ID NO: 135264 - protein, 9 aa, Homo Sapiens
RVQKLSRVI

SEQ ID NO: 135265 - protein, 9 aa, Homo Sapiens
RVSDILRYL

SEQ ID NO: 135266 - protein, 9 aa, Homo Sapiens
RVWSLMRFL

SEQ ID NO: 135267 - protein, 9 aa, Homo Sapiens
RVYDVTRFL

SEQ ID NO: 135268 - protein, 9 aa, Homo Sapiens
RVYEILRLL

SEQ ID NO: 135269 - protein, 9 aa, Homo Sapiens
RYTRHLVSL

SEQ ID NO: 135270 - protein, 9 aa, Homo Sapiens
SAFLPARFY

SEQ ID NO: 135271 - protein, 9 aa, Homo Sapiens
SAVQAARKL

SEQ ID NO: 135272 - protein, 9 aa, Homo Sapiens
SIPLALALS

SEQ ID NO: 135273 - protein, 9 aa, Homo Sapiens
SNPHGCRLF

SEQ ID NO: 135274 - protein, 9 aa, Homo Sapiens
SSCPLLRTL

SEQ ID NO: 135275 - protein, 9 aa, Homo Sapiens
SSIKIVRHI

SEQ ID NO: 135276 - protein, 9 aa, Homo Sapiens
STTDVEKSF

SEQ ID NO: 135277 - protein, 9 aa, Homo Sapiens
SYLDKVQAL

SEQ ID NO: 135278 - protein, 9 aa, Homo Sapiens
TSFCAKYTY

SEQ ID NO: 135279 - protein, 9 aa, Homo Sapiens
TSKPFNPLL

SEQ ID NO: 135280 - protein, 9 aa, Homo Sapiens
TSLFIARSF

SEQ ID NO: 135281 - protein, 9 aa, Homo Sapiens
TSRHLEETI

SEQ ID NO: 135282 - protein, 9 aa, Homo Sapiens
VAPGKDLTK

SEQ ID NO: 135283 - protein, 9 aa, Homo Sapiens
VSCNIFRTL

SEQ ID NO: 135284 - protein, 9 aa, Homo Sapiens
VSFLEYRTF

SEQ ID NO: 135285 - protein, 9 aa, Homo Sapiens
VSFQHPHKY

SEQ ID NO: 135286 - protein, 9 aa, Homo Sapiens
VSKPLAHHI

SEQ ID NO: 135287 - protein, 9 aa, Homo Sapiens
VSLDICRYL

SEQ ID NO: 135288 - protein, 9 aa, Homo Sapiens
VSLLVQRTI

SEQ ID NO: 135289 - protein, 9 aa, Homo Sapiens
VSNPATRML

SEQ ID NO: 135290 - protein, 9 aa, Homo Sapiens
VSNPKSFEY

SEQ ID NO: 135291 - protein, 9 aa, Homo Sapiens
VSNPYHVVI

SEQ ID NO: 135292 - protein, 9 aa, Homo Sapiens
VSQEVTRSL

SEQ ID NO: 135293 - protein, 9 aa, Homo Sapiens
VSSKVQRLL

SEQ ID NO: 135294 - protein, 9 aa, Homo Sapiens
VSVPVVWTL

SEQ ID NO: 135295 - protein, 9 aa, Homo Sapiens
VTFSGQYNI

SEQ ID NO: 135296 - protein, 9 aa, Homo Sapiens
VTIRLLETI

SEQ ID NO: 135297 - protein, 9 aa, Homo Sapiens
VTNPYQATI

SEQ ID NO: 135298 - protein, 9 aa, Homo Sapiens
VTYKNVPNW

SEQ ID NO: 135299 - protein, 9 aa, Homo Sapiens
VTYVPVTTF

SEQ ID NO: 135300 - protein, 9 aa, Homo Sapiens
VVNQIARQL

SEQ ID NO: 135301 - protein, 9 aa, Homo Sapiens
YAIRGVPSL

SEQ ID NO: 135302 - protein, 9 aa, Homo Sapiens
YAKRIQQRL

SEQ ID NO: 135303 - protein, 9 aa, Homo Sapiens
YSFRNVQQI

SEQ ID NO: 135304 - protein, 9 aa, Homo Sapiens
YSKRIAVAL

SEQ ID NO: 135305 - protein, 9 aa, Homo Sapiens
YSRRFFPYY

SEQ ID NO: 135306 - protein, 9 aa, Homo Sapiens
YTLRILRQL

SEQ ID NO: 135307 - protein, 9 aa, Homo Sapiens
YTVKVQREL

SEQ ID NO: 135308 - protein, 9 aa, Homo Sapiens
YTYRGPKAF

SEQ ID NO: 135309 - protein, 10 aa, Homo Sapiens
ASELHSVRKL

SEQ ID NO: 135310 - protein, 10 aa, Homo Sapiens
ASLGASVHKI

SEQ ID NO: 135311 - protein, 10 aa, Homo Sapiens
EENLLDFVRF

SEQ ID NO: 135312 - protein, 10 aa, Homo Sapiens
EESNYELEGK

SEQ ID NO: 135313 - protein, 10 aa, Homo Sapiens
FTIKADVWSF

SEQ ID NO: 135314 - protein, 10 aa, Homo Sapiens
FTIKSDVWSF

SEQ ID NO: 135315 - protein, 10 aa, Homo Sapiens
GASSLSGRCW

SEQ ID NO: 135316 - protein, 10 aa, Homo Sapiens
GGASLGARHI

SEQ ID NO: 135317 - protein, 10 aa, Homo Sapiens
GNSSIVGRLL

SEQ ID NO: 135318 - protein, 10 aa, Homo Sapiens
GPSSNKPRVI

SEQ ID NO: 135319 - protein, 10 aa, Homo Sapiens
HSITSDNHKW

SEQ ID NO: 135320 - protein, 10 aa, Homo Sapiens
HSKDGSLQQL

SEQ ID NO: 135321 - protein, 10 aa, Homo Sapiens
HTIQTEDRVW

SEQ ID NO: 135322 - protein, 10 aa, Homo Sapiens
IRLENEIQTY

SEQ ID NO: 135323 - protein, 10 aa, Homo Sapiens
ISMPDFDLHL

SEQ ID NO: 135324 - protein, 10 aa, Homo Sapiens
ISNPHGCRLF

SEQ ID NO: 135325 - protein, 10 aa, Homo Sapiens
KAAPGWLKRF

SEQ ID NO: 135326 - protein, 10 aa, Homo Sapiens
KAINGKYHRF

SEQ ID NO: 135327 - protein, 10 aa, Homo Sapiens
KAIPDTRLTI

SEQ ID NO: 135328 - protein, 10 aa, Homo Sapiens
KGGTSIIMEL

SEQ ID NO: 135329 - protein, 10 aa, Homo Sapiens
KMIPPGIHFL

SEQ ID NO: 135330 - protein, 10 aa, Homo Sapiens
KSADPEVMLL

SEQ ID NO: 135331 - protein, 10 aa, Homo Sapiens
KSANSTLRLL

SEQ ID NO: 135332 - protein, 10 aa, Homo Sapiens
KSDPSIVRLL

SEQ ID NO: 135333 - protein, 10 aa, Homo Sapiens
KSFEGLFYFL

SEQ ID NO: 135334 - protein, 10 aa, Homo Sapiens
KSFPGGKEYL

SEQ ID NO: 135335 - protein, 10 aa, Homo Sapiens
KSFRDKGIFL

SEQ ID NO: 135336 - protein, 10 aa, Homo Sapiens
KSGEAKYFHL

SEQ ID NO: 135337 - protein, 10 aa, Homo Sapiens
KSIELGTLTI

SEQ ID NO: 135338 - protein, 10 aa, Homo Sapiens
KSINSEVLKF

SEQ ID NO: 135339 - protein, 10 aa, Homo Sapiens
KSKDPSGLLI

SEQ ID NO: 135340 - protein, 10 aa, Homo Sapiens
KSKEALIQCL

SEQ ID NO: 135341 - protein, 10 aa, Homo Sapiens
KSKPDKALSL

SEQ ID NO: 135342 - protein, 10 aa, Homo Sapiens
KSLPAEINRM

SEQ ID NO: 135343 - protein, 10 aa, Homo Sapiens
KSLPASLSFL

SEQ ID NO: 135344 - protein, 10 aa, Homo Sapiens
KSQHGSARLF

SEQ ID NO: 135345 - protein, 10 aa, Homo Sapiens
KSVFIKQQRF

SEQ ID NO: 135346 - protein, 10 aa, Homo Sapiens
KSVGKIEHSF

SEQ ID NO: 135347 - protein, 10 aa, Homo Sapiens
KSVVGNLHRL

SEQ ID NO: 135348 - protein, 10 aa, Homo Sapiens
KSYDGRAYVI

SEQ ID NO: 135349 - protein, 10 aa, Homo Sapiens
KSYEAKLRLL

SEQ ID NO: 135350 - protein, 10 aa, Homo Sapiens
KSYGNEKRFF

SEQ ID NO: 135351 - protein, 10 aa, Homo Sapiens
KTIDGILLLI

SEQ ID NO: 135352 - protein, 10 aa, Homo Sapiens
KTIHLTGRSL

SEQ ID NO: 135353 - protein, 10 aa, Homo Sapiens
KTKAIQAQKL

SEQ ID NO: 135354 - protein, 10 aa, Homo Sapiens
KTKDFQESSI

SEQ ID NO: 135355 - protein, 10 aa, Homo Sapiens
KTKDGVREVF

SEQ ID NO: 135356 - protein, 10 aa, Homo Sapiens
KTKEGVREVF

SEQ ID NO: 135357 - protein, 10 aa, Homo Sapiens
KTKENILEEF

SEQ ID NO: 135358 - protein, 10 aa, Homo Sapiens
KTLDQAIMKF

SEQ ID NO: 135359 - protein, 10 aa, Homo Sapiens
KTLDSQTRTF

SEQ ID NO: 135360 - protein, 10 aa, Homo Sapiens
KTLTGKTITL

SEQ ID NO: 135361 - protein, 10 aa, Homo Sapiens
KTNPDDRRII

SEQ ID NO: 135362 - protein, 10 aa, Homo Sapiens
KTPEEIRKTF

SEQ ID NO: 135363 - protein, 10 aa, Homo Sapiens
KTYGEIFEKF

SEQ ID NO: 135364 - protein, 10 aa, Homo Sapiens
KTYQDIQNTI

SEQ ID NO: 135365 - protein, 10 aa, Homo Sapiens
LSADFNYRSF

SEQ ID NO: 135366 - protein, 10 aa, Homo Sapiens
LSISPIVLYL

SEQ ID NO: 135367 - protein, 10 aa, Homo Sapiens
LSLAPDGRTF

SEQ ID NO: 135368 - protein, 10 aa, Homo Sapiens
LSLPDIKVYL

SEQ ID NO: 135369 - protein, 10 aa, Homo Sapiens
LSVPDSGRLW

SEQ ID NO: 135370 - protein, 10 aa, Homo Sapiens
MRLEKEIETY

SEQ ID NO: 135371 - protein, 10 aa, Homo Sapiens
NDMRQEYEQL

SEQ ID NO: 135372 - protein, 10 aa, Homo Sapiens
QAINPKLLQL

SEQ ID NO: 135373 - protein, 10 aa, Homo Sapiens
QAINPKLMQL

SEQ ID NO: 135374 - protein, 10 aa, Homo Sapiens
QSLEASLHAM

SEQ ID NO: 135375 - protein, 10 aa, Homo Sapiens
RAAPPPLFLL

SEQ ID NO: 135376 - protein, 10 aa, Homo Sapiens
RAYPHNLMTF

SEQ ID NO: 135377 - protein, 10 aa, Homo Sapiens
RSFAGNLNTY

SEQ ID NO: 135378 - protein, 10 aa, Homo Sapiens
RSIPAITRYW

SEQ ID NO: 135379 - protein, 10 aa, Homo Sapiens
RSIQADGLVW

SEQ ID NO: 135380 - protein, 10 aa, Homo Sapiens
RSIQVDGKTI

SEQ ID NO: 135381 - protein, 10 aa, Homo Sapiens
RSLAANLQLL

SEQ ID NO: 135382 - protein, 10 aa, Homo Sapiens
RSLKADLQKL

SEQ ID NO: 135383 - protein, 10 aa, Homo Sapiens
RSLPEPLMTY

SEQ ID NO: 135384 - protein, 10 aa, Homo Sapiens
RSLPLGARCF

SEQ ID NO: 135385 - protein, 10 aa, Homo Sapiens
RSLQAQLQRL

SEQ ID NO: 135386 - protein, 10 aa, Homo Sapiens
RSLSDLFRRY

SEQ ID NO: 135387 - protein, 10 aa, Homo Sapiens
RSMHPELMKY

SEQ ID NO: 135388 - protein, 10 aa, Homo Sapiens
RSMPLGARIL

SEQ ID NO: 135389 - protein, 10 aa, Homo Sapiens
RSRPAVSVTI

SEQ ID NO: 135390 - protein, 10 aa, Homo Sapiens
RSWDQQIKLW

SEQ ID NO: 135391 - protein, 10 aa, Homo Sapiens
RTLDNQLFFF

SEQ ID NO: 135392 - protein, 10 aa, Homo Sapiens
RTLNADLMTL

SEQ ID NO: 135393 - protein, 10 aa, Homo Sapiens
RTLVLRDRNL

SEQ ID NO: 135394 - protein, 10 aa, Homo Sapiens
SLYQSKYEEL

SEQ ID NO: 135395 - protein, 10 aa, Homo Sapiens
TSFGRTAHAL

SEQ ID NO: 135396 - protein, 10 aa, Homo Sapiens
TSSCPLLRTL

SEQ ID NO: 135397 - protein, 10 aa, Homo Sapiens
TSVHPDLMKI

SEQ ID NO: 135398 - protein, 10 aa, Homo Sapiens
VAAPSWLHRF

SEQ ID NO: 135399 - protein, 10 aa, Homo Sapiens
VSIVHSVFEF

SEQ ID NO: 135400 - protein, 10 aa, Homo Sapiens
VSMDNRLMEL

SEQ ID NO: 135401 - protein, 11 aa, Homo Sapiens
AEQNRKDAEAW

SEQ ID NO: 135402 - protein, 11 aa, Homo Sapiens
ASKTKEIEQVY

SEQ ID NO: 135403 - protein, 11 aa, Homo Sapiens
ASLPAELINQI

SEQ ID NO: 135404 - protein, 11 aa, Homo Sapiens
ASLPSELIVHI

SEQ ID NO: 135405 - protein, 11 aa, Homo Sapiens
ATIPVSQISTI

SEQ ID NO: 135406 - protein, 11 aa, Homo Sapiens
ATSGVVAVRLI

SEQ ID NO: 135407 - protein, 11 aa, Homo Sapiens
ESSRSHAVFTI

SEQ ID NO: 135408 - protein, 11 aa, Homo Sapiens
FTQKGNLLRHI

SEQ ID NO: 135409 - protein, 11 aa, Homo Sapiens
GSTIVHAVQRI

SEQ ID NO: 135410 - protein, 11 aa, Homo Sapiens
GSTLSSDLMKL

SEQ ID NO: 135411 - protein, 11 aa, Homo Sapiens
HSALCHSWLSL

SEQ ID NO: 135412 - protein, 11 aa, Homo Sapiens
HSSRSHAIFTI

SEQ ID NO: 135413 - protein, 11 aa, Homo Sapiens
IGKPAHLIVSL

SEQ ID NO: 135414 - protein, 11 aa, Homo Sapiens
ISKKADLLFAL

SEQ ID NO: 135415 - protein, 11 aa, Homo Sapiens
ISLPDDVRRRL

SEQ ID NO: 135416 - protein, 11 aa, Homo Sapiens
ISNPVTKEMLF

SEQ ID NO: 135417 - protein, 11 aa, Homo Sapiens
ISSAEHAGLFL

SEQ ID NO: 135418 - protein, 11 aa, Homo Sapiens
ITKPASVFVQL

SEQ ID NO: 135419 - protein, 11 aa, Homo Sapiens
ITQIEHEVSSS

SEQ ID NO: 135420 - protein, 11 aa, Homo Sapiens
KAFAETHIKGF

SEQ ID NO: 135421 - protein, 11 aa, Homo Sapiens
KAFDRPSLFQI

SEQ ID NO: 135422 - protein, 11 aa, Homo Sapiens
KAFDYPSLFRI

SEQ ID NO: 135423 - protein, 11 aa, Homo Sapiens
KAFPHSSSLRY

SEQ ID NO: 135424 - protein, 11 aa, Homo Sapiens
KAINGKYHRFL

SEQ ID NO: 135425 - protein, 11 aa, Homo Sapiens
KASELHSVRKL

SEQ ID NO: 135426 - protein, 11 aa, Homo Sapiens
KASIEHEALYL

SEQ ID NO: 135427 - protein, 11 aa, Homo Sapiens
KILYPSTLFLL

SEQ ID NO: 135428 - protein, 11 aa, Homo Sapiens
KISSEHARTYI

SEQ ID NO: 135429 - protein, 11 aa, Homo Sapiens
KKDVDNAYMIK

SEQ ID NO: 135430 - protein, 11 aa, Homo Sapiens
KLDPNKAYIQI

SEQ ID NO: 135431 - protein, 11 aa, Homo Sapiens
KLKPEGLHQLL

SEQ ID NO: 135432 - protein, 11 aa, Homo Sapiens
KLNPYRAKVLI

SEQ ID NO: 135433 - protein, 11 aa, Homo Sapiens
KMNPLWNTMVI

SEQ ID NO: 135434 - protein, 11 aa, Homo Sapiens
KNKYEDEINKR

SEQ ID NO: 135435 - protein, 11 aa, Homo Sapiens
KSCGIQDIFVF

SEQ ID NO: 135436 - protein, 11 aa, Homo Sapiens
KSDKAQTKLLI

SEQ ID NO: 135437 - protein, 11 aa, Homo Sapiens
KSFDKNLYRQL

SEQ ID NO: 135438 - protein, 11 aa, Homo Sapiens
KSFEETYDRKL

SEQ ID NO: 135439 - protein, 11 aa, Homo Sapiens
KSFGWPSFITY

SEQ ID NO: 135440 - protein, 11 aa, Homo Sapiens
KSFPAAIEHTI

SEQ ID NO: 135441 - protein, 11 aa, Homo Sapiens
KSFPDTGSLNL

SEQ ID NO: 135442 - protein, 11 aa, Homo Sapiens
KSFPGIPLHHI

SEQ ID NO: 135443 - protein, 11 aa, Homo Sapiens
KSFQKIQVRLV

SEQ ID NO: 135444 - protein, 11 aa, Homo Sapiens
KSFSKSDLVNW

SEQ ID NO: 135445 - protein, 11 aa, Homo Sapiens
KSFSQPGLRSL

SEQ ID NO: 135446 - protein, 11 aa, Homo Sapiens
KSIDSKSFISI

SEQ ID NO: 135447 - protein, 11 aa, Homo Sapiens
KSIGPPEMHKY

SEQ ID NO: 135448 - protein, 11 aa, Homo Sapiens
KSKAMTGVEQW

SEQ ID NO: 135449 - protein, 11 aa, Homo Sapiens
KSKEDLVSQGF

SEQ ID NO: 135450 - protein, 11 aa, Homo Sapiens
KSKGSDKDFVI

SEQ ID NO: 135451 - protein, 11 aa, Homo Sapiens
KSKPDKALSLI

SEQ ID NO: 135452 - protein, 11 aa, Homo Sapiens
KSKPESNEQVL

SEQ ID NO: 135453 - protein, 11 aa, Homo Sapiens
KSKPIIAEPEI

SEQ ID NO: 135454 - protein, 11 aa, Homo Sapiens
KSLEEIYLFSL

SEQ ID NO: 135455 - protein, 11 aa, Homo Sapiens
KSLILPPEHIL

SEQ ID NO: 135456 - protein, 11 aa, Homo Sapiens
KSLPAKVEQIL

SEQ ID NO: 135457 - protein, 11 aa, Homo Sapiens
KSLPATVTQII

SEQ ID NO: 135458 - protein, 11 aa, Homo Sapiens
KSLPEEDVAEI

SEQ ID NO: 135459 - protein, 11 aa, Homo Sapiens
KSLPSLVPLRI

SEQ ID NO: 135460 - protein, 11 aa, Homo Sapiens
KSLPSVLVIHL

SEQ ID NO: 135461 - protein, 11 aa, Homo Sapiens
KSLSALIGQCI

SEQ ID NO: 135462 - protein, 11 aa, Homo Sapiens
KSLSDTAKPHI

SEQ ID NO: 135463 - protein, 11 aa, Homo Sapiens
KSNPYGEWQEI

SEQ ID NO: 135464 - protein, 11 aa, Homo Sapiens
KSRPAHLAVFL

SEQ ID NO: 135465 - protein, 11 aa, Homo Sapiens
KSSPSMAVLYI

SEQ ID NO: 135466 - protein, 11 aa, Homo Sapiens
KSSRSHSVFTL

SEQ ID NO: 135467 - protein, 11 aa, Homo Sapiens
KSVPENLLKCF

SEQ ID NO: 135468 - protein, 11 aa, Homo Sapiens
KSYCSNLVRTL

SEQ ID NO: 135469 - protein, 11 aa, Homo Sapiens
KSYELPDGQVI

SEQ ID NO: 135470 - protein, 11 aa, Homo Sapiens
KSYPGSQSQLF

SEQ ID NO: 135471 - protein, 11 aa, Homo Sapiens
KSYRRKDGVFL

SEQ ID NO: 135472 - protein, 11 aa, Homo Sapiens
KTKDHTLVQTI

SEQ ID NO: 135473 - protein, 11 aa, Homo Sapiens
KTKDSDIYCTL

SEQ ID NO: 135474 - protein, 11 aa, Homo Sapiens
KTLPADVQNYY

SEQ ID NO: 135475 - protein, 11 aa, Homo Sapiens
KTMPAATYRLL

SEQ ID NO: 135476 - protein, 11 aa, Homo Sapiens
KTWAGSQSRRL

SEQ ID NO: 135477 - protein, 11 aa, Homo Sapiens
KVFPSPHILQI

SEQ ID NO: 135478 - protein, 11 aa, Homo Sapiens
KVKDEKIRQAF

SEQ ID NO: 135479 - protein, 11 aa, Homo Sapiens
KVSKLHSKITL

SEQ ID NO: 135480 - protein, 11 aa, Homo Sapiens
LESRIRDVHEL

SEQ ID NO: 135481 - protein, 11 aa, Homo Sapiens
LSAPSYLARSL

SEQ ID NO: 135482 - protein, 11 aa, Homo Sapiens
MSRPFGVALLF

SEQ ID NO: 135483 - protein, 11 aa, Homo Sapiens
MVFNHPAIKKF

SEQ ID NO: 135484 - protein, 11 aa, Homo Sapiens
NGNSSIVGRLL

SEQ ID NO: 135485 - protein, 11 aa, Homo Sapiens
QGPSSNKPRVI

SEQ ID NO: 135486 - protein, 11 aa, Homo Sapiens
QSLPSSVLHII

SEQ ID NO: 135487 - protein, 11 aa, Homo Sapiens
QSSRSHAIFTI

SEQ ID NO: 135488 - protein, 11 aa, Homo Sapiens
RAKLREIEQQI

SEQ ID NO: 135489 - protein, 11 aa, Homo Sapiens
RNKYEDEINKR

SEQ ID NO: 135490 - protein, 11 aa, Homo Sapiens
RSCLEQAKLLF

SEQ ID NO: 135491 - protein, 11 aa, Homo Sapiens
RSFSEGGERLL

SEQ ID NO: 135492 - protein, 11 aa, Homo Sapiens
RSFYAESCFLF

SEQ ID NO: 135493 - protein, 11 aa, Homo Sapiens
RSIAECAVFTW

SEQ ID NO: 135494 - protein, 11 aa, Homo Sapiens
RSIALTQARYL

SEQ ID NO: 135495 - protein, 11 aa, Homo Sapiens
RSISQGLTWTW

SEQ ID NO: 135496 - protein, 11 aa, Homo Sapiens
RSKSYELIRKI

SEQ ID NO: 135497 - protein, 11 aa, Homo Sapiens
RSLQLQEHRLL

SEQ ID NO: 135498 - protein, 11 aa, Homo Sapiens
RSLQPSVLMQL

SEQ ID NO: 135499 - protein, 11 aa, Homo Sapiens
RSLVCDGKRGL

SEQ ID NO: 135500 - protein, 11 aa, Homo Sapiens
RSMPAVMMQNY

SEQ ID NO: 135501 - protein, 11 aa, Homo Sapiens
RSNPKLKDLYI

SEQ ID NO: 135502 - protein, 11 aa, Homo Sapiens
RSSKFAGTRFL

SEQ ID NO: 135503 - protein, 11 aa, Homo Sapiens
RSSRSHAVLLV

SEQ ID NO: 135504 - protein, 11 aa, Homo Sapiens
RSSRSHSVFQL

SEQ ID NO: 135505 - protein, 11 aa, Homo Sapiens
RSVFFGVFQSF

SEQ ID NO: 135506 - protein, 11 aa, Homo Sapiens
RSVPACQVPRL

SEQ ID NO: 135507 - protein, 11 aa, Homo Sapiens
RSYANIKEKLF

SEQ ID NO: 135508 - protein, 11 aa, Homo Sapiens
RSYVTTSTRTY

SEQ ID NO: 135509 - protein, 11 aa, Homo Sapiens
RTICSKVLVQW

SEQ ID NO: 135510 - protein, 11 aa, Homo Sapiens
RTKDLIIEQRF

SEQ ID NO: 135511 - protein, 11 aa, Homo Sapiens
RTLDNQLFFFL

SEQ ID NO: 135512 - protein, 11 aa, Homo Sapiens
RTLEDRGIRKI

SEQ ID NO: 135513 - protein, 11 aa, Homo Sapiens
RTLKEEGPRYL

SEQ ID NO: 135514 - protein, 11 aa, Homo Sapiens
RTLPFYFVQKI

SEQ ID NO: 135515 - protein, 11 aa, Homo Sapiens
RTTVVHGDFRL

SEQ ID NO: 135516 - protein, 11 aa, Homo Sapiens
RVDPNGSRYLL

SEQ ID NO: 135517 - protein, 11 aa, Homo Sapiens
RVNPALAELNL

SEQ ID NO: 135518 - protein, 11 aa, Homo Sapiens
RVYPESIPRKF

SEQ ID NO: 135519 - protein, 11 aa, Homo Sapiens
SPASSTTARVI

SEQ ID NO: 135520 - protein, 11 aa, Homo Sapiens
STMQELNSRLA

SEQ ID NO: 135521 - protein, 11 aa, Homo Sapiens
STSSCPLLRTL

SEQ ID NO: 135522 - protein, 11 aa, Homo Sapiens
SVRGYPTLLLF

SEQ ID NO: 135523 - protein, 11 aa, Homo Sapiens
TEELNREVATN

SEQ ID NO: 135524 - protein, 11 aa, Homo Sapiens
TSSRSHAVFTI

SEQ ID NO: 135525 - protein, 11 aa, Homo Sapiens
TSWREGGGRHI

SEQ ID NO: 135526 - protein, 11 aa, Homo Sapiens
VSDPQHAARLL

SEQ ID NO: 135527 - protein, 11 aa, Homo Sapiens
VSKPAESLPVI

SEQ ID NO: 135528 - protein, 11 aa, Homo Sapiens
VSNLLHSTLQL

SEQ ID NO: 135529 - protein, 11 aa, Homo Sapiens
VSNPYHVVILF

SEQ ID NO: 135530 - protein, 11 aa, Homo Sapiens
YAIREVNINKF

SEQ ID NO: 135531 - protein, 8 aa, Homo Sapiens
AAPAGTTF

SEQ ID NO: 135532 - protein, 8 aa, Homo Sapiens
AAPASGAL

SEQ ID NO: 135533 - protein, 8 aa, Homo Sapiens
AAPATNHI

SEQ ID NO: 135534 - protein, 8 aa, Homo Sapiens
AAPDGPAL

SEQ ID NO: 135535 - protein, 8 aa, Homo Sapiens
AAPLGTTL

SEQ ID NO: 135536 - protein, 8 aa, Homo Sapiens
AAPLHSVL

SEQ ID NO: 135537 - protein, 8 aa, Homo Sapiens
AAPRAEAL

SEQ ID NO: 135538 - protein, 8 aa, Homo Sapiens
AAPSGATL

SEQ ID NO: 135539 - protein, 8 aa, Homo Sapiens
AAPTANLL

SEQ ID NO: 135540 - protein, 8 aa, Homo Sapiens
AAPTGPLL

SEQ ID NO: 135541 - protein, 8 aa, Homo Sapiens
AAPTGTTI

SEQ ID NO: 135542 - protein, 8 aa, Homo Sapiens
AAPTSSAL

SEQ ID NO: 135543 - protein, 8 aa, Homo Sapiens
AGPTAHEL

SEQ ID NO: 135544 - protein, 8 aa, Homo Sapiens
AGPVGGSL

SEQ ID NO: 135545 - protein, 8 aa, Homo Sapiens
ALPIGNEL

SEQ ID NO: 135546 - protein, 8 aa, Homo Sapiens
APTDVKEL

SEQ ID NO: 135547 - protein, 8 aa, Homo Sapiens
ASPNGAEL

SEQ ID NO: 135548 - protein, 8 aa, Homo Sapiens
ASPSGSQL

SEQ ID NO: 135549 - protein, 8 aa, Homo Sapiens
ASPVSPEL

SEQ ID NO: 135550 - protein, 8 aa, Homo Sapiens
AVGLGSCL

SEQ ID NO: 135551 - protein, 8 aa, Homo Sapiens
AVPQGSKL

SEQ ID NO: 135552 - protein, 8 aa, Homo Sapiens
AVPSGNEV

SEQ ID NO: 135553 - protein, 8 aa, Homo Sapiens
CGPVGPKL

SEQ ID NO: 135554 - protein, 8 aa, Homo Sapiens
CSPISSEL

SEQ ID NO: 135555 - protein, 8 aa, Homo Sapiens
CSPVHTTL

SEQ ID NO: 135556 - protein, 8 aa, Homo Sapiens
EAPERPSL

SEQ ID NO: 135557 - protein, 8 aa, Homo Sapiens
EAPQGVEL

SEQ ID NO: 135558 - protein, 8 aa, Homo Sapiens
EAPVGNSL

SEQ ID NO: 135559 - protein, 8 aa, Homo Sapiens
EGPVGSTL

SEQ ID NO: 135560 - protein, 8 aa, Homo Sapiens
ESLIACKA

SEQ ID NO: 135561 - protein, 8 aa, Homo Sapiens
FAERVTSL

SEQ ID NO: 135562 - protein, 8 aa, Homo Sapiens
FAPYGTVM

SEQ ID NO: 135563 - protein, 8 aa, Homo Sapiens
FFQVGSDL

SEQ ID NO: 135564 - protein, 8 aa, Homo Sapiens
FSPAGPIL

SEQ ID NO: 135565 - protein, 8 aa, Homo Sapiens
FSPAGPVL

SEQ ID NO: 135566 - protein, 8 aa, Homo Sapiens
FSPSGHIL

SEQ ID NO: 135567 - protein, 8 aa, Homo Sapiens
FSPTGEIL

SEQ ID NO: 135568 - protein, 8 aa, Homo Sapiens
FSPTGKYL

SEQ ID NO: 135569 - protein, 8 aa, Homo Sapiens
FSPVGSVL

SEQ ID NO: 135570 - protein, 8 aa, Homo Sapiens
FVPVANEL

SEQ ID NO: 135571 - protein, 8 aa, Homo Sapiens
GAPVGIAL

SEQ ID NO: 135572 - protein, 8 aa, Homo Sapiens
GPLRKSSL

SEQ ID NO: 135573 - protein, 8 aa, Homo Sapiens
GSPTGAAL

SEQ ID NO: 135574 - protein, 8 aa, Homo Sapiens
GTPEGLYL

SEQ ID NO: 135575 - protein, 8 aa, Homo Sapiens
IAEPGSVA

SEQ ID NO: 135576 - protein, 8 aa, Homo Sapiens
IAPSAKTL

SEQ ID NO: 135577 - protein, 8 aa, Homo Sapiens
IAPSGHGL

SEQ ID NO: 135578 - protein, 8 aa, Homo Sapiens
IFATVREL

SEQ ID NO: 135579 - protein, 8 aa, Homo Sapiens
IFCPHVAL

SEQ ID NO: 135580 - protein, 8 aa, Homo Sapiens
IFKDHVSL

SEQ ID NO: 135581 - protein, 8 aa, Homo Sapiens
IFQPVAEL

SEQ ID NO: 135582 - protein, 8 aa, Homo Sapiens
IFQVAQEL

SEQ ID NO: 135583 - protein, 8 aa, Homo Sapiens
IFSEHSCL

SEQ ID NO: 135584 - protein, 8 aa, Homo Sapiens
IGPKGNSL

SEQ ID NO: 135585 - protein, 8 aa, Homo Sapiens
IGPKGSTL

SEQ ID NO: 135586 - protein, 8 aa, Homo Sapiens
IPHIHKSL

SEQ ID NO: 135587 - protein, 8 aa, Homo Sapiens
ISPHGNAL

SEQ ID NO: 135588 - protein, 8 aa, Homo Sapiens
ISPVANEM

SEQ ID NO: 135589 - protein, 8 aa, Homo Sapiens
ITPTGHSL

SEQ ID NO: 135590 - protein, 8 aa, Homo Sapiens
IVPVGEAL

SEQ ID NO: 135591 - protein, 8 aa, Homo Sapiens
KAPNASNL

SEQ ID NO: 135592 - protein, 8 aa, Homo Sapiens
KMPEHSTL

SEQ ID NO: 135593 - protein, 8 aa, Homo Sapiens
LFENGPCL

SEQ ID NO: 135594 - protein, 8 aa, Homo Sapiens
LLWPGAAL

SEQ ID NO: 135595 - protein, 8 aa, Homo Sapiens
LSPDGTVL

SEQ ID NO: 135596 - protein, 8 aa, Homo Sapiens
LTPTHGEM

SEQ ID NO: 135597 - protein, 8 aa, Homo Sapiens
LVPSGSEL

SEQ ID NO: 135598 - protein, 8 aa, Homo Sapiens
MAPNHQTL

SEQ ID NO: 135599 - protein, 8 aa, Homo Sapiens
MMPKGAAL

SEQ ID NO: 135600 - protein, 8 aa, Homo Sapiens
MSPIGTDL

SEQ ID NO: 135601 - protein, 8 aa, Homo Sapiens
MSPQGQVL

SEQ ID NO: 135602 - protein, 8 aa, Homo Sapiens
MSPTGDFL

SEQ ID NO: 135603 - protein, 8 aa, Homo Sapiens
MVASGSEL

SEQ ID NO: 135604 - protein, 8 aa, Homo Sapiens
NAPNHMEL

SEQ ID NO: 135605 - protein, 8 aa, Homo Sapiens
NAPVGTEL

SEQ ID NO: 135606 - protein, 8 aa, Homo Sapiens
NGPTHMEL

SEQ ID NO: 135607 - protein, 8 aa, Homo Sapiens
NSPMSPAL

SEQ ID NO: 135608 - protein, 8 aa, Homo Sapiens
NSPVGNQL

SEQ ID NO: 135609 - protein, 8 aa, Homo Sapiens
NTPNGNSL

SEQ ID NO: 135610 - protein, 8 aa, Homo Sapiens
NVATHSTL

SEQ ID NO: 135611 - protein, 8 aa, Homo Sapiens
NVGTGEAL

SEQ ID NO: 135612 - protein, 8 aa, Homo Sapiens
NVPISPAL

SEQ ID NO: 135613 - protein, 8 aa, Homo Sapiens
NVPVGKVL

SEQ ID NO: 135614 - protein, 8 aa, Homo Sapiens
QAPEATVL

SEQ ID NO: 135615 - protein, 8 aa, Homo Sapiens
QAPIAAVL

SEQ ID NO: 135616 - protein, 8 aa, Homo Sapiens
QAPVAAVL

SEQ ID NO: 135617 - protein, 8 aa, Homo Sapiens
QLQLRSLA

SEQ ID NO: 135618 - protein, 8 aa, Homo Sapiens
QSPQGRVM

SEQ ID NO: 135619 - protein, 8 aa, Homo Sapiens
RVPEGQHL

SEQ ID NO: 135620 - protein, 8 aa, Homo Sapiens
SAPAGETL

SEQ ID NO: 135621 - protein, 8 aa, Homo Sapiens
SAPIHTQM

SEQ ID NO: 135622 - protein, 8 aa, Homo Sapiens
SAPNHCTL

SEQ ID NO: 135623 - protein, 8 aa, Homo Sapiens
SAPSAIAL

SEQ ID NO: 135624 - protein, 8 aa, Homo Sapiens
SFEAQGAL

SEQ ID NO: 135625 - protein, 8 aa, Homo Sapiens
SGPLGTEM

SEQ ID NO: 135626 - protein, 8 aa, Homo Sapiens
SGPTAEAL

SEQ ID NO: 135627 - protein, 8 aa, Homo Sapiens
SIKPGPEL

SEQ ID NO: 135628 - protein, 8 aa, Homo Sapiens
SPKVKMAL

SEQ ID NO: 135629 - protein, 8 aa, Homo Sapiens
SSPCAAEL

SEQ ID NO: 135630 - protein, 8 aa, Homo Sapiens
SSPCHIEM

SEQ ID NO: 135631 - protein, 8 aa, Homo Sapiens
SSPEHPEL

SEQ ID NO: 135632 - protein, 8 aa, Homo Sapiens
SSPIGKSV

SEQ ID NO: 135633 - protein, 8 aa, Homo Sapiens
SSPLSKEL

SEQ ID NO: 135634 - protein, 8 aa, Homo Sapiens
SSPTGTGL

SEQ ID NO: 135635 - protein, 8 aa, Homo Sapiens
STPEGIAL

SEQ ID NO: 135636 - protein, 8 aa, Homo Sapiens
STPFGQAL

SEQ ID NO: 135637 - protein, 8 aa, Homo Sapiens
STPGYSSL

SEQ ID NO: 135638 - protein, 8 aa, Homo Sapiens
SVATGSTL

SEQ ID NO: 135639 - protein, 8 aa, Homo Sapiens
SVPTADEL

SEQ ID NO: 135640 - protein, 8 aa, Homo Sapiens
TAPIGHIL

SEQ ID NO: 135641 - protein, 8 aa, Homo Sapiens
TAPLAHDL

SEQ ID NO: 135642 - protein, 8 aa, Homo Sapiens
TAPLRAEL

SEQ ID NO: 135643 - protein, 8 aa, Homo Sapiens
TAPSSSSL

SEQ ID NO: 135644 - protein, 8 aa, Homo Sapiens
TAPTGEYL

SEQ ID NO: 135645 - protein, 8 aa, Homo Sapiens
TAPVGINM

SEQ ID NO: 135646 - protein, 8 aa, Homo Sapiens
TFLNHPAL

SEQ ID NO: 135647 - protein, 8 aa, Homo Sapiens
TGPEGHVL

SEQ ID NO: 135648 - protein, 8 aa, Homo Sapiens
TLPVASAL

SEQ ID NO: 135649 - protein, 8 aa, Homo Sapiens
TSPLGSLS

SEQ ID NO: 135650 - protein, 8 aa, Homo Sapiens
VAPAGITL

SEQ ID NO: 135651 - protein, 8 aa, Homo Sapiens
VAPAGVTL

SEQ ID NO: 135652 - protein, 8 aa, Homo Sapiens
VAPEEHPV

SEQ ID NO: 135653 - protein, 8 aa, Homo Sapiens
VAPIAEQL

SEQ ID NO: 135654 - protein, 8 aa, Homo Sapiens
VAPSAVNL

SEQ ID NO: 135655 - protein, 8 aa, Homo Sapiens
VAPVAGQL

SEQ ID NO: 135656 - protein, 8 aa, Homo Sapiens
VAPVGSGL

SEQ ID NO: 135657 - protein, 8 aa, Homo Sapiens
VFDPHGTL

SEQ ID NO: 135658 - protein, 8 aa, Homo Sapiens
VFFCHGEL

SEQ ID NO: 135659 - protein, 8 aa, Homo Sapiens
VFHAGTAL

SEQ ID NO: 135660 - protein, 8 aa, Homo Sapiens
VFHPRQEL

SEQ ID NO: 135661 - protein, 8 aa, Homo Sapiens
VFLDHNAL

SEQ ID NO: 135662 - protein, 8 aa, Homo Sapiens
VFLPSHSL

SEQ ID NO: 135663 - protein, 8 aa, Homo Sapiens
VFQPVAEL

SEQ ID NO: 135664 - protein, 8 aa, Homo Sapiens
VFVTVKEL

SEQ ID NO: 135665 - protein, 8 aa, Homo Sapiens
VGPLGSTI

SEQ ID NO: 135666 - protein, 8 aa, Homo Sapiens
VLPVGTEL

SEQ ID NO: 135667 - protein, 8 aa, Homo Sapiens
VNDISSMS

SEQ ID NO: 135668 - protein, 8 aa, Homo Sapiens
VSPCGAYL

SEQ ID NO: 135669 - protein, 8 aa, Homo Sapiens
VSPESQEM

SEQ ID NO: 135670 - protein, 8 aa, Homo Sapiens
VSPLHRVL

SEQ ID NO: 135671 - protein, 8 aa, Homo Sapiens
VSPNGQHL

SEQ ID NO: 135672 - protein, 8 aa, Homo Sapiens
VSQVGKEL

SEQ ID NO: 135673 - protein, 8 aa, Homo Sapiens
VTPNHSAF

SEQ ID NO: 135674 - protein, 8 aa, Homo Sapiens
VVGTGTSL

SEQ ID NO: 135675 - protein, 8 aa, Homo Sapiens
VVPQAIEL

SEQ ID NO: 135676 - protein, 8 aa, Homo Sapiens
VVPTALEL

SEQ ID NO: 135677 - protein, 8 aa, Homo Sapiens
VVPTAPEL

SEQ ID NO: 135678 - protein, 8 aa, Homo Sapiens
VVPTSQSL

SEQ ID NO: 135679 - protein, 8 aa, Homo Sapiens
VVPYGTPL

SEQ ID NO: 135680 - protein, 8 aa, Homo Sapiens
WAPESAPL

SEQ ID NO: 135681 - protein, 8 aa, Homo Sapiens
WAPSGNLL

SEQ ID NO: 135682 - protein, 8 aa, Homo Sapiens
WSPCGNYL

SEQ ID NO: 135683 - protein, 8 aa, Homo Sapiens
WSPTHPAL

SEQ ID NO: 135684 - protein, 8 aa, Homo Sapiens
YAPAAATV

SEQ ID NO: 135685 - protein, 8 aa, Homo Sapiens
YAPSGCAI

SEQ ID NO: 135686 - protein, 8 aa, Homo Sapiens
YFENRKAL

SEQ ID NO: 135687 - protein, 8 aa, Homo Sapiens
YFNEGTVL

SEQ ID NO: 135688 - protein, 8 aa, Homo Sapiens
YGPEGLEL

SEQ ID NO: 135689 - protein, 8 aa, Homo Sapiens
YSPEGHVL

SEQ ID NO: 135690 - protein, 8 aa, Homo Sapiens
YSPHGHIL

SEQ ID NO: 135691 - protein, 8 aa, Homo Sapiens
YSPTSKAL

SEQ ID NO: 135692 - protein, 8 aa, Homo Sapiens
YTPEGTVL

SEQ ID NO: 135693 - protein, 8 aa, Homo Sapiens
YVPEVSAL

SEQ ID NO: 135694 - protein, 8 aa, Homo Sapiens
YWQNHPEL

SEQ ID NO: 135695 - protein, 9 aa, Homo Sapiens
AAAAATMAL

SEQ ID NO: 135696 - protein, 9 aa, Homo Sapiens
AANFSDRSL

SEQ ID NO: 135697 - protein, 9 aa, Homo Sapiens
AAPAGTTFV

SEQ ID NO: 135698 - protein, 9 aa, Homo Sapiens
AAPALASSL

SEQ ID NO: 135699 - protein, 9 aa, Homo Sapiens
AAPAPTAVV

SEQ ID NO: 135700 - protein, 9 aa, Homo Sapiens
AAPAYSRAL

SEQ ID NO: 135701 - protein, 9 aa, Homo Sapiens
AAPDGTRNL

SEQ ID NO: 135702 - protein, 9 aa, Homo Sapiens
AAPEGAGAL

SEQ ID NO: 135703 - protein, 9 aa, Homo Sapiens
AAPESGLEV

SEQ ID NO: 135704 - protein, 9 aa, Homo Sapiens
AAPESSTSF

SEQ ID NO: 135705 - protein, 9 aa, Homo Sapiens
AAPESYEEL

SEQ ID NO: 135706 - protein, 9 aa, Homo Sapiens
AAPFPRGEL

SEQ ID NO: 135707 - protein, 9 aa, Homo Sapiens
AAPFSYHST

SEQ ID NO: 135708 - protein, 9 aa, Homo Sapiens
AAPGEFRAI

SEQ ID NO: 135709 - protein, 9 aa, Homo Sapiens
AAPGGWLQV

SEQ ID NO: 135710 - protein, 9 aa, Homo Sapiens
AAPGPSAAF

SEQ ID NO: 135711 - protein, 9 aa, Homo Sapiens
AAPHSIESF

SEQ ID NO: 135712 - protein, 9 aa, Homo Sapiens
AAPIAITCF

SEQ ID NO: 135713 - protein, 9 aa, Homo Sapiens
AAPIRLLAA

SEQ ID NO: 135714 - protein, 9 aa, Homo Sapiens
AAPLSGQTF

SEQ ID NO: 135715 - protein, 9 aa, Homo Sapiens
AAPPAAQTL

SEQ ID NO: 135716 - protein, 9 aa, Homo Sapiens
AAPPAGGTL

SEQ ID NO: 135717 - protein, 9 aa, Homo Sapiens
AAPPWALGL

SEQ ID NO: 135718 - protein, 9 aa, Homo Sapiens
AAPRAPSAL

SEQ ID NO: 135719 - protein, 9 aa, Homo Sapiens
AAPSGSGTL

SEQ ID NO: 135720 - protein, 9 aa, Homo Sapiens
AAPSKACML

SEQ ID NO: 135721 - protein, 9 aa, Homo Sapiens
AAPSPFAEL

SEQ ID NO: 135722 - protein, 9 aa, Homo Sapiens
AAPTAITEA

SEQ ID NO: 135723 - protein, 9 aa, Homo Sapiens
AAPTAQKSL

SEQ ID NO: 135724 - protein, 9 aa, Homo Sapiens
AAPTRPSAL

SEQ ID NO: 135725 - protein, 9 aa, Homo Sapiens
AAPTSAAAL

SEQ ID NO: 135726 - protein, 9 aa, Homo Sapiens
AAPTTGNQI

SEQ ID NO: 135727 - protein, 9 aa, Homo Sapiens
AAPTVNQFL

SEQ ID NO: 135728 - protein, 9 aa, Homo Sapiens
AAPVATGAV

SEQ ID NO: 135729 - protein, 9 aa, Homo Sapiens
AAPVPTTTL

SEQ ID NO: 135730 - protein, 9 aa, Homo Sapiens
AAPVSTSEL

SEQ ID NO: 135731 - protein, 9 aa, Homo Sapiens
AAPVVPQAL

SEQ ID NO: 135732 - protein, 9 aa, Homo Sapiens
AAPWTEETV

SEQ ID NO: 135733 - protein, 9 aa, Homo Sapiens
AAPYGIESM

SEQ ID NO: 135734 - protein, 9 aa, Homo Sapiens
AFSPSSDSL

SEQ ID NO: 135735 - protein, 9 aa, Homo Sapiens
AGPGPGAVL

SEQ ID NO: 135736 - protein, 9 aa, Homo Sapiens
AGPMRQISL

SEQ ID NO: 135737 - protein, 9 aa, Homo Sapiens
AGPPAAAEV

SEQ ID NO: 135738 - protein, 9 aa, Homo Sapiens
AGPPATSEL

SEQ ID NO: 135739 - protein, 9 aa, Homo Sapiens
AGPPAVHGL

SEQ ID NO: 135740 - protein, 9 aa, Homo Sapiens
AGPPDTISL

SEQ ID NO: 135741 - protein, 9 aa, Homo Sapiens
AGPPHTCPL

SEQ ID NO: 135742 - protein, 9 aa, Homo Sapiens
AGPPRCSSL

SEQ ID NO: 135743 - protein, 9 aa, Homo Sapiens
AGPSHVAAM

SEQ ID NO: 135744 - protein, 9 aa, Homo Sapiens
AGPSVVNHM

SEQ ID NO: 135745 - protein, 9 aa, Homo Sapiens
AIIRDRAAL

SEQ ID NO: 135746 - protein, 9 aa, Homo Sapiens
AINHDTKEL

SEQ ID NO: 135747 - protein, 9 aa, Homo Sapiens
AIPDHARQL

SEQ ID NO: 135748 - protein, 9 aa, Homo Sapiens
AIPLHASSL

SEQ ID NO: 135749 - protein, 9 aa, Homo Sapiens
AIPLKASVL

SEQ ID NO: 135750 - protein, 9 aa, Homo Sapiens
ALGDPASAL

SEQ ID NO: 135751 - protein, 9 aa, Homo Sapiens
ALIPETTTL

SEQ ID NO: 135752 - protein, 9 aa, Homo Sapiens
ALPEAIAAL

SEQ ID NO: 135753 - protein, 9 aa, Homo Sapiens
ALPEEVQEL

SEQ ID NO: 135754 - protein, 9 aa, Homo Sapiens
ALPEWISCL

SEQ ID NO: 135755 - protein, 9 aa, Homo Sapiens
ALPGFAEAL

SEQ ID NO: 135756 - protein, 9 aa, Homo Sapiens
ALPLGGKAL

SEQ ID NO: 135757 - protein, 9 aa, Homo Sapiens
ALPQEFAAL

SEQ ID NO: 135758 - protein, 9 aa, Homo Sapiens
ALPQPTSVL

SEQ ID NO: 135759 - protein, 9 aa, Homo Sapiens
AMPFKCMQL

SEQ ID NO: 135760 - protein, 9 aa, Homo Sapiens
ASAPALTLS

SEQ ID NO: 135761 - protein, 9 aa, Homo Sapiens
ASPAVGQPL

SEQ ID NO: 135762 - protein, 9 aa, Homo Sapiens
ASPCGAWAL

SEQ ID NO: 135763 - protein, 9 aa, Homo Sapiens
ASPDRTHVL

SEQ ID NO: 135764 - protein, 9 aa, Homo Sapiens
ASPEAGNTL

SEQ ID NO: 135765 - protein, 9 aa, Homo Sapiens
ASPESGLEV

SEQ ID NO: 135766 - protein, 9 aa, Homo Sapiens
ASPESISSL

SEQ ID NO: 135767 - protein, 9 aa, Homo Sapiens
ASPKVRLSL

SEQ ID NO: 135768 - protein, 9 aa, Homo Sapiens
ASPLRESAL

SEQ ID NO: 135769 - protein, 9 aa, Homo Sapiens
ASPLRLQSH

SEQ ID NO: 135770 - protein, 9 aa, Homo Sapiens
ASPPARDAL

SEQ ID NO: 135771 - protein, 9 aa, Homo Sapiens
ASPPPVSEL

SEQ ID NO: 135772 - protein, 9 aa, Homo Sapiens
ASPSAASQL

SEQ ID NO: 135773 - protein, 9 aa, Homo Sapiens
ASPSRLLSL

SEQ ID NO: 135774 - protein, 9 aa, Homo Sapiens
ASPSSIRSL

SEQ ID NO: 135775 - protein, 9 aa, Homo Sapiens
ASPTACRAV

SEQ ID NO: 135776 - protein, 9 aa, Homo Sapiens
ASPVRLLSL

SEQ ID NO: 135777 - protein, 9 aa, Homo Sapiens
ASPVSFQEL

SEQ ID NO: 135778 - protein, 9 aa, Homo Sapiens
ATPVVVRSL

SEQ ID NO: 135779 - protein, 9 aa, Homo Sapiens
AVAAYRRAL

SEQ ID NO: 135780 - protein, 9 aa, Homo Sapiens
AVFGEATNL

SEQ ID NO: 135781 - protein, 9 aa, Homo Sapiens
AVIGSTEEL

SEQ ID NO: 135782 - protein, 9 aa, Homo Sapiens
AVISGVMSL

SEQ ID NO: 135783 - protein, 9 aa, Homo Sapiens
AVPEHAARL

SEQ ID NO: 135784 - protein, 9 aa, Homo Sapiens
AVPFSLDSV

SEQ ID NO: 135785 - protein, 9 aa, Homo Sapiens
AVPIYSSAL

SEQ ID NO: 135786 - protein, 9 aa, Homo Sapiens
AVPLCKQAL

SEQ ID NO: 135787 - protein, 9 aa, Homo Sapiens
CAPRRKVAL

SEQ ID NO: 135788 - protein, 9 aa, Homo Sapiens
CGPASQSTL

SEQ ID NO: 135789 - protein, 9 aa, Homo Sapiens
CGPGGVDHL

SEQ ID NO: 135790 - protein, 9 aa, Homo Sapiens
CGPHTLHSL

SEQ ID NO: 135791 - protein, 9 aa, Homo Sapiens
CSPGRLAVL

SEQ ID NO: 135792 - protein, 9 aa, Homo Sapiens
CSPKQGVSL

SEQ ID NO: 135793 - protein, 9 aa, Homo Sapiens
CTPQAAKAI

SEQ ID NO: 135794 - protein, 9 aa, Homo Sapiens
CVIGVARSL

SEQ ID NO: 135795 - protein, 9 aa, Homo Sapiens
DAPVSELSL

SEQ ID NO: 135796 - protein, 9 aa, Homo Sapiens
EAPESAQCL

SEQ ID NO: 135797 - protein, 9 aa, Homo Sapiens
EAPFSNLEL

SEQ ID NO: 135798 - protein, 9 aa, Homo Sapiens
EAPPAFSHL

SEQ ID NO: 135799 - protein, 9 aa, Homo Sapiens
EGPPVTTVL

SEQ ID NO: 135800 - protein, 9 aa, Homo Sapiens
EMPDSAAAL

SEQ ID NO: 135801 - protein, 9 aa, Homo Sapiens
ESPAPKQEL

SEQ ID NO: 135802 - protein, 9 aa, Homo Sapiens
EVPGPAAAL

SEQ ID NO: 135803 - protein, 9 aa, Homo Sapiens
FAPASAAAA

SEQ ID NO: 135804 - protein, 9 aa, Homo Sapiens
FAPAVGPAL

SEQ ID NO: 135805 - protein, 9 aa, Homo Sapiens
FAPEKLQEL

SEQ ID NO: 135806 - protein, 9 aa, Homo Sapiens
FAPENTCHL

SEQ ID NO: 135807 - protein, 9 aa, Homo Sapiens
FAPGDLPEL

SEQ ID NO: 135808 - protein, 9 aa, Homo Sapiens
FAPIQPLAM

SEQ ID NO: 135809 - protein, 9 aa, Homo Sapiens
FAPQHMAML

SEQ ID NO: 135810 - protein, 9 aa, Homo Sapiens
FAPYERRAM

SEQ ID NO: 135811 - protein, 9 aa, Homo Sapiens
FFDEKLNSL

SEQ ID NO: 135812 - protein, 9 aa, Homo Sapiens
FFPEYTHQL

SEQ ID NO: 135813 - protein, 9 aa, Homo Sapiens
FGPEWLRAL

SEQ ID NO: 135814 - protein, 9 aa, Homo Sapiens
FGPGPGSNF

SEQ ID NO: 135815 - protein, 9 aa, Homo Sapiens
FGPIADIAM

SEQ ID NO: 135816 - protein, 9 aa, Homo Sapiens
FIAPTGHSL

SEQ ID NO: 135817 - protein, 9 aa, Homo Sapiens
FIFSDTHEL

SEQ ID NO: 135818 - protein, 9 aa, Homo Sapiens
FIISRTQAL

SEQ ID NO: 135819 - protein, 9 aa, Homo Sapiens
FIIYDTHSL

SEQ ID NO: 135820 - protein, 9 aa, Homo Sapiens
FIMDRAQAL

SEQ ID NO: 135821 - protein, 9 aa, Homo Sapiens
FINGDISSL

SEQ ID NO: 135822 - protein, 9 aa, Homo Sapiens
FIPFSVSSV

SEQ ID NO: 135823 - protein, 9 aa, Homo Sapiens
FIPKNYIEM

SEQ ID NO: 135824 - protein, 9 aa, Homo Sapiens
FIPWGPASI

SEQ ID NO: 135825 - protein, 9 aa, Homo Sapiens
FIQEIEHAL

SEQ ID NO: 135826 - protein, 9 aa, Homo Sapiens
FISGHTSEL

SEQ ID NO: 135827 - protein, 9 aa, Homo Sapiens
FISPTGHSL

SEQ ID NO: 135828 - protein, 9 aa, Homo Sapiens
FLPDHPIVL

SEQ ID NO: 135829 - protein, 9 aa, Homo Sapiens
FLPEAPAEL

SEQ ID NO: 135830 - protein, 9 aa, Homo Sapiens
FLPFCHSEL

SEQ ID NO: 135831 - protein, 9 aa, Homo Sapiens
FLPGFSQSL

SEQ ID NO: 135832 - protein, 9 aa, Homo Sapiens
FLPGISTAL

SEQ ID NO: 135833 - protein, 9 aa, Homo Sapiens
FLPLHYDYL

SEQ ID NO: 135834 - protein, 9 aa, Homo Sapiens
FLPNAPKAL

SEQ ID NO: 135835 - protein, 9 aa, Homo Sapiens
FLPSHYNYL

SEQ ID NO: 135836 - protein, 9 aa, Homo Sapiens
FLPSPLHAL

SEQ ID NO: 135837 - protein, 9 aa, Homo Sapiens
FLQGDTSVL

SEQ ID NO: 135838 - protein, 9 aa, Homo Sapiens
FMNSVIQSL

SEQ ID NO: 135839 - protein, 9 aa, Homo Sapiens
FMPKSYEAL

SEQ ID NO: 135840 - protein, 9 aa, Homo Sapiens
FMPPGLQEL

SEQ ID NO: 135841 - protein, 9 aa, Homo Sapiens
FSPAPRPEM

SEQ ID NO: 135842 - protein, 9 aa, Homo Sapiens
FSPAPSLSL

SEQ ID NO: 135843 - protein, 9 aa, Homo Sapiens
FSPDSRHVL

SEQ ID NO: 135844 - protein, 9 aa, Homo Sapiens
FSPFHASVL

SEQ ID NO: 135845 - protein, 9 aa, Homo Sapiens
FSPFNPTSL

SEQ ID NO: 135846 - protein, 9 aa, Homo Sapiens
FSPISDIGL

SEQ ID NO: 135847 - protein, 9 aa, Homo Sapiens
FSPLPTPAL

SEQ ID NO: 135848 - protein, 9 aa, Homo Sapiens
FSPLRIWDL

SEQ ID NO: 135849 - protein, 9 aa, Homo Sapiens
FSPNRVIGL

SEQ ID NO: 135850 - protein, 9 aa, Homo Sapiens
FSPNVPKSL

SEQ ID NO: 135851 - protein, 9 aa, Homo Sapiens
FSPSSLSSL

SEQ ID NO: 135852 - protein, 9 aa, Homo Sapiens
FVIETARQL

SEQ ID NO: 135853 - protein, 9 aa, Homo Sapiens
FVIPVVQAL

SEQ ID NO: 135854 - protein, 9 aa, Homo Sapiens
FVPETKEEL

SEQ ID NO: 135855 - protein, 9 aa, Homo Sapiens
FVPETQVSL

SEQ ID NO: 135856 - protein, 9 aa, Homo Sapiens
FVPGTTAVL

SEQ ID NO: 135857 - protein, 9 aa, Homo Sapiens
FVPRHTRNL

SEQ ID NO: 135858 - protein, 9 aa, Homo Sapiens
FVPSDKSAL

SEQ ID NO: 135859 - protein, 9 aa, Homo Sapiens
FVPVVYHDL

SEQ ID NO: 135860 - protein, 9 aa, Homo Sapiens
FVTFTTRAM

SEQ ID NO: 135861 - protein, 9 aa, Homo Sapiens
GAPAGVREV

SEQ ID NO: 135862 - protein, 9 aa, Homo Sapiens
GAPERAAEL

SEQ ID NO: 135863 - protein, 9 aa, Homo Sapiens
GAPFTGSSL

SEQ ID NO: 135864 - protein, 9 aa, Homo Sapiens
GAPGAVTTL

SEQ ID NO: 135865 - protein, 9 aa, Homo Sapiens
GAPGGACEL

SEQ ID NO: 135866 - protein, 9 aa, Homo Sapiens
GAPLSLVDL

SEQ ID NO: 135867 - protein, 9 aa, Homo Sapiens
GGLPEGPVL

SEQ ID NO: 135868 - protein, 9 aa, Homo Sapiens
GIPAGWMGL

SEQ ID NO: 135869 - protein, 9 aa, Homo Sapiens
GIPEHADNL

SEQ ID NO: 135870 - protein, 9 aa, Homo Sapiens
GIPGTRGPI

SEQ ID NO: 135871 - protein, 9 aa, Homo Sapiens
GIPSAFLEL

SEQ ID NO: 135872 - protein, 9 aa, Homo Sapiens
GLPEKVLSL

SEQ ID NO: 135873 - protein, 9 aa, Homo Sapiens
GMPPPHLQR

SEQ ID NO: 135874 - protein, 9 aa, Homo Sapiens
GQPEAVARL

SEQ ID NO: 135875 - protein, 9 aa, Homo Sapiens
GSPVFLCAL

SEQ ID NO: 135876 - protein, 9 aa, Homo Sapiens
GTPGSRPGL

SEQ ID NO: 135877 - protein, 9 aa, Homo Sapiens
GVAIGQTSL

SEQ ID NO: 135878 - protein, 9 aa, Homo Sapiens
HAPDNFREL

SEQ ID NO: 135879 - protein, 9 aa, Homo Sapiens
HAPFTATSL

SEQ ID NO: 135880 - protein, 9 aa, Homo Sapiens
HAPLSGESL

SEQ ID NO: 135881 - protein, 9 aa, Homo Sapiens
HAPVRPVTL

SEQ ID NO: 135882 - protein, 9 aa, Homo Sapiens
HFYGKAIEL

SEQ ID NO: 135883 - protein, 9 aa, Homo Sapiens
HGPGPVGAL

SEQ ID NO: 135884 - protein, 9 aa, Homo Sapiens
HGPRAVSCL

SEQ ID NO: 135885 - protein, 9 aa, Homo Sapiens
HHPDYNNEL

SEQ ID NO: 135886 - protein, 9 aa, Homo Sapiens
HIIAGAGEL

SEQ ID NO: 135887 - protein, 9 aa, Homo Sapiens
HIPDVITYL

SEQ ID NO: 135888 - protein, 9 aa, Homo Sapiens
HIPEQTTQL

SEQ ID NO: 135889 - protein, 9 aa, Homo Sapiens
HISSQNSEL

SEQ ID NO: 135890 - protein, 9 aa, Homo Sapiens
HLAEKTSSL

SEQ ID NO: 135891 - protein, 9 aa, Homo Sapiens
HLPAHSQSL

SEQ ID NO: 135892 - protein, 9 aa, Homo Sapiens
HLPDMHSEL

SEQ ID NO: 135893 - protein, 9 aa, Homo Sapiens
HLPPGFLHL

SEQ ID NO: 135894 - protein, 9 aa, Homo Sapiens
HLPPTFHAV

SEQ ID NO: 135895 - protein, 9 aa, Homo Sapiens
HLPSGVKSL

SEQ ID NO: 135896 - protein, 9 aa, Homo Sapiens
HLQEYTSTL

SEQ ID NO: 135897 - protein, 9 aa, Homo Sapiens
HSPAGSQAL

SEQ ID NO: 135898 - protein, 9 aa, Homo Sapiens
HSPEEAREL

SEQ ID NO: 135899 - protein, 9 aa, Homo Sapiens
HSPGAVSSL

SEQ ID NO: 135900 - protein, 9 aa, Homo Sapiens
HVITKTMEL

SEQ ID NO: 135901 - protein, 9 aa, Homo Sapiens
HVNVSGNEL

SEQ ID NO: 135902 - protein, 9 aa, Homo Sapiens
HVPAPKLAL

SEQ ID NO: 135903 - protein, 9 aa, Homo Sapiens
HVPEHAVVL

SEQ ID NO: 135904 - protein, 9 aa, Homo Sapiens
HVPGWLRPL

SEQ ID NO: 135905 - protein, 9 aa, Homo Sapiens
HWEVRIKEL

SEQ ID NO: 135906 - protein, 9 aa, Homo Sapiens
IAPEGSLVF

SEQ ID NO: 135907 - protein, 9 aa, Homo Sapiens
IAPERRFYL

SEQ ID NO: 135908 - protein, 9 aa, Homo Sapiens
IAPESDYSL

SEQ ID NO: 135909 - protein, 9 aa, Homo Sapiens
IAPETGENL

SEQ ID NO: 135910 - protein, 9 aa, Homo Sapiens
IAPETRRSI

SEQ ID NO: 135911 - protein, 9 aa, Homo Sapiens
IAPGHVSVI

SEQ ID NO: 135912 - protein, 9 aa, Homo Sapiens
IAPGVTHEL

SEQ ID NO: 135913 - protein, 9 aa, Homo Sapiens
IAPHARNGL

SEQ ID NO: 135914 - protein, 9 aa, Homo Sapiens
IAPKPAAHL

SEQ ID NO: 135915 - protein, 9 aa, Homo Sapiens
IAPKSTSVF

SEQ ID NO: 135916 - protein, 9 aa, Homo Sapiens
IAPLRVLSF

SEQ ID NO: 135917 - protein, 9 aa, Homo Sapiens
IAPNGALQL

SEQ ID NO: 135918 - protein, 9 aa, Homo Sapiens
IAPQRIPSL

SEQ ID NO: 135919 - protein, 9 aa, Homo Sapiens
IAPSRKVTF

SEQ ID NO: 135920 - protein, 9 aa, Homo Sapiens
IAPSRPWAL

SEQ ID NO: 135921 - protein, 9 aa, Homo Sapiens
IFEAAKQEL

SEQ ID NO: 135922 - protein, 9 aa, Homo Sapiens
IFEGGATEL

SEQ ID NO: 135923 - protein, 9 aa, Homo Sapiens
IFQTAKETL

SEQ ID NO: 135924 - protein, 9 aa, Homo Sapiens
IFRVNLRTL

SEQ ID NO: 135925 - protein, 9 aa, Homo Sapiens
IFVPARNNM

SEQ ID NO: 135926 - protein, 9 aa, Homo Sapiens
IGPTTARAL

SEQ ID NO: 135927 - protein, 9 aa, Homo Sapiens
IINDLLQSL

SEQ ID NO: 135928 - protein, 9 aa, Homo Sapiens
IINGEATML

SEQ ID NO: 135929 - protein, 9 aa, Homo Sapiens
IIPVGGTYL

SEQ ID NO: 135930 - protein, 9 aa, Homo Sapiens
IIPYITNVL

SEQ ID NO: 135931 - protein, 9 aa, Homo Sapiens
IIYTAKISL

SEQ ID NO: 135932 - protein, 9 aa, Homo Sapiens
IKEPIWETL

SEQ ID NO: 135933 - protein, 9 aa, Homo Sapiens
ILISTPESL

SEQ ID NO: 135934 - protein, 9 aa, Homo Sapiens
ILPEQHMSL

SEQ ID NO: 135935 - protein, 9 aa, Homo Sapiens
ILPISQESL

SEQ ID NO: 135936 - protein, 9 aa, Homo Sapiens
ILPLRNWLL

SEQ ID NO: 135937 - protein, 9 aa, Homo Sapiens
ILPPSAHEL

SEQ ID NO: 135938 - protein, 9 aa, Homo Sapiens
IMPNVTISL

SEQ ID NO: 135939 - protein, 9 aa, Homo Sapiens
ISPDTVGTL

SEQ ID NO: 135940 - protein, 9 aa, Homo Sapiens
ISPEFFTVL

SEQ ID NO: 135941 - protein, 9 aa, Homo Sapiens
ISPENHISL

SEQ ID NO: 135942 - protein, 9 aa, Homo Sapiens
ISPEPKTEM

SEQ ID NO: 135943 - protein, 9 aa, Homo Sapiens
ISPETMVAL

SEQ ID NO: 135944 - protein, 9 aa, Homo Sapiens
ISPFHDIPI

SEQ ID NO: 135945 - protein, 9 aa, Homo Sapiens
ISPKVKMAL

SEQ ID NO: 135946 - protein, 9 aa, Homo Sapiens
ISPPPTANL

SEQ ID NO: 135947 - protein, 9 aa, Homo Sapiens
ISPRFDVQL

SEQ ID NO: 135948 - protein, 9 aa, Homo Sapiens
ITPAAFSTL

SEQ ID NO: 135949 - protein, 9 aa, Homo Sapiens
ITPDKVRGL

SEQ ID NO: 135950 - protein, 9 aa, Homo Sapiens
ITPGGFSSV

SEQ ID NO: 135951 - protein, 9 aa, Homo Sapiens
ITPLGSSEL

SEQ ID NO: 135952 - protein, 9 aa, Homo Sapiens
ITPSTQQHL

SEQ ID NO: 135953 - protein, 9 aa, Homo Sapiens
IVAKHTSAL

SEQ ID NO: 135954 - protein, 9 aa, Homo Sapiens
IVPDGTLQL

SEQ ID NO: 135955 - protein, 9 aa, Homo Sapiens
IVPGNVKSL

SEQ ID NO: 135956 - protein, 9 aa, Homo Sapiens
IVPHGYTEV

SEQ ID NO: 135957 - protein, 9 aa, Homo Sapiens
IVPTGKTGL

SEQ ID NO: 135958 - protein, 9 aa, Homo Sapiens
IVTERLVAL

SEQ ID NO: 135959 - protein, 9 aa, Homo Sapiens
KAMEAASSL

SEQ ID NO: 135960 - protein, 9 aa, Homo Sapiens
KAPDFLPLL

SEQ ID NO: 135961 - protein, 9 aa, Homo Sapiens
KAPEMTNEL

SEQ ID NO: 135962 - protein, 9 aa, Homo Sapiens
KAPEPLSSL

SEQ ID NO: 135963 - protein, 9 aa, Homo Sapiens
KAPEPPPAL

SEQ ID NO: 135964 - protein, 9 aa, Homo Sapiens
KAPGFAQML

SEQ ID NO: 135965 - protein, 9 aa, Homo Sapiens
KAPGFRPPL

SEQ ID NO: 135966 - protein, 9 aa, Homo Sapiens
KAPGSTSNL

SEQ ID NO: 135967 - protein, 9 aa, Homo Sapiens
KAPLSKVRL

SEQ ID NO: 135968 - protein, 9 aa, Homo Sapiens
KAPQTPSAL

SEQ ID NO: 135969 - protein, 9 aa, Homo Sapiens
KAPSSNTDL

SEQ ID NO: 135970 - protein, 9 aa, Homo Sapiens
KAPVGPVTM

SEQ ID NO: 135971 - protein, 9 aa, Homo Sapiens
KAPVNTAEL

SEQ ID NO: 135972 - protein, 9 aa, Homo Sapiens
KAPVTKVAA

SEQ ID NO: 135973 - protein, 9 aa, Homo Sapiens
KFHPNGSTL

SEQ ID NO: 135974 - protein, 9 aa, Homo Sapiens
KFWERFIAL

SEQ ID NO: 135975 - protein, 9 aa, Homo Sapiens
KGPPAALTL

SEQ ID NO: 135976 - protein, 9 aa, Homo Sapiens
KIAEGVNSL

SEQ ID NO: 135977 - protein, 9 aa, Homo Sapiens
KIAEKTAAL

SEQ ID NO: 135978 - protein, 9 aa, Homo Sapiens
KIHSSFRSL

SEQ ID NO: 135979 - protein, 9 aa, Homo Sapiens
KIITKAKSL

SEQ ID NO: 135980 - protein, 9 aa, Homo Sapiens
KILDKSQAL

SEQ ID NO: 135981 - protein, 9 aa, Homo Sapiens
KIPDISSFL

SEQ ID NO: 135982 - protein, 9 aa, Homo Sapiens
KIPDKTERL

SEQ ID NO: 135983 - protein, 9 aa, Homo Sapiens
KIPEDQHAL

SEQ ID NO: 135984 - protein, 9 aa, Homo Sapiens
KIPEDVSGL

SEQ ID NO: 135985 - protein, 9 aa, Homo Sapiens
KIPEESKAL

SEQ ID NO: 135986 - protein, 9 aa, Homo Sapiens
KIPTCKITL

SEQ ID NO: 135987 - protein, 9 aa, Homo Sapiens
KIQEAVKAL

SEQ ID NO: 135988 - protein, 9 aa, Homo Sapiens
KLIAKVRCL

SEQ ID NO: 135989 - protein, 9 aa, Homo Sapiens
KLPAFSPLM

SEQ ID NO: 135990 - protein, 9 aa, Homo Sapiens
KLPDGFSQL

SEQ ID NO: 135991 - protein, 9 aa, Homo Sapiens
KLPEKWESV

SEQ ID NO: 135992 - protein, 9 aa, Homo Sapiens
KLPGNISSL

SEQ ID NO: 135993 - protein, 9 aa, Homo Sapiens
KLPGPGSSL

SEQ ID NO: 135994 - protein, 9 aa, Homo Sapiens
KLPKVNKEL

SEQ ID NO: 135995 - protein, 9 aa, Homo Sapiens
KLPTPMQSL

SEQ ID NO: 135996 - protein, 9 aa, Homo Sapiens
KLQASVRCL

SEQ ID NO: 135997 - protein, 9 aa, Homo Sapiens
KSPAITATL

SEQ ID NO: 135998 - protein, 9 aa, Homo Sapiens
KSPEIQRAL

SEQ ID NO: 135999 - protein, 9 aa, Homo Sapiens
KSPGFGLSL

SEQ ID NO: 136000 - protein, 9 aa, Homo Sapiens
KSPGTANVL

SEQ ID NO: 136001 - protein, 9 aa, Homo Sapiens
KSPIAPCSL

SEQ ID NO: 136002 - protein, 9 aa, Homo Sapiens
KSPITRSEM

SEQ ID NO: 136003 - protein, 9 aa, Homo Sapiens
KSPVNTKSL

SEQ ID NO: 136004 - protein, 9 aa, Homo Sapiens
KTAENFRAL

SEQ ID NO: 136005 - protein, 9 aa, Homo Sapiens
KTPFVARSL

SEQ ID NO: 136006 - protein, 9 aa, Homo Sapiens
KTPGPVRGL

SEQ ID NO: 136007 - protein, 9 aa, Homo Sapiens
KTPQGLSNL

SEQ ID NO: 136008 - protein, 9 aa, Homo Sapiens
KVFSTKSSL

SEQ ID NO: 136009 - protein, 9 aa, Homo Sapiens
KVPAGVQEL

SEQ ID NO: 136010 - protein, 9 aa, Homo Sapiens
KVPFIINTL

SEQ ID NO: 136011 - protein, 9 aa, Homo Sapiens
KVPKERLAL

SEQ ID NO: 136012 - protein, 9 aa, Homo Sapiens
KVPTTKSTL

SEQ ID NO: 136013 - protein, 9 aa, Homo Sapiens
KVQAGNSSL

SEQ ID NO: 136014 - protein, 9 aa, Homo Sapiens
KVTELRSEL

SEQ ID NO: 136015 - protein, 9 aa, Homo Sapiens
KWQERKEAL

SEQ ID NO: 136016 - protein, 9 aa, Homo Sapiens
LAPASLTSA

SEQ ID NO: 136017 - protein, 9 aa, Homo Sapiens
LAPASVQTL

SEQ ID NO: 136018 - protein, 9 aa, Homo Sapiens
LAPATVQTV

SEQ ID NO: 136019 - protein, 9 aa, Homo Sapiens
LAPCFQKAL

SEQ ID NO: 136020 - protein, 9 aa, Homo Sapiens
LAPNIISQL

SEQ ID NO: 136021 - protein, 9 aa, Homo Sapiens
LAPNQTKEL

SEQ ID NO: 136022 - protein, 9 aa, Homo Sapiens
LAPPAGATL

SEQ ID NO: 136023 - protein, 9 aa, Homo Sapiens
LAPPAGSVL

SEQ ID NO: 136024 - protein, 9 aa, Homo Sapiens
LAPSASVVL

SEQ ID NO: 136025 - protein, 9 aa, Homo Sapiens
LAPSGDLSL

SEQ ID NO: 136026 - protein, 9 aa, Homo Sapiens
LAPSGFLGL

SEQ ID NO: 136027 - protein, 9 aa, Homo Sapiens
LAPTREIAV

SEQ ID NO: 136028 - protein, 9 aa, Homo Sapiens
LAPVRQQEL

SEQ ID NO: 136029 - protein, 9 aa, Homo Sapiens
LFEDATSAL

SEQ ID NO: 136030 - protein, 9 aa, Homo Sapiens
LFENRLSSL

SEQ ID NO: 136031 - protein, 9 aa, Homo Sapiens
LFEPVINAL

SEQ ID NO: 136032 - protein, 9 aa, Homo Sapiens
LFKEREKPL

SEQ ID NO: 136033 - protein, 9 aa, Homo Sapiens
LFMPRSTEF

SEQ ID NO: 136034 - protein, 9 aa, Homo Sapiens
LGPAALHAL

SEQ ID NO: 136035 - protein, 9 aa, Homo Sapiens
LGPPAAHSL

SEQ ID NO: 136036 - protein, 9 aa, Homo Sapiens
LGPPGTSAL

SEQ ID NO: 136037 - protein, 9 aa, Homo Sapiens
LIPAVGSSL

SEQ ID NO: 136038 - protein, 9 aa, Homo Sapiens
LIPKDYRSL

SEQ ID NO: 136039 - protein, 9 aa, Homo Sapiens
LLLERAKEL

SEQ ID NO: 136040 - protein, 9 aa, Homo Sapiens
LLLTRPVWL

SEQ ID NO: 136041 - protein, 9 aa, Homo Sapiens
LLNSATTSL

SEQ ID NO: 136042 - protein, 9 aa, Homo Sapiens
LLPDEVSTL

SEQ ID NO: 136043 - protein, 9 aa, Homo Sapiens
LLPEHFLFL

SEQ ID NO: 136044 - protein, 9 aa, Homo Sapiens
LLPGNARCL

SEQ ID NO: 136045 - protein, 9 aa, Homo Sapiens
LLPHAVSSL

SEQ ID NO: 136046 - protein, 9 aa, Homo Sapiens
LLPPPMKEL

SEQ ID NO: 136047 - protein, 9 aa, Homo Sapiens
LLPSHASYL

SEQ ID NO: 136048 - protein, 9 aa, Homo Sapiens
LLPVITKEL

SEQ ID NO: 136049 - protein, 9 aa, Homo Sapiens
LMPQVLTTL

SEQ ID NO: 136050 - protein, 9 aa, Homo Sapiens
LSPAPSKTL

SEQ ID NO: 136051 - protein, 9 aa, Homo Sapiens
LSPEARRSL

SEQ ID NO: 136052 - protein, 9 aa, Homo Sapiens
LSPEFFTSV

SEQ ID NO: 136053 - protein, 9 aa, Homo Sapiens
LSPENLQSL

SEQ ID NO: 136054 - protein, 9 aa, Homo Sapiens
LSPGSLTLS

SEQ ID NO: 136055 - protein, 9 aa, Homo Sapiens
LSPITKLSV

SEQ ID NO: 136056 - protein, 9 aa, Homo Sapiens
LSPMSVNAV

SEQ ID NO: 136057 - protein, 9 aa, Homo Sapiens
LSPNTTSSL

SEQ ID NO: 136058 - protein, 9 aa, Homo Sapiens
LSPQRKEAL

SEQ ID NO: 136059 - protein, 9 aa, Homo Sapiens
LSPSSDLTL

SEQ ID NO: 136060 - protein, 9 aa, Homo Sapiens
LSPTPATAL

SEQ ID NO: 136061 - protein, 9 aa, Homo Sapiens
LSPTYELAL

SEQ ID NO: 136062 - protein, 9 aa, Homo Sapiens
LTNQPTLEL

SEQ ID NO: 136063 - protein, 9 aa, Homo Sapiens
LTPPVATEL

SEQ ID NO: 136064 - protein, 9 aa, Homo Sapiens
LVPFSIKPL

SEQ ID NO: 136065 - protein, 9 aa, Homo Sapiens
LVPKRDHAL

SEQ ID NO: 136066 - protein, 9 aa, Homo Sapiens
MAAAAPVAA

SEQ ID NO: 136067 - protein, 9 aa, Homo Sapiens
MAPDISLTL

SEQ ID NO: 136068 - protein, 9 aa, Homo Sapiens
MAPDKQLTL

SEQ ID NO: 136069 - protein, 9 aa, Homo Sapiens
MAPDSSMSM

SEQ ID NO: 136070 - protein, 9 aa, Homo Sapiens
MAPEQKTEL

SEQ ID NO: 136071 - protein, 9 aa, Homo Sapiens
MAPGTVTVV

SEQ ID NO: 136072 - protein, 9 aa, Homo Sapiens
MAPHNPHTL

SEQ ID NO: 136073 - protein, 9 aa, Homo Sapiens
MAPKAWTVL

SEQ ID NO: 136074 - protein, 9 aa, Homo Sapiens
MAPLKMLAL

SEQ ID NO: 136075 - protein, 9 aa, Homo Sapiens
MAPPSASCL

SEQ ID NO: 136076 - protein, 9 aa, Homo Sapiens
MAPQNLSTF

SEQ ID NO: 136077 - protein, 9 aa, Homo Sapiens
MAPRTGKSL

SEQ ID NO: 136078 - protein, 9 aa, Homo Sapiens
MAPSGSLAV

SEQ ID NO: 136079 - protein, 9 aa, Homo Sapiens
MAPSIMKSL

SEQ ID NO: 136080 - protein, 9 aa, Homo Sapiens
MAPSKETEM

SEQ ID NO: 136081 - protein, 9 aa, Homo Sapiens
MAPVASIWL

SEQ ID NO: 136082 - protein, 9 aa, Homo Sapiens
MAPYGPLAA

SEQ ID NO: 136083 - protein, 9 aa, Homo Sapiens
MFCEKAMEL

SEQ ID NO: 136084 - protein, 9 aa, Homo Sapiens
MGPAARPAL

SEQ ID NO: 136085 - protein, 9 aa, Homo Sapiens
MGPAGAKNL

SEQ ID NO: 136086 - protein, 9 aa, Homo Sapiens
MIPLLLAAL

SEQ ID NO: 136087 - protein, 9 aa, Homo Sapiens
MIQNSRPSL

SEQ ID NO: 136088 - protein, 9 aa, Homo Sapiens
MLIEQARAL

SEQ ID NO: 136089 - protein, 9 aa, Homo Sapiens
MLPEKLRPL

SEQ ID NO: 136090 - protein, 9 aa, Homo Sapiens
MLPELKSTL

SEQ ID NO: 136091 - protein, 9 aa, Homo Sapiens
MLPMKVRAL

SEQ ID NO: 136092 - protein, 9 aa, Homo Sapiens
MMPDGTLGL

SEQ ID NO: 136093 - protein, 9 aa, Homo Sapiens
MSPDVKNSI

SEQ ID NO: 136094 - protein, 9 aa, Homo Sapiens
MSPIPAHSL

SEQ ID NO: 136095 - protein, 9 aa, Homo Sapiens
MSPKAQRPL

SEQ ID NO: 136096 - protein, 9 aa, Homo Sapiens
MSPLSETEM

SEQ ID NO: 136097 - protein, 9 aa, Homo Sapiens
MSPLSNNSL

SEQ ID NO: 136098 - protein, 9 aa, Homo Sapiens
MSPMAERSM

SEQ ID NO: 136099 - protein, 9 aa, Homo Sapiens
MSPPPAKKL

SEQ ID NO: 136100 - protein, 9 aa, Homo Sapiens
MSPSGRLCL

SEQ ID NO: 136101 - protein, 9 aa, Homo Sapiens
MTPLRALAL

SEQ ID NO: 136102 - protein, 9 aa, Homo Sapiens
MTPSAKQSL

SEQ ID NO: 136103 - protein, 9 aa, Homo Sapiens
MTPTRELAL

SEQ ID NO: 136104 - protein, 9 aa, Homo Sapiens
MVADKFTEL

SEQ ID NO: 136105 - protein, 9 aa, Homo Sapiens
MVADRFSEL

SEQ ID NO: 136106 - protein, 9 aa, Homo Sapiens
NAAERRGPL

SEQ ID NO: 136107 - protein, 9 aa, Homo Sapiens
NAAIAKQAL

SEQ ID NO: 136108 - protein, 9 aa, Homo Sapiens
NAIPVDTVL

SEQ ID NO: 136109 - protein, 9 aa, Homo Sapiens
NAPAAISFL

SEQ ID NO: 136110 - protein, 9 aa, Homo Sapiens
NAPEANRGL

SEQ ID NO: 136111 - protein, 9 aa, Homo Sapiens
NAPEQACHL

SEQ ID NO: 136112 - protein, 9 aa, Homo Sapiens
NAPGYGPII

SEQ ID NO: 136113 - protein, 9 aa, Homo Sapiens
NAPLFIRAV

SEQ ID NO: 136114 - protein, 9 aa, Homo Sapiens
NAPMTLEEF

SEQ ID NO: 136115 - protein, 9 aa, Homo Sapiens
NAPPSFGTL

SEQ ID NO: 136116 - protein, 9 aa, Homo Sapiens
NAPSHPRAL

SEQ ID NO: 136117 - protein, 9 aa, Homo Sapiens
NFQTAKESL

SEQ ID NO: 136118 - protein, 9 aa, Homo Sapiens
NGPGTPRPL

SEQ ID NO: 136119 - protein, 9 aa, Homo Sapiens
NGPILNVLV

SEQ ID NO: 136120 - protein, 9 aa, Homo Sapiens
NGPVSHSSL

SEQ ID NO: 136121 - protein, 9 aa, Homo Sapiens
NIPAGKPSL

SEQ ID NO: 136122 - protein, 9 aa, Homo Sapiens
NIPDMLQSL

SEQ ID NO: 136123 - protein, 9 aa, Homo Sapiens
NIPGEYRCL

SEQ ID NO: 136124 - protein, 9 aa, Homo Sapiens
NIPTWLTEL

SEQ ID NO: 136125 - protein, 9 aa, Homo Sapiens
NLPEETNEL

SEQ ID NO: 136126 - protein, 9 aa, Homo Sapiens
NLPERSVPL

SEQ ID NO: 136127 - protein, 9 aa, Homo Sapiens
NLPKARAAL

SEQ ID NO: 136128 - protein, 9 aa, Homo Sapiens
NLPSTGGSL

SEQ ID NO: 136129 - protein, 9 aa, Homo Sapiens
NMPLTISSL

SEQ ID NO: 136130 - protein, 9 aa, Homo Sapiens
NRPGTVSSL

SEQ ID NO: 136131 - protein, 9 aa, Homo Sapiens
NSPASLVGL

SEQ ID NO: 136132 - protein, 9 aa, Homo Sapiens
NSPEKACSL

SEQ ID NO: 136133 - protein, 9 aa, Homo Sapiens
NSPFQVTAL

SEQ ID NO: 136134 - protein, 9 aa, Homo Sapiens
NSPGTYQEL

SEQ ID NO: 136135 - protein, 9 aa, Homo Sapiens
NSPIRSSAF

SEQ ID NO: 136136 - protein, 9 aa, Homo Sapiens
NSPLPGSEL

SEQ ID NO: 136137 - protein, 9 aa, Homo Sapiens
NSPLRENSF

SEQ ID NO: 136138 - protein, 9 aa, Homo Sapiens
NSPLVRRTL

SEQ ID NO: 136139 - protein, 9 aa, Homo Sapiens
NSPSCTREL

SEQ ID NO: 136140 - protein, 9 aa, Homo Sapiens
NSPSFCTSL

SEQ ID NO: 136141 - protein, 9 aa, Homo Sapiens
NSPTNISSL

SEQ ID NO: 136142 - protein, 9 aa, Homo Sapiens
NTPEDVQAL

SEQ ID NO: 136143 - protein, 9 aa, Homo Sapiens
NTPENLHEM

SEQ ID NO: 136144 - protein, 9 aa, Homo Sapiens
NTPVVKSAL

SEQ ID NO: 136145 - protein, 9 aa, Homo Sapiens
NVPAAGSHL

SEQ ID NO: 136146 - protein, 9 aa, Homo Sapiens
NVPDGTGAL

SEQ ID NO: 136147 - protein, 9 aa, Homo Sapiens
NVPEAASTL

SEQ ID NO: 136148 - protein, 9 aa, Homo Sapiens
PAPGPHPAL

SEQ ID NO: 136149 - protein, 9 aa, Homo Sapiens
PAYHSSLMD

SEQ ID NO: 136150 - protein, 9 aa, Homo Sapiens
PDDTEAALL

SEQ ID NO: 136151 - protein, 9 aa, Homo Sapiens
PMSESTLSI

SEQ ID NO: 136152 - protein, 9 aa, Homo Sapiens
PRHSQSLTM

SEQ ID NO: 136153 - protein, 9 aa, Homo Sapiens
PSIVHRKCF

SEQ ID NO: 136154 - protein, 9 aa, Homo Sapiens
QAPAAVVEL

SEQ ID NO: 136155 - protein, 9 aa, Homo Sapiens
QAPDGMQSL

SEQ ID NO: 136156 - protein, 9 aa, Homo Sapiens
QAPSGRAPL

SEQ ID NO: 136157 - protein, 9 aa, Homo Sapiens
QAPVAAHTV

SEQ ID NO: 136158 - protein, 9 aa, Homo Sapiens
QFLPRTITL

SEQ ID NO: 136159 - protein, 9 aa, Homo Sapiens
QGPDGRLEL

SEQ ID NO: 136160 - protein, 9 aa, Homo Sapiens
QGPGGASEL

SEQ ID NO: 136161 - protein, 9 aa, Homo Sapiens
QGPPVTPVL

SEQ ID NO: 136162 - protein, 9 aa, Homo Sapiens
QIAVGFLEL

SEQ ID NO: 136163 - protein, 9 aa, Homo Sapiens
QIPEIKQTL

SEQ ID NO: 136164 - protein, 9 aa, Homo Sapiens
QIPVDLSEL

SEQ ID NO: 136165 - protein, 9 aa, Homo Sapiens
QLIPKRSAL

SEQ ID NO: 136166 - protein, 9 aa, Homo Sapiens
QLPEGASAV

SEQ ID NO: 136167 - protein, 9 aa, Homo Sapiens
QLPSGWASI

SEQ ID NO: 136168 - protein, 9 aa, Homo Sapiens
QSPASLSSL

SEQ ID NO: 136169 - protein, 9 aa, Homo Sapiens
QSPDGVLDL

SEQ ID NO: 136170 - protein, 9 aa, Homo Sapiens
QSPEGMISL

SEQ ID NO: 136171 - protein, 9 aa, Homo Sapiens
QSPFFPVVL

SEQ ID NO: 136172 - protein, 9 aa, Homo Sapiens
QSPQTLLEL

SEQ ID NO: 136173 - protein, 9 aa, Homo Sapiens
QTIGARKEL

SEQ ID NO: 136174 - protein, 9 aa, Homo Sapiens
QTPDGVHCL

SEQ ID NO: 136175 - protein, 9 aa, Homo Sapiens
QTPDIKVSL

SEQ ID NO: 136176 - protein, 9 aa, Homo Sapiens
QTPGHTEEL

SEQ ID NO: 136177 - protein, 9 aa, Homo Sapiens
QTPLALRSL

SEQ ID NO: 136178 - protein, 9 aa, Homo Sapiens
QTPVGVSTL

SEQ ID NO: 136179 - protein, 9 aa, Homo Sapiens
QVIEKTKSL

SEQ ID NO: 136180 - protein, 9 aa, Homo Sapiens
QVNDLTTAL

SEQ ID NO: 136181 - protein, 9 aa, Homo Sapiens
QVNGAATEL

SEQ ID NO: 136182 - protein, 9 aa, Homo Sapiens
QVPVVMTSL

SEQ ID NO: 136183 - protein, 9 aa, Homo Sapiens
RAALRSCSL

SEQ ID NO: 136184 - protein, 9 aa, Homo Sapiens
RAPAAGESL

SEQ ID NO: 136185 - protein, 9 aa, Homo Sapiens
RAPASAEAM

SEQ ID NO: 136186 - protein, 9 aa, Homo Sapiens
RAPDVARAL

SEQ ID NO: 136187 - protein, 9 aa, Homo Sapiens
RAPEAQQTL

SEQ ID NO: 136188 - protein, 9 aa, Homo Sapiens
RAPEEVHAL

SEQ ID NO: 136189 - protein, 9 aa, Homo Sapiens
RAPEFLQTL

SEQ ID NO: 136190 - protein, 9 aa, Homo Sapiens
RAPEGQLPA

SEQ ID NO: 136191 - protein, 9 aa, Homo Sapiens
RAPGPWQAM

SEQ ID NO: 136192 - protein, 9 aa, Homo Sapiens
RAPVPASEL

SEQ ID NO: 136193 - protein, 9 aa, Homo Sapiens
RAPWTSTSV

SEQ ID NO: 136194 - protein, 9 aa, Homo Sapiens
RGPGPRSSL

SEQ ID NO: 136195 - protein, 9 aa, Homo Sapiens
RIAEFTTNL

SEQ ID NO: 136196 - protein, 9 aa, Homo Sapiens
RIMEFTTTL

SEQ ID NO: 136197 - protein, 9 aa, Homo Sapiens
RIPAYFVTV

SEQ ID NO: 136198 - protein, 9 aa, Homo Sapiens
RIPDQLGYL

SEQ ID NO: 136199 - protein, 9 aa, Homo Sapiens
RIPSAFRHL

SEQ ID NO: 136200 - protein, 9 aa, Homo Sapiens
RIPSFVTEL

SEQ ID NO: 136201 - protein, 9 aa, Homo Sapiens
RIPVHSSAL

SEQ ID NO: 136202 - protein, 9 aa, Homo Sapiens
RIQEELSAL

SEQ ID NO: 136203 - protein, 9 aa, Homo Sapiens
RLIKDTLAL

SEQ ID NO: 136204 - protein, 9 aa, Homo Sapiens
RLINQVLEL

SEQ ID NO: 136205 - protein, 9 aa, Homo Sapiens
RLPAWQPIL

SEQ ID NO: 136206 - protein, 9 aa, Homo Sapiens
RLPCSFATL

SEQ ID NO: 136207 - protein, 9 aa, Homo Sapiens
RLPDGFTQL

SEQ ID NO: 136208 - protein, 9 aa, Homo Sapiens
RLPEELRSL

SEQ ID NO: 136209 - protein, 9 aa, Homo Sapiens
RLPERMTTL

SEQ ID NO: 136210 - protein, 9 aa, Homo Sapiens
RLPESNQTL

SEQ ID NO: 136211 - protein, 9 aa, Homo Sapiens
RLPGRSTSL

SEQ ID NO: 136212 - protein, 9 aa, Homo Sapiens
RLPHSTAAL

SEQ ID NO: 136213 - protein, 9 aa, Homo Sapiens
RLPPKVESL

SEQ ID NO: 136214 - protein, 9 aa, Homo Sapiens
RLPPLLSPL

SEQ ID NO: 136215 - protein, 9 aa, Homo Sapiens
RLPPYSSQL

SEQ ID NO: 136216 - protein, 9 aa, Homo Sapiens
RLPSEVSAL

SEQ ID NO: 136217 - protein, 9 aa, Homo Sapiens
RLPSRVLEL

SEQ ID NO: 136218 - protein, 9 aa, Homo Sapiens
RLPTSKRSL

SEQ ID NO: 136219 - protein, 9 aa, Homo Sapiens
RLPVNVREL

SEQ ID NO: 136220 - protein, 9 aa, Homo Sapiens
RMPDCSVAL

SEQ ID NO: 136221 - protein, 9 aa, Homo Sapiens
RNPPAFTEL

SEQ ID NO: 136222 - protein, 9 aa, Homo Sapiens
RQPAKVAAL

SEQ ID NO: 136223 - protein, 9 aa, Homo Sapiens
RQPYAVSEL

SEQ ID NO: 136224 - protein, 9 aa, Homo Sapiens
RSPEEVTEL

SEQ ID NO: 136225 - protein, 9 aa, Homo Sapiens
RSPGRAYAL

SEQ ID NO: 136226 - protein, 9 aa, Homo Sapiens
RSPPPGMGL

SEQ ID NO: 136227 - protein, 9 aa, Homo Sapiens
RSPSWQTAM

SEQ ID NO: 136228 - protein, 9 aa, Homo Sapiens
RSPVVHSVL

SEQ ID NO: 136229 - protein, 9 aa, Homo Sapiens
RTPAAVREL

SEQ ID NO: 136230 - protein, 9 aa, Homo Sapiens
RTPLHEIAL

SEQ ID NO: 136231 - protein, 9 aa, Homo Sapiens
RTPSDVKEL

SEQ ID NO: 136232 - protein, 9 aa, Homo Sapiens
RTPSSSSTL

SEQ ID NO: 136233 - protein, 9 aa, Homo Sapiens
RVEERLSAL

SEQ ID NO: 136234 - protein, 9 aa, Homo Sapiens
RVIDLRAEL

SEQ ID NO: 136235 - protein, 9 aa, Homo Sapiens
RVNSTMTTL

SEQ ID NO: 136236 - protein, 9 aa, Homo Sapiens
RVPLASQGL

SEQ ID NO: 136237 - protein, 9 aa, Homo Sapiens
RVPRNIKSL

SEQ ID NO: 136238 - protein, 9 aa, Homo Sapiens
RVPSAGSSL

SEQ ID NO: 136239 - protein, 9 aa, Homo Sapiens
RVPTANVSV

SEQ ID NO: 136240 - protein, 9 aa, Homo Sapiens
RVPYRDSKL

SEQ ID NO: 136241 - protein, 9 aa, Homo Sapiens
SAAQRLTAL

SEQ ID NO: 136242 - protein, 9 aa, Homo Sapiens
SANFSYNAL

SEQ ID NO: 136243 - protein, 9 aa, Homo Sapiens
SANYTEIAL

SEQ ID NO: 136244 - protein, 9 aa, Homo Sapiens
SAPAAAAGL

SEQ ID NO: 136245 - protein, 9 aa, Homo Sapiens
SAPARQAVL

SEQ ID NO: 136246 - protein, 9 aa, Homo Sapiens
SAPASQASL

SEQ ID NO: 136247 - protein, 9 aa, Homo Sapiens
SAPASTTAV

SEQ ID NO: 136248 - protein, 9 aa, Homo Sapiens
SAPDFQQSL

SEQ ID NO: 136249 - protein, 9 aa, Homo Sapiens
SAPDKSLEL

SEQ ID NO: 136250 - protein, 9 aa, Homo Sapiens
SAPDMRVAL

SEQ ID NO: 136251 - protein, 9 aa, Homo Sapiens
SAPDNVLEV

SEQ ID NO: 136252 - protein, 9 aa, Homo Sapiens
SAPDPHQQL

SEQ ID NO: 136253 - protein, 9 aa, Homo Sapiens
SAPDPVSTL

SEQ ID NO: 136254 - protein, 9 aa, Homo Sapiens
SAPFLASAV

SEQ ID NO: 136255 - protein, 9 aa, Homo Sapiens
SAPGIISAL

SEQ ID NO: 136256 - protein, 9 aa, Homo Sapiens
SAPGPAQAM

SEQ ID NO: 136257 - protein, 9 aa, Homo Sapiens
SAPGPGLLL

SEQ ID NO: 136258 - protein, 9 aa, Homo Sapiens
SAPGTLKTL

SEQ ID NO: 136259 - protein, 9 aa, Homo Sapiens
SAPGTTMFL

SEQ ID NO: 136260 - protein, 9 aa, Homo Sapiens
SAPIFTTSL

SEQ ID NO: 136261 - protein, 9 aa, Homo Sapiens
SAPKYIDYL

SEQ ID NO: 136262 - protein, 9 aa, Homo Sapiens
SAPLGKMSL

SEQ ID NO: 136263 - protein, 9 aa, Homo Sapiens
SAPLLVNAM

SEQ ID NO: 136264 - protein, 9 aa, Homo Sapiens
SAPLPQSTL

SEQ ID NO: 136265 - protein, 9 aa, Homo Sapiens
SAPMTTNGL

SEQ ID NO: 136266 - protein, 9 aa, Homo Sapiens
SAPNSPMAL

SEQ ID NO: 136267 - protein, 9 aa, Homo Sapiens
SAPRPTRFL

SEQ ID NO: 136268 - protein, 9 aa, Homo Sapiens
SAPSADAPM

SEQ ID NO: 136269 - protein, 9 aa, Homo Sapiens
SAPSASVGL

SEQ ID NO: 136270 - protein, 9 aa, Homo Sapiens
SAPSNVTSL

SEQ ID NO: 136271 - protein, 9 aa, Homo Sapiens
SAPSRVQAL

SEQ ID NO: 136272 - protein, 9 aa, Homo Sapiens
SAPSSDKPL

SEQ ID NO: 136273 - protein, 9 aa, Homo Sapiens
SAPSSQARL

SEQ ID NO: 136274 - protein, 9 aa, Homo Sapiens
SAPSTQQVL

SEQ ID NO: 136275 - protein, 9 aa, Homo Sapiens
SAPTAIKAA

SEQ ID NO: 136276 - protein, 9 aa, Homo Sapiens
SAPTETHSL

SEQ ID NO: 136277 - protein, 9 aa, Homo Sapiens
SAPTIATYL

SEQ ID NO: 136278 - protein, 9 aa, Homo Sapiens
SAPTPIQAL

SEQ ID NO: 136279 - protein, 9 aa, Homo Sapiens
SAPTVRNAM

SEQ ID NO: 136280 - protein, 9 aa, Homo Sapiens
SAPVNFISA

SEQ ID NO: 136281 - protein, 9 aa, Homo Sapiens
SAPVPASPL

SEQ ID NO: 136282 - protein, 9 aa, Homo Sapiens
SAPVPASTL

SEQ ID NO: 136283 - protein, 9 aa, Homo Sapiens
SAPVPFTVL

SEQ ID NO: 136284 - protein, 9 aa, Homo Sapiens
SAPVSVSAV

SEQ ID NO: 136285 - protein, 9 aa, Homo Sapiens
SFEPTTVEL

SEQ ID NO: 136286 - protein, 9 aa, Homo Sapiens
SFPHPLPSL

SEQ ID NO: 136287 - protein, 9 aa, Homo Sapiens
SFQPTVVSL

SEQ ID NO: 136288 - protein, 9 aa, Homo Sapiens
SFSPGNSSL

SEQ ID NO: 136289 - protein, 9 aa, Homo Sapiens
SGPAAAATL

SEQ ID NO: 136290 - protein, 9 aa, Homo Sapiens
SGPAPRCEL

SEQ ID NO: 136291 - protein, 9 aa, Homo Sapiens
SGPASGHAL

SEQ ID NO: 136292 - protein, 9 aa, Homo Sapiens
SGPERILSI

SEQ ID NO: 136293 - protein, 9 aa, Homo Sapiens
SGPGPAAAL

SEQ ID NO: 136294 - protein, 9 aa, Homo Sapiens
SGPRPGLSL

SEQ ID NO: 136295 - protein, 9 aa, Homo Sapiens
SGPVAANVL

SEQ ID NO: 136296 - protein, 9 aa, Homo Sapiens
SGPVPGTAI

SEQ ID NO: 136297 - protein, 9 aa, Homo Sapiens
SIAEQAHEL

SEQ ID NO: 136298 - protein, 9 aa, Homo Sapiens
SIAKQTSSL

SEQ ID NO: 136299 - protein, 9 aa, Homo Sapiens
SIFASGSEL

SEQ ID NO: 136300 - protein, 9 aa, Homo Sapiens
SIFSGAASL

SEQ ID NO: 136301 - protein, 9 aa, Homo Sapiens
SILTTHTTL

SEQ ID NO: 136302 - protein, 9 aa, Homo Sapiens
SINGDLMEL

SEQ ID NO: 136303 - protein, 9 aa, Homo Sapiens
SINQTTLEL

SEQ ID NO: 136304 - protein, 9 aa, Homo Sapiens
SIPAFLSSL

SEQ ID NO: 136305 - protein, 9 aa, Homo Sapiens
SIPALTATL

SEQ ID NO: 136306 - protein, 9 aa, Homo Sapiens
SIPDFPMHL

SEQ ID NO: 136307 - protein, 9 aa, Homo Sapiens
SIPDIKTAF

SEQ ID NO: 136308 - protein, 9 aa, Homo Sapiens
SIPDVNVNL

SEQ ID NO: 136309 - protein, 9 aa, Homo Sapiens
SIPERPAQL

SEQ ID NO: 136310 - protein, 9 aa, Homo Sapiens
SIPLAFACL

SEQ ID NO: 136311 - protein, 9 aa, Homo Sapiens
SIPLANESL

SEQ ID NO: 136312 - protein, 9 aa, Homo Sapiens
SIPTKALEL

SEQ ID NO: 136313 - protein, 9 aa, Homo Sapiens
SIQTSVNAL

SEQ ID NO: 136314 - protein, 9 aa, Homo Sapiens
SISSPVLSL

SEQ ID NO: 136315 - protein, 9 aa, Homo Sapiens
SITATTQAL

SEQ ID NO: 136316 - protein, 9 aa, Homo Sapiens
SLIEQTTAL

SEQ ID NO: 136317 - protein, 9 aa, Homo Sapiens
SLPAEVGCL

SEQ ID NO: 136318 - protein, 9 aa, Homo Sapiens
SLPAEVHSL

SEQ ID NO: 136319 - protein, 9 aa, Homo Sapiens
SLPAPSKAL

SEQ ID NO: 136320 - protein, 9 aa, Homo Sapiens
SLPDGGSCL

SEQ ID NO: 136321 - protein, 9 aa, Homo Sapiens
SLPDIKVYL

SEQ ID NO: 136322 - protein, 9 aa, Homo Sapiens
SLPENYKQL

SEQ ID NO: 136323 - protein, 9 aa, Homo Sapiens
SLPGPRKPL

SEQ ID NO: 136324 - protein, 9 aa, Homo Sapiens
SLPIATQEL

SEQ ID NO: 136325 - protein, 9 aa, Homo Sapiens
SLPNGTASL

SEQ ID NO: 136326 - protein, 9 aa, Homo Sapiens
SLPNVFSAL

SEQ ID NO: 136327 - protein, 9 aa, Homo Sapiens
SLPRDRQAL

SEQ ID NO: 136328 - protein, 9 aa, Homo Sapiens
SLPSYVSVL

SEQ ID NO: 136329 - protein, 9 aa, Homo Sapiens
SLVTGITAL

SEQ ID NO: 136330 - protein, 9 aa, Homo Sapiens
SMITGVAAL

SEQ ID NO: 136331 - protein, 9 aa, Homo Sapiens
SMNTASHSL

SEQ ID NO: 136332 - protein, 9 aa, Homo Sapiens
SMPEFMANL

SEQ ID NO: 136333 - protein, 9 aa, Homo Sapiens
SMPWNVDTL

SEQ ID NO: 136334 - protein, 9 aa, Homo Sapiens
SMPYHVCTL

SEQ ID NO: 136335 - protein, 9 aa, Homo Sapiens
SPLPAGNAL

SEQ ID NO: 136336 - protein, 9 aa, Homo Sapiens
SSLPAGAAL

SEQ ID NO: 136337 - protein, 9 aa, Homo Sapiens
SSLPVGPVL

SEQ ID NO: 136338 - protein, 9 aa, Homo Sapiens
SSPATESAL

SEQ ID NO: 136339 - protein, 9 aa, Homo Sapiens
SSPEFSKTL

SEQ ID NO: 136340 - protein, 9 aa, Homo Sapiens
SSPEKAASL

SEQ ID NO: 136341 - protein, 9 aa, Homo Sapiens
SSPERDFPL

SEQ ID NO: 136342 - protein, 9 aa, Homo Sapiens
SSPGAVAGL

SEQ ID NO: 136343 - protein, 9 aa, Homo Sapiens
SSPGHGSPL

SEQ ID NO: 136344 - protein, 9 aa, Homo Sapiens
SSPLKSHPL

SEQ ID NO: 136345 - protein, 9 aa, Homo Sapiens
SSPLRKQEL

SEQ ID NO: 136346 - protein, 9 aa, Homo Sapiens
SSPLVVVSV

SEQ ID NO: 136347 - protein, 9 aa, Homo Sapiens
SSPMATTAA

SEQ ID NO: 136348 - protein, 9 aa, Homo Sapiens
SSPPLRHAV

SEQ ID NO: 136349 - protein, 9 aa, Homo Sapiens
SSPPPHPQL

SEQ ID NO: 136350 - protein, 9 aa, Homo Sapiens
SSPQAGSSL

SEQ ID NO: 136351 - protein, 9 aa, Homo Sapiens
SSPSSKTSF

SEQ ID NO: 136352 - protein, 9 aa, Homo Sapiens
SSPSSLRAL

SEQ ID NO: 136353 - protein, 9 aa, Homo Sapiens
SSPSYENSL

SEQ ID NO: 136354 - protein, 9 aa, Homo Sapiens
SSPTFLRAL

SEQ ID NO: 136355 - protein, 9 aa, Homo Sapiens
SSPTVNTTL

SEQ ID NO: 136356 - protein, 9 aa, Homo Sapiens
SSPVADIAV

SEQ ID NO: 136357 - protein, 9 aa, Homo Sapiens
SSPVSMVHL

SEQ ID NO: 136358 - protein, 9 aa, Homo Sapiens
SSPVTNQAI

SEQ ID NO: 136359 - protein, 9 aa, Homo Sapiens
SSPVTVHTL

SEQ ID NO: 136360 - protein, 9 aa, Homo Sapiens
SSPVVATTM

SEQ ID NO: 136361 - protein, 9 aa, Homo Sapiens
SSPVVHQSL

SEQ ID NO: 136362 - protein, 9 aa, Homo Sapiens
SSPYSPAYL

SEQ ID NO: 136363 - protein, 9 aa, Homo Sapiens
SSPYSTDTL

SEQ ID NO: 136364 - protein, 9 aa, Homo Sapiens
STAIREISL

SEQ ID NO: 136365 - protein, 9 aa, Homo Sapiens
STPDHTSTL

SEQ ID NO: 136366 - protein, 9 aa, Homo Sapiens
STPEYTVEL

SEQ ID NO: 136367 - protein, 9 aa, Homo Sapiens
STPSGYLEL

SEQ ID NO: 136368 - protein, 9 aa, Homo Sapiens
STPSPTSSL

SEQ ID NO: 136369 - protein, 9 aa, Homo Sapiens
STPTGYGTL

SEQ ID NO: 136370 - protein, 9 aa, Homo Sapiens
SVECATQAL

SEQ ID NO: 136371 - protein, 9 aa, Homo Sapiens
SVIPDREYL

SEQ ID NO: 136372 - protein, 9 aa, Homo Sapiens
SVIQHTNSL

SEQ ID NO: 136373 - protein, 9 aa, Homo Sapiens
SVLAAANSV

SEQ ID NO: 136374 - protein, 9 aa, Homo Sapiens
SVPAFASSL

SEQ ID NO: 136375 - protein, 9 aa, Homo Sapiens
SVPAPTNVL

SEQ ID NO: 136376 - protein, 9 aa, Homo Sapiens
SVPDSVTPL

SEQ ID NO: 136377 - protein, 9 aa, Homo Sapiens
SVPDVTHHL

SEQ ID NO: 136378 - protein, 9 aa, Homo Sapiens
SVPFAATAT

SEQ ID NO: 136379 - protein, 9 aa, Homo Sapiens
SVPIQANAL

SEQ ID NO: 136380 - protein, 9 aa, Homo Sapiens
SVPLSALEL

SEQ ID NO: 136381 - protein, 9 aa, Homo Sapiens
SVPNKALEL

SEQ ID NO: 136382 - protein, 9 aa, Homo Sapiens
SVPNVHGAL

SEQ ID NO: 136383 - protein, 9 aa, Homo Sapiens
SVPPYGVAL

SEQ ID NO: 136384 - protein, 9 aa, Homo Sapiens
SVPQALTGL

SEQ ID NO: 136385 - protein, 9 aa, Homo Sapiens
SVPSAKVSL

SEQ ID NO: 136386 - protein, 9 aa, Homo Sapiens
SVPSAVSSL

SEQ ID NO: 136387 - protein, 9 aa, Homo Sapiens
SVPTDYSYL

SEQ ID NO: 136388 - protein, 9 aa, Homo Sapiens
SVPTLRSEL

SEQ ID NO: 136389 - protein, 9 aa, Homo Sapiens
SVPVAFSHF

SEQ ID NO: 136390 - protein, 9 aa, Homo Sapiens
SVPVATVEL

SEQ ID NO: 136391 - protein, 9 aa, Homo Sapiens
SVPVPATEL

SEQ ID NO: 136392 - protein, 9 aa, Homo Sapiens
SVPVSLQTL

SEQ ID NO: 136393 - protein, 9 aa, Homo Sapiens
SVPVTKTNL

SEQ ID NO: 136394 - protein, 9 aa, Homo Sapiens
SVPYHQAAL

SEQ ID NO: 136395 - protein, 9 aa, Homo Sapiens
SVPYPTASL

SEQ ID NO: 136396 - protein, 9 aa, Homo Sapiens
SVQRADTSL

SEQ ID NO: 136397 - protein, 9 aa, Homo Sapiens
SVQSGNLAL

SEQ ID NO: 136398 - protein, 9 aa, Homo Sapiens
SVQSSERPL

SEQ ID NO: 136399 - protein, 9 aa, Homo Sapiens
SVSGKVSCL

SEQ ID NO: 136400 - protein, 9 aa, Homo Sapiens
TAPATEQTL

SEQ ID NO: 136401 - protein, 9 aa, Homo Sapiens
TAPGFTAEM

SEQ ID NO: 136402 - protein, 9 aa, Homo Sapiens
TAPIPGATL

SEQ ID NO: 136403 - protein, 9 aa, Homo Sapiens
TAPIRSPAL

SEQ ID NO: 136404 - protein, 9 aa, Homo Sapiens
TAPLAICSL

SEQ ID NO: 136405 - protein, 9 aa, Homo Sapiens
TAPLSDAVL

SEQ ID NO: 136406 - protein, 9 aa, Homo Sapiens
TAPLTLESL

SEQ ID NO: 136407 - protein, 9 aa, Homo Sapiens
TAPNTFKTL

SEQ ID NO: 136408 - protein, 9 aa, Homo Sapiens
TAPQAEHAM

SEQ ID NO: 136409 - protein, 9 aa, Homo Sapiens
TAPQGNVDL

SEQ ID NO: 136410 - protein, 9 aa, Homo Sapiens
TAPQPGSAV

SEQ ID NO: 136411 - protein, 9 aa, Homo Sapiens
TAPSALHTL

SEQ ID NO: 136412 - protein, 9 aa, Homo Sapiens
TAPSMASVL

SEQ ID NO: 136413 - protein, 9 aa, Homo Sapiens
TAPVPTTEI

SEQ ID NO: 136414 - protein, 9 aa, Homo Sapiens
TAPVSEVSI

SEQ ID NO: 136415 - protein, 9 aa, Homo Sapiens
TAPYSLETL

SEQ ID NO: 136416 - protein, 9 aa, Homo Sapiens
TFKESIVSL

SEQ ID NO: 136417 - protein, 9 aa, Homo Sapiens
TFNEDVQAL

SEQ ID NO: 136418 - protein, 9 aa, Homo Sapiens
TFVPAMTAI

SEQ ID NO: 136419 - protein, 9 aa, Homo Sapiens
TGPDVVKSV

SEQ ID NO: 136420 - protein, 9 aa, Homo Sapiens
TGPITGLAL

SEQ ID NO: 136421 - protein, 9 aa, Homo Sapiens
TGPPAMKSL

SEQ ID NO: 136422 - protein, 9 aa, Homo Sapiens
TIFGKAHSL

SEQ ID NO: 136423 - protein, 9 aa, Homo Sapiens
TIIDKSKSV

SEQ ID NO: 136424 - protein, 9 aa, Homo Sapiens
TIIEATHVL

SEQ ID NO: 136425 - protein, 9 aa, Homo Sapiens
TIIPKVLAM

SEQ ID NO: 136426 - protein, 9 aa, Homo Sapiens
TILDKAMVL

SEQ ID NO: 136427 - protein, 9 aa, Homo Sapiens
TILDNRKEL

SEQ ID NO: 136428 - protein, 9 aa, Homo Sapiens
TINGHNAEV

SEQ ID NO: 136429 - protein, 9 aa, Homo Sapiens
TIPDWLQAI

SEQ ID NO: 136430 - protein, 9 aa, Homo Sapiens
TIPGGTPSL

SEQ ID NO: 136431 - protein, 9 aa, Homo Sapiens
TIPSQILEV

SEQ ID NO: 136432 - protein, 9 aa, Homo Sapiens
TIPVVHASI

SEQ ID NO: 136433 - protein, 9 aa, Homo Sapiens
TIQGAANAL

SEQ ID NO: 136434 - protein, 9 aa, Homo Sapiens
TLHEQASAL

SEQ ID NO: 136435 - protein, 9 aa, Homo Sapiens
TLPDWKRSL

SEQ ID NO: 136436 - protein, 9 aa, Homo Sapiens
TLPGPGASL

SEQ ID NO: 136437 - protein, 9 aa, Homo Sapiens
TLPHEILEM

SEQ ID NO: 136438 - protein, 9 aa, Homo Sapiens
TLPTVIAEL

SEQ ID NO: 136439 - protein, 9 aa, Homo Sapiens
TMPPVGTDL

SEQ ID NO: 136440 - protein, 9 aa, Homo Sapiens
TMPSDVLEV

SEQ ID NO: 136441 - protein, 9 aa, Homo Sapiens
TMPTDVLEV

SEQ ID NO: 136442 - protein, 9 aa, Homo Sapiens
TMSGVTTCL

SEQ ID NO: 136443 - protein, 9 aa, Homo Sapiens
TSAPKGSVL

SEQ ID NO: 136444 - protein, 9 aa, Homo Sapiens
TSPAVGSIL

SEQ ID NO: 136445 - protein, 9 aa, Homo Sapiens
TSPEAFLAL

SEQ ID NO: 136446 - protein, 9 aa, Homo Sapiens
TSPEIVTAL

SEQ ID NO: 136447 - protein, 9 aa, Homo Sapiens
TSPENNASL

SEQ ID NO: 136448 - protein, 9 aa, Homo Sapiens
TSPQFQQAL

SEQ ID NO: 136449 - protein, 9 aa, Homo Sapiens
TSPVINTSL

SEQ ID NO: 136450 - protein, 9 aa, Homo Sapiens
TSPVINVPL

SEQ ID NO: 136451 - protein, 9 aa, Homo Sapiens
TSPVPGRTL

SEQ ID NO: 136452 - protein, 9 aa, Homo Sapiens
TSPVTARTL

SEQ ID NO: 136453 - protein, 9 aa, Homo Sapiens
TTPIQTAAL

SEQ ID NO: 136454 - protein, 9 aa, Homo Sapiens
TVMDKTRAL

SEQ ID NO: 136455 - protein, 9 aa, Homo Sapiens
TVPASFSSL

SEQ ID NO: 136456 - protein, 9 aa, Homo Sapiens
TVPATEQEL

SEQ ID NO: 136457 - protein, 9 aa, Homo Sapiens
TVPFTVESL

SEQ ID NO: 136458 - protein, 9 aa, Homo Sapiens
TVPKDLRHL

SEQ ID NO: 136459 - protein, 9 aa, Homo Sapiens
TVPLPASQL

SEQ ID NO: 136460 - protein, 9 aa, Homo Sapiens
TVYLRDIAL

SEQ ID NO: 136461 - protein, 9 aa, Homo Sapiens
TVYVSMIAL

SEQ ID NO: 136462 - protein, 9 aa, Homo Sapiens
TWDERFSAL

SEQ ID NO: 136463 - protein, 9 aa, Homo Sapiens
VANVSLLAL

SEQ ID NO: 136464 - protein, 9 aa, Homo Sapiens
VAPAAASSL

SEQ ID NO: 136465 - protein, 9 aa, Homo Sapiens
VAPAGPASL

SEQ ID NO: 136466 - protein, 9 aa, Homo Sapiens
VAPASVITI

SEQ ID NO: 136467 - protein, 9 aa, Homo Sapiens
VAPAYGVYL

SEQ ID NO: 136468 - protein, 9 aa, Homo Sapiens
VAPEEHPVL

SEQ ID NO: 136469 - protein, 9 aa, Homo Sapiens
VAPESFEYI

SEQ ID NO: 136470 - protein, 9 aa, Homo Sapiens
VAPFFKSYI

SEQ ID NO: 136471 - protein, 9 aa, Homo Sapiens
VAPGKRPAL

SEQ ID NO: 136472 - protein, 9 aa, Homo Sapiens
VAPGLVLGL

SEQ ID NO: 136473 - protein, 9 aa, Homo Sapiens
VAPGPVIGL

SEQ ID NO: 136474 - protein, 9 aa, Homo Sapiens
VAPGSVQCL

SEQ ID NO: 136475 - protein, 9 aa, Homo Sapiens
VAPGTGIDL

SEQ ID NO: 136476 - protein, 9 aa, Homo Sapiens
VAPKQLHSL

SEQ ID NO: 136477 - protein, 9 aa, Homo Sapiens
VAPLATVNI

SEQ ID NO: 136478 - protein, 9 aa, Homo Sapiens
VAPPGCSHL

SEQ ID NO: 136479 - protein, 9 aa, Homo Sapiens
VAPPGNISL

SEQ ID NO: 136480 - protein, 9 aa, Homo Sapiens
VAPPKAHEV

SEQ ID NO: 136481 - protein, 9 aa, Homo Sapiens
VAPPPPTHL

SEQ ID NO: 136482 - protein, 9 aa, Homo Sapiens
VAPPVSGDL

SEQ ID NO: 136483 - protein, 9 aa, Homo Sapiens
VAPRNSAEL

SEQ ID NO: 136484 - protein, 9 aa, Homo Sapiens
VAPSFGTLL

SEQ ID NO: 136485 - protein, 9 aa, Homo Sapiens
VAPSRAIYF

SEQ ID NO: 136486 - protein, 9 aa, Homo Sapiens
VAPSRIRTL

SEQ ID NO: 136487 - protein, 9 aa, Homo Sapiens
VAPTAGHSV

SEQ ID NO: 136488 - protein, 9 aa, Homo Sapiens
VAPTSGPAL

SEQ ID NO: 136489 - protein, 9 aa, Homo Sapiens
VAPTSTVAV

SEQ ID NO: 136490 - protein, 9 aa, Homo Sapiens
VAPVAPVAV

SEQ ID NO: 136491 - protein, 9 aa, Homo Sapiens
VAPVAQVAL

SEQ ID NO: 136492 - protein, 9 aa, Homo Sapiens
VAPVPCTTL

SEQ ID NO: 136493 - protein, 9 aa, Homo Sapiens
VAPVSAVHA

SEQ ID NO: 136494 - protein, 9 aa, Homo Sapiens
VAPVTGNDV

SEQ ID NO: 136495 - protein, 9 aa, Homo Sapiens
VAPWNSLSL

SEQ ID NO: 136496 - protein, 9 aa, Homo Sapiens
VAYVSSVAL

SEQ ID NO: 136497 - protein, 9 aa, Homo Sapiens
VFAEKITSL

SEQ ID NO: 136498 - protein, 9 aa, Homo Sapiens
VFCPVKEAL

SEQ ID NO: 136499 - protein, 9 aa, Homo Sapiens
VFIDGPLAL

SEQ ID NO: 136500 - protein, 9 aa, Homo Sapiens
VFIDKQTNL

SEQ ID NO: 136501 - protein, 9 aa, Homo Sapiens
VFLPRVTEL

SEQ ID NO: 136502 - protein, 9 aa, Homo Sapiens
VFQERINCL

SEQ ID NO: 136503 - protein, 9 aa, Homo Sapiens
VGPGFDAAL

SEQ ID NO: 136504 - protein, 9 aa, Homo Sapiens
VGPGPALML

SEQ ID NO: 136505 - protein, 9 aa, Homo Sapiens
VGPGPTAAA

SEQ ID NO: 136506 - protein, 9 aa, Homo Sapiens
VGPGPYRAT

SEQ ID NO: 136507 - protein, 9 aa, Homo Sapiens
VGPPAGSPF

SEQ ID NO: 136508 - protein, 9 aa, Homo Sapiens
VGPPPATSI

SEQ ID NO: 136509 - protein, 9 aa, Homo Sapiens
VGPSSDKAL

SEQ ID NO: 136510 - protein, 9 aa, Homo Sapiens
VGPVGNSDL

SEQ ID NO: 136511 - protein, 9 aa, Homo Sapiens
VIAPNPAQL

SEQ ID NO: 136512 - protein, 9 aa, Homo Sapiens
VIFATVREL

SEQ ID NO: 136513 - protein, 9 aa, Homo Sapiens
VIHATVTSV

SEQ ID NO: 136514 - protein, 9 aa, Homo Sapiens
VIIEKTYSL

SEQ ID NO: 136515 - protein, 9 aa, Homo Sapiens
VIKEQNREL

SEQ ID NO: 136516 - protein, 9 aa, Homo Sapiens
VINEMVREL

SEQ ID NO: 136517 - protein, 9 aa, Homo Sapiens
VINGHTLCL

SEQ ID NO: 136518 - protein, 9 aa, Homo Sapiens
VIPDEAKAL

SEQ ID NO: 136519 - protein, 9 aa, Homo Sapiens
VIPDTIKEV

SEQ ID NO: 136520 - protein, 9 aa, Homo Sapiens
VIPELAQEL

SEQ ID NO: 136521 - protein, 9 aa, Homo Sapiens
VIPHIHKSL

SEQ ID NO: 136522 - protein, 9 aa, Homo Sapiens
VIPIIGKCL

SEQ ID NO: 136523 - protein, 9 aa, Homo Sapiens
VIPKDYKTM

SEQ ID NO: 136524 - protein, 9 aa, Homo Sapiens
VIPQYHSSV

SEQ ID NO: 136525 - protein, 9 aa, Homo Sapiens
VIPRITIEM

SEQ ID NO: 136526 - protein, 9 aa, Homo Sapiens
VIPSTPLAI

SEQ ID NO: 136527 - protein, 9 aa, Homo Sapiens
VIPTNVPEL

SEQ ID NO: 136528 - protein, 9 aa, Homo Sapiens
VIPYANHEL

SEQ ID NO: 136529 - protein, 9 aa, Homo Sapiens
VIQDFINAL

SEQ ID NO: 136530 - protein, 9 aa, Homo Sapiens
VISGGASDL

SEQ ID NO: 136531 - protein, 9 aa, Homo Sapiens
VLGSGFGEL

SEQ ID NO: 136532 - protein, 9 aa, Homo Sapiens
VLLPAASEL

SEQ ID NO: 136533 - protein, 9 aa, Homo Sapiens
VLPAFTSNL

SEQ ID NO: 136534 - protein, 9 aa, Homo Sapiens
VLPEVESSL

SEQ ID NO: 136535 - protein, 9 aa, Homo Sapiens
VLPNIQAVL

SEQ ID NO: 136536 - protein, 9 aa, Homo Sapiens
VLPNTALHL

SEQ ID NO: 136537 - protein, 9 aa, Homo Sapiens
VLPQRIREL

SEQ ID NO: 136538 - protein, 9 aa, Homo Sapiens
VLPSYEEAL

SEQ ID NO: 136539 - protein, 9 aa, Homo Sapiens
VLPVYMNCL

SEQ ID NO: 136540 - protein, 9 aa, Homo Sapiens
VMPGHSESL

SEQ ID NO: 136541 - protein, 9 aa, Homo Sapiens
VMPSRLKAL

SEQ ID NO: 136542 - protein, 9 aa, Homo Sapiens
VMPYIKTSL

SEQ ID NO: 136543 - protein, 9 aa, Homo Sapiens
VSCQKQPAL

SEQ ID NO: 136544 - protein, 9 aa, Homo Sapiens
VSPATSQSI

SEQ ID NO: 136545 - protein, 9 aa, Homo Sapiens
VSPDAKTSL

SEQ ID NO: 136546 - protein, 9 aa, Homo Sapiens
VSPFAFEAM

SEQ ID NO: 136547 - protein, 9 aa, Homo Sapiens
VSPGPLHCL

SEQ ID NO: 136548 - protein, 9 aa, Homo Sapiens
VSPGPRPVL

SEQ ID NO: 136549 - protein, 9 aa, Homo Sapiens
VSPGQASPL

SEQ ID NO: 136550 - protein, 9 aa, Homo Sapiens
VSPLATSAL

SEQ ID NO: 136551 - protein, 9 aa, Homo Sapiens
VSPLNVTSV

SEQ ID NO: 136552 - protein, 9 aa, Homo Sapiens
VSPNRLVAM

SEQ ID NO: 136553 - protein, 9 aa, Homo Sapiens
VSPPIRPSL

SEQ ID NO: 136554 - protein, 9 aa, Homo Sapiens
VSPPPGAVL

SEQ ID NO: 136555 - protein, 9 aa, Homo Sapiens
VSPQSRASL

SEQ ID NO: 136556 - protein, 9 aa, Homo Sapiens
VSPRQTLEL

SEQ ID NO: 136557 - protein, 9 aa, Homo Sapiens
VSPSFSAEL

SEQ ID NO: 136558 - protein, 9 aa, Homo Sapiens
VSPTKKVAV

SEQ ID NO: 136559 - protein, 9 aa, Homo Sapiens
VSPTVNQRL

SEQ ID NO: 136560 - protein, 9 aa, Homo Sapiens
VSPYSGAVF

SEQ ID NO: 136561 - protein, 9 aa, Homo Sapiens
VSQEVTRSL

SEQ ID NO: 136562 - protein, 9 aa, Homo Sapiens
VTAVSGKAL

SEQ ID NO: 136563 - protein, 9 aa, Homo Sapiens
VTPGSKAAL

SEQ ID NO: 136564 - protein, 9 aa, Homo Sapiens
VTPNCRVAL

SEQ ID NO: 136565 - protein, 9 aa, Homo Sapiens
VTPNTGMSL

SEQ ID NO: 136566 - protein, 9 aa, Homo Sapiens
VTPQAGTAL

SEQ ID NO: 136567 - protein, 9 aa, Homo Sapiens
VTPSAMAEL

SEQ ID NO: 136568 - protein, 9 aa, Homo Sapiens
VTPSKYSSL

SEQ ID NO: 136569 - protein, 9 aa, Homo Sapiens
VTPVTGASL

SEQ ID NO: 136570 - protein, 9 aa, Homo Sapiens
VVIGNIGAL

SEQ ID NO: 136571 - protein, 9 aa, Homo Sapiens
VVKPPGSSL

SEQ ID NO: 136572 - protein, 9 aa, Homo Sapiens
VVNGRVLEL

SEQ ID NO: 136573 - protein, 9 aa, Homo Sapiens
VVPARSEAL

SEQ ID NO: 136574 - protein, 9 aa, Homo Sapiens
VVPDSAHKL

SEQ ID NO: 136575 - protein, 9 aa, Homo Sapiens
VVPSCVASL

SEQ ID NO: 136576 - protein, 9 aa, Homo Sapiens
VVQDVASAL

SEQ ID NO: 136577 - protein, 9 aa, Homo Sapiens
VVQGDPREL

SEQ ID NO: 136578 - protein, 9 aa, Homo Sapiens
YAPARLAAA

SEQ ID NO: 136579 - protein, 9 aa, Homo Sapiens
YAPHYDSTF

SEQ ID NO: 136580 - protein, 9 aa, Homo Sapiens
YAPINANAI

SEQ ID NO: 136581 - protein, 9 aa, Homo Sapiens
YAPMGMHPM

SEQ ID NO: 136582 - protein, 9 aa, Homo Sapiens
YAPPPFLHI

SEQ ID NO: 136583 - protein, 9 aa, Homo Sapiens
YAPQGWIAF

SEQ ID NO: 136584 - protein, 9 aa, Homo Sapiens
YAPVHADDL

SEQ ID NO: 136585 - protein, 9 aa, Homo Sapiens
YAPYPSPVL

SEQ ID NO: 136586 - protein, 9 aa, Homo Sapiens
YFEGGVSSV

SEQ ID NO: 136587 - protein, 9 aa, Homo Sapiens
YIPEAILNL

SEQ ID NO: 136588 - protein, 9 aa, Homo Sapiens
YIPGKNRDL

SEQ ID NO: 136589 - protein, 9 aa, Homo Sapiens
YIPHGYMEL

SEQ ID NO: 136590 - protein, 9 aa, Homo Sapiens
YLGNFRSAL

SEQ ID NO: 136591 - protein, 9 aa, Homo Sapiens
YLNVQVKEL

SEQ ID NO: 136592 - protein, 9 aa, Homo Sapiens
YLPAGQSVL

SEQ ID NO: 136593 - protein, 9 aa, Homo Sapiens
YLPDAVKGL

SEQ ID NO: 136594 - protein, 9 aa, Homo Sapiens
YLPPGFLSA

SEQ ID NO: 136595 - protein, 9 aa, Homo Sapiens
YLPPGVIAL

SEQ ID NO: 136596 - protein, 9 aa, Homo Sapiens
YLPSAILQL

SEQ ID NO: 136597 - protein, 9 aa, Homo Sapiens
YLPSFFTKL

SEQ ID NO: 136598 - protein, 9 aa, Homo Sapiens
YLPVGSHNL

SEQ ID NO: 136599 - protein, 9 aa, Homo Sapiens
YMGIRDTEL

SEQ ID NO: 136600 - protein, 9 aa, Homo Sapiens
YMIAHITGL

SEQ ID NO: 136601 - protein, 9 aa, Homo Sapiens
YMPMNANDL

SEQ ID NO: 136602 - protein, 9 aa, Homo Sapiens
YMPPPYASL

SEQ ID NO: 136603 - protein, 9 aa, Homo Sapiens
YMSPHPSPL

SEQ ID NO: 136604 - protein, 9 aa, Homo Sapiens
YSPAGNLEL

SEQ ID NO: 136605 - protein, 9 aa, Homo Sapiens
YSPEACRSM

SEQ ID NO: 136606 - protein, 9 aa, Homo Sapiens
YSPERQRSL

SEQ ID NO: 136607 - protein, 9 aa, Homo Sapiens
YSPFGDSPL

SEQ ID NO: 136608 - protein, 9 aa, Homo Sapiens
YSPGMTMSV

SEQ ID NO: 136609 - protein, 9 aa, Homo Sapiens
YSPIRLLEV

SEQ ID NO: 136610 - protein, 9 aa, Homo Sapiens
YSPQRERPL

SEQ ID NO: 136611 - protein, 9 aa, Homo Sapiens
YSPVSRIGL

SEQ ID NO: 136612 - protein, 9 aa, Homo Sapiens
YTAFSERPL

SEQ ID NO: 136613 - protein, 9 aa, Homo Sapiens
YTPEERRAL

SEQ ID NO: 136614 - protein, 9 aa, Homo Sapiens
YTPYGWLQL

SEQ ID NO: 136615 - protein, 9 aa, Homo Sapiens
YVPFAERSL

SEQ ID NO: 136616 - protein, 9 aa, Homo Sapiens
YVPNAGRGL

SEQ ID NO: 136617 - protein, 9 aa, Homo Sapiens
YVPTSYVEV

SEQ ID NO: 136618 - protein, 10 aa, Homo Sapiens
AAAAAATPGL

SEQ ID NO: 136619 - protein, 10 aa, Homo Sapiens
AAPAAAGAAL

SEQ ID NO: 136620 - protein, 10 aa, Homo Sapiens
AAPGPGRKEL

SEQ ID NO: 136621 - protein, 10 aa, Homo Sapiens
AAPGSARRPL

SEQ ID NO: 136622 - protein, 10 aa, Homo Sapiens
AAPYGGPIAL

SEQ ID NO: 136623 - protein, 10 aa, Homo Sapiens
AGHDNRVSCL

SEQ ID NO: 136624 - protein, 10 aa, Homo Sapiens
AGPDSAGIAL

SEQ ID NO: 136625 - protein, 10 aa, Homo Sapiens
AIHLIDPNTL

SEQ ID NO: 136626 - protein, 10 aa, Homo Sapiens
ALAEIAKAEL

SEQ ID NO: 136627 - protein, 10 aa, Homo Sapiens
ALDASQHSSL

SEQ ID NO: 136628 - protein, 10 aa, Homo Sapiens
ALHATSQQPL

SEQ ID NO: 136629 - protein, 10 aa, Homo Sapiens
ALHERELDSL

SEQ ID NO: 136630 - protein, 10 aa, Homo Sapiens
ALHLQPLRSA

SEQ ID NO: 136631 - protein, 10 aa, Homo Sapiens
ALHNCPAISL

SEQ ID NO: 136632 - protein, 10 aa, Homo Sapiens
ALHQHTISTL

SEQ ID NO: 136633 - protein, 10 aa, Homo Sapiens
ALHQKQLLTL

SEQ ID NO: 136634 - protein, 10 aa, Homo Sapiens
ALNPAALTAL

SEQ ID NO: 136635 - protein, 10 aa, Homo Sapiens
ALNTSKYLEL

SEQ ID NO: 136636 - protein, 10 aa, Homo Sapiens
ALPAAPASSL

SEQ ID NO: 136637 - protein, 10 aa, Homo Sapiens
ALPDIKVLTL

SEQ ID NO: 136638 - protein, 10 aa, Homo Sapiens
ALPEDDFLSL

SEQ ID NO: 136639 - protein, 10 aa, Homo Sapiens
ALPPGSYASL

SEQ ID NO: 136640 - protein, 10 aa, Homo Sapiens
ALPSGQLTSL

SEQ ID NO: 136641 - protein, 10 aa, Homo Sapiens
ALPSSSYTDL

SEQ ID NO: 136642 - protein, 10 aa, Homo Sapiens
ALSQSNPSAL

SEQ ID NO: 136643 - protein, 10 aa, Homo Sapiens
ALYDICFRTL

SEQ ID NO: 136644 - protein, 10 aa, Homo Sapiens
ASPAGEWRAL

SEQ ID NO: 136645 - protein, 10 aa, Homo Sapiens
ASPAKGEPSL

SEQ ID NO: 136646 - protein, 10 aa, Homo Sapiens
ASPASLARTL

SEQ ID NO: 136647 - protein, 10 aa, Homo Sapiens
ATPAGDIMEL

SEQ ID NO: 136648 - protein, 10 aa, Homo Sapiens
CGPSGLVREL

SEQ ID NO: 136649 - protein, 10 aa, Homo Sapiens
CITPTGTHPL

SEQ ID NO: 136650 - protein, 10 aa, Homo Sapiens
CSPASRSISL

SEQ ID NO: 136651 - protein, 10 aa, Homo Sapiens
CVPETKGRSL

SEQ ID NO: 136652 - protein, 10 aa, Homo Sapiens
ELHDHGVSSL

SEQ ID NO: 136653 - protein, 10 aa, Homo Sapiens
FGPDSKSSAL

SEQ ID NO: 136654 - protein, 10 aa, Homo Sapiens
FICDYELHEL

SEQ ID NO: 136655 - protein, 10 aa, Homo Sapiens
FIPDVKGAVL

SEQ ID NO: 136656 - protein, 10 aa, Homo Sapiens
FIPEHTNLSL

SEQ ID NO: 136657 - protein, 10 aa, Homo Sapiens
FIPESWLNSL

SEQ ID NO: 136658 - protein, 10 aa, Homo Sapiens
FITEEDYQAL

SEQ ID NO: 136659 - protein, 10 aa, Homo Sapiens
FLPAGIVAVL

SEQ ID NO: 136660 - protein, 10 aa, Homo Sapiens
FLPARFYQAL

SEQ ID NO: 136661 - protein, 10 aa, Homo Sapiens
FLPEEAWCDL

SEQ ID NO: 136662 - protein, 10 aa, Homo Sapiens
FLPEGGCYEL

SEQ ID NO: 136663 - protein, 10 aa, Homo Sapiens
FLPRQPPMSL

SEQ ID NO: 136664 - protein, 10 aa, Homo Sapiens
FLRQVGVTEM

SEQ ID NO: 136665 - protein, 10 aa, Homo Sapiens
FLSEHPNVTL

SEQ ID NO: 136666 - protein, 10 aa, Homo Sapiens
FVDPNGKISL

SEQ ID NO: 136667 - protein, 10 aa, Homo Sapiens
GLPSQKTASL

SEQ ID NO: 136668 - protein, 10 aa, Homo Sapiens
GLSENPFASL

SEQ ID NO: 136669 - protein, 10 aa, Homo Sapiens
GNCPERIITL

SEQ ID NO: 136670 - protein, 10 aa, Homo Sapiens
GPGPGPTTPL

SEQ ID NO: 136671 - protein, 10 aa, Homo Sapiens
GSVPEAQSAL

SEQ ID NO: 136672 - protein, 10 aa, Homo Sapiens
HIPDQETTSL

SEQ ID NO: 136673 - protein, 10 aa, Homo Sapiens
HISNSHPLSL

SEQ ID NO: 136674 - protein, 10 aa, Homo Sapiens
HLGSKGTSSL

SEQ ID NO: 136675 - protein, 10 aa, Homo Sapiens
HLHESCVLSL

SEQ ID NO: 136676 - protein, 10 aa, Homo Sapiens
HLHNMPPSAL

SEQ ID NO: 136677 - protein, 10 aa, Homo Sapiens
HLHTQALTAL

SEQ ID NO: 136678 - protein, 10 aa, Homo Sapiens
HLIDLPTCEL

SEQ ID NO: 136679 - protein, 10 aa, Homo Sapiens
HLPESQSSSV

SEQ ID NO: 136680 - protein, 10 aa, Homo Sapiens
HLPNDFPTCL

SEQ ID NO: 136681 - protein, 10 aa, Homo Sapiens
HLPTKEASSL

SEQ ID NO: 136682 - protein, 10 aa, Homo Sapiens
HLSDTGISAL

SEQ ID NO: 136683 - protein, 10 aa, Homo Sapiens
HLSSSQLQSL

SEQ ID NO: 136684 - protein, 10 aa, Homo Sapiens
IAPDFPAQVL

SEQ ID NO: 136685 - protein, 10 aa, Homo Sapiens
IINDPRYSAL

SEQ ID NO: 136686 - protein, 10 aa, Homo Sapiens
ILAEFKVRAL

SEQ ID NO: 136687 - protein, 10 aa, Homo Sapiens
ILARDGPNAL

SEQ ID NO: 136688 - protein, 10 aa, Homo Sapiens
ILPEQGVSAL

SEQ ID NO: 136689 - protein, 10 aa, Homo Sapiens
ILPKKPCKNL

SEQ ID NO: 136690 - protein, 10 aa, Homo Sapiens
ILSDRPCLEL

SEQ ID NO: 136691 - protein, 10 aa, Homo Sapiens
ILTDESLSSL

SEQ ID NO: 136692 - protein, 10 aa, Homo Sapiens
ISPASTPSCL

SEQ ID NO: 136693 - protein, 10 aa, Homo Sapiens
KFHTEALTAL

SEQ ID NO: 136694 - protein, 10 aa, Homo Sapiens
KIIDRAITSL

SEQ ID NO: 136695 - protein, 10 aa, Homo Sapiens
KISERTPSAL

SEQ ID NO: 136696 - protein, 10 aa, Homo Sapiens
KLFEHYYQEL

SEQ ID NO: 136697 - protein, 10 aa, Homo Sapiens
KLFSEKRVEL

SEQ ID NO: 136698 - protein, 10 aa, Homo Sapiens
KLGEKERSEL

SEQ ID NO: 136699 - protein, 10 aa, Homo Sapiens
KLHEEEIQEL

SEQ ID NO: 136700 - protein, 10 aa, Homo Sapiens
KLHGVKLEAL

SEQ ID NO: 136701 - protein, 10 aa, Homo Sapiens
KLPALPTQAL

SEQ ID NO: 136702 - protein, 10 aa, Homo Sapiens
KLPDYSSIEI

SEQ ID NO: 136703 - protein, 10 aa, Homo Sapiens
KLPEYNPRTL

SEQ ID NO: 136704 - protein, 10 aa, Homo Sapiens
KLPNYDAREI

SEQ ID NO: 136705 - protein, 10 aa, Homo Sapiens
KLPSHATHSL

SEQ ID NO: 136706 - protein, 10 aa, Homo Sapiens
KLSCQPMLSL

SEQ ID NO: 136707 - protein, 10 aa, Homo Sapiens
KLSDSVFRCL

SEQ ID NO: 136708 - protein, 10 aa, Homo Sapiens
KLSNHVFNAL

SEQ ID NO: 136709 - protein, 10 aa, Homo Sapiens
KTPEEAYRAL

SEQ ID NO: 136710 - protein, 10 aa, Homo Sapiens
KWDSHFRESV

SEQ ID NO: 136711 - protein, 10 aa, Homo Sapiens
LAPDYDALDV

SEQ ID NO: 136712 - protein, 10 aa, Homo Sapiens
LLHMESPTCL

SEQ ID NO: 136713 - protein, 10 aa, Homo Sapiens
LLPDQPPYHL

SEQ ID NO: 136714 - protein, 10 aa, Homo Sapiens
LLPEEPVSQL

SEQ ID NO: 136715 - protein, 10 aa, Homo Sapiens
LLPSSGFMEL

SEQ ID NO: 136716 - protein, 10 aa, Homo Sapiens
LLPTHAFSTL

SEQ ID NO: 136717 - protein, 10 aa, Homo Sapiens
LLSPTPATAL

SEQ ID NO: 136718 - protein, 10 aa, Homo Sapiens
LSGPQRSALL

SEQ ID NO: 136719 - protein, 10 aa, Homo Sapiens
LSPDSRASSL

SEQ ID NO: 136720 - protein, 10 aa, Homo Sapiens
LSPSSLFSAL

SEQ ID NO: 136721 - protein, 10 aa, Homo Sapiens
MAPAYLPRSL

SEQ ID NO: 136722 - protein, 10 aa, Homo Sapiens
MLPAEGVKEL

SEQ ID NO: 136723 - protein, 10 aa, Homo Sapiens
MMPPMGGPPM

SEQ ID NO: 136724 - protein, 10 aa, Homo Sapiens
MVPPVQVSPL

SEQ ID NO: 136725 - protein, 10 aa, Homo Sapiens
NFPEHIFPAL

SEQ ID NO: 136726 - protein, 10 aa, Homo Sapiens
NLPKQPPLAL

SEQ ID NO: 136727 - protein, 10 aa, Homo Sapiens
NLPQYVSNEL

SEQ ID NO: 136728 - protein, 10 aa, Homo Sapiens
PLPDRSLPAL

SEQ ID NO: 136729 - protein, 10 aa, Homo Sapiens
PSSLPVGPVL

SEQ ID NO: 136730 - protein, 10 aa, Homo Sapiens
QLHRQGLLSL

SEQ ID NO: 136731 - protein, 10 aa, Homo Sapiens
QLPAPKWTEL

SEQ ID NO: 136732 - protein, 10 aa, Homo Sapiens
QLPDYYDTPL

SEQ ID NO: 136733 - protein, 10 aa, Homo Sapiens
QLPQLPLAAL

SEQ ID NO: 136734 - protein, 10 aa, Homo Sapiens
QSPAPTHNSL

SEQ ID NO: 136735 - protein, 10 aa, Homo Sapiens
QSPEGRYSAL

SEQ ID NO: 136736 - protein, 10 aa, Homo Sapiens
RGPSFKASSL

SEQ ID NO: 136737 - protein, 10 aa, Homo Sapiens
RIHESSPLDL

SEQ ID NO: 136738 - protein, 10 aa, Homo Sapiens
RINEILSNAL

SEQ ID NO: 136739 - protein, 10 aa, Homo Sapiens
RIPNFKGSYL

SEQ ID NO: 136740 - protein, 10 aa, Homo Sapiens
RLANKDRPAL

SEQ ID NO: 136741 - protein, 10 aa, Homo Sapiens
RLNDAALRAL

SEQ ID NO: 136742 - protein, 10 aa, Homo Sapiens
RLPARGFREV

SEQ ID NO: 136743 - protein, 10 aa, Homo Sapiens
RLPDTALPTL

SEQ ID NO: 136744 - protein, 10 aa, Homo Sapiens
RLPGAAARCL

SEQ ID NO: 136745 - protein, 10 aa, Homo Sapiens
RLPLRYPRAL

SEQ ID NO: 136746 - protein, 10 aa, Homo Sapiens
RLPQGIVREL

SEQ ID NO: 136747 - protein, 10 aa, Homo Sapiens
RLPSDPFTHL

SEQ ID NO: 136748 - protein, 10 aa, Homo Sapiens
RLPSKPYSTL

SEQ ID NO: 136749 - protein, 10 aa, Homo Sapiens
RLPVGGFRSL

SEQ ID NO: 136750 - protein, 10 aa, Homo Sapiens
RLSERQARAL

SEQ ID NO: 136751 - protein, 10 aa, Homo Sapiens
RLSQVPMSAL

SEQ ID NO: 136752 - protein, 10 aa, Homo Sapiens
RTPAGNFVTL

SEQ ID NO: 136753 - protein, 10 aa, Homo Sapiens
RVAEHHVATL

SEQ ID NO: 136754 - protein, 10 aa, Homo Sapiens
SAPGGGPGTL

SEQ ID NO: 136755 - protein, 10 aa, Homo Sapiens
SAPGPGYAPL

SEQ ID NO: 136756 - protein, 10 aa, Homo Sapiens
SAPGPSGQSV

SEQ ID NO: 136757 - protein, 10 aa, Homo Sapiens
SAPGYLPTSL

SEQ ID NO: 136758 - protein, 10 aa, Homo Sapiens
SAPSYLARSL

SEQ ID NO: 136759 - protein, 10 aa, Homo Sapiens
SAPSYPMASL

SEQ ID NO: 136760 - protein, 10 aa, Homo Sapiens
SFHTTPNTSL

SEQ ID NO: 136761 - protein, 10 aa, Homo Sapiens
SGPAGPILSL

SEQ ID NO: 136762 - protein, 10 aa, Homo Sapiens
SGPGGVVACL

SEQ ID NO: 136763 - protein, 10 aa, Homo Sapiens
SLAPTDVKEL

SEQ ID NO: 136764 - protein, 10 aa, Homo Sapiens
SLDDRVLSSL

SEQ ID NO: 136765 - protein, 10 aa, Homo Sapiens
SLDPSNRKPL

SEQ ID NO: 136766 - protein, 10 aa, Homo Sapiens
SLHSQPPQHL

SEQ ID NO: 136767 - protein, 10 aa, Homo Sapiens
SLNEKKLLEL

SEQ ID NO: 136768 - protein, 10 aa, Homo Sapiens
SLPALPLAEL

SEQ ID NO: 136769 - protein, 10 aa, Homo Sapiens
SLPATATMSL

SEQ ID NO: 136770 - protein, 10 aa, Homo Sapiens
SLPEDHFSEL

SEQ ID NO: 136771 - protein, 10 aa, Homo Sapiens
SLPEKKGNTL

SEQ ID NO: 136772 - protein, 10 aa, Homo Sapiens
SLPGSPTHSL

SEQ ID NO: 136773 - protein, 10 aa, Homo Sapiens
SLPKEAFLVL

SEQ ID NO: 136774 - protein, 10 aa, Homo Sapiens
SLPNDVISSL

SEQ ID NO: 136775 - protein, 10 aa, Homo Sapiens
SLPSRKLVAL

SEQ ID NO: 136776 - protein, 10 aa, Homo Sapiens
SLPSSGRSSL

SEQ ID NO: 136777 - protein, 10 aa, Homo Sapiens
SLPTVGPSGL

SEQ ID NO: 136778 - protein, 10 aa, Homo Sapiens
SLPVHVFEAL

SEQ ID NO: 136779 - protein, 10 aa, Homo Sapiens
SLPYEPYKAL

SEQ ID NO: 136780 - protein, 10 aa, Homo Sapiens
SLSSADLSSL

SEQ ID NO: 136781 - protein, 10 aa, Homo Sapiens
SLTEADFREL

SEQ ID NO: 136782 - protein, 10 aa, Homo Sapiens
SPLPIVRSNL

SEQ ID NO: 136783 - protein, 10 aa, Homo Sapiens
SSPKLPVSSL

SEQ ID NO: 136784 - protein, 10 aa, Homo Sapiens
SSPLGSGEGL

SEQ ID NO: 136785 - protein, 10 aa, Homo Sapiens
STPEEKLAAL

SEQ ID NO: 136786 - protein, 10 aa, Homo Sapiens
STPGGSHPAL

SEQ ID NO: 136787 - protein, 10 aa, Homo Sapiens
SVPDGFLSEL

SEQ ID NO: 136788 - protein, 10 aa, Homo Sapiens
SVPENKGISL

SEQ ID NO: 136789 - protein, 10 aa, Homo Sapiens
TGHTGDVMSL

SEQ ID NO: 136790 - protein, 10 aa, Homo Sapiens
TIASQRLTPL

SEQ ID NO: 136791 - protein, 10 aa, Homo Sapiens
TIPEIATSEL

SEQ ID NO: 136792 - protein, 10 aa, Homo Sapiens
TIPKSKFLAL

SEQ ID NO: 136793 - protein, 10 aa, Homo Sapiens
TISDRYYTAL

SEQ ID NO: 136794 - protein, 10 aa, Homo Sapiens
TLNASILNSL

SEQ ID NO: 136795 - protein, 10 aa, Homo Sapiens
TLNKNNLTEL

SEQ ID NO: 136796 - protein, 10 aa, Homo Sapiens
TLPEENYQVL

SEQ ID NO: 136797 - protein, 10 aa, Homo Sapiens
TLPEQHLQEL

SEQ ID NO: 136798 - protein, 10 aa, Homo Sapiens
TLPERPLTEV

SEQ ID NO: 136799 - protein, 10 aa, Homo Sapiens
TLPIAASSSL

SEQ ID NO: 136800 - protein, 10 aa, Homo Sapiens
TLPWGTLSSL

SEQ ID NO: 136801 - protein, 10 aa, Homo Sapiens
TLSDRQPAEL

SEQ ID NO: 136802 - protein, 10 aa, Homo Sapiens
TLSSTKNRAL

SEQ ID NO: 136803 - protein, 10 aa, Homo Sapiens
TSGPASSPVA

SEQ ID NO: 136804 - protein, 10 aa, Homo Sapiens
TSPAGLKAVL

SEQ ID NO: 136805 - protein, 10 aa, Homo Sapiens
TSPAGSSPAV

SEQ ID NO: 136806 - protein, 10 aa, Homo Sapiens
TSPGGSYGHL

SEQ ID NO: 136807 - protein, 10 aa, Homo Sapiens
VAPEKQATEL

SEQ ID NO: 136808 - protein, 10 aa, Homo Sapiens
VAPVGSGSAL

SEQ ID NO: 136809 - protein, 10 aa, Homo Sapiens
VGPGGEITEL

SEQ ID NO: 136810 - protein, 10 aa, Homo Sapiens
VGPPGTGKTL

SEQ ID NO: 136811 - protein, 10 aa, Homo Sapiens
VHPGGDTVAI

SEQ ID NO: 136812 - protein, 10 aa, Homo Sapiens
VIAEHANDSL

SEQ ID NO: 136813 - protein, 10 aa, Homo Sapiens
VIDEIGKMEL

SEQ ID NO: 136814 - protein, 10 aa, Homo Sapiens
VIPDGPTRAL

SEQ ID NO: 136815 - protein, 10 aa, Homo Sapiens
VIPDIPDHFL

SEQ ID NO: 136816 - protein, 10 aa, Homo Sapiens
VIQEHQPSVL

SEQ ID NO: 136817 - protein, 10 aa, Homo Sapiens
VIYDSNGVVL

SEQ ID NO: 136818 - protein, 10 aa, Homo Sapiens
VLPQTRYVEL

SEQ ID NO: 136819 - protein, 10 aa, Homo Sapiens
VLPSERYKEL

SEQ ID NO: 136820 - protein, 10 aa, Homo Sapiens
VLPTLPFHVL

SEQ ID NO: 136821 - protein, 10 aa, Homo Sapiens
VLSAADKGNV

SEQ ID NO: 136822 - protein, 10 aa, Homo Sapiens
VLSERDYESL

SEQ ID NO: 136823 - protein, 10 aa, Homo Sapiens
VLSSLPLNSL

SEQ ID NO: 136824 - protein, 10 aa, Homo Sapiens
VSAAGLVQGL

SEQ ID NO: 136825 - protein, 10 aa, Homo Sapiens
VSPAKNPSSL

SEQ ID NO: 136826 - protein, 10 aa, Homo Sapiens
VSPCGKFLAA

SEQ ID NO: 136827 - protein, 10 aa, Homo Sapiens
VVPNKGYSSL

SEQ ID NO: 136828 - protein, 10 aa, Homo Sapiens
YAPSGNYVAC

SEQ ID NO: 136829 - protein, 10 aa, Homo Sapiens
YGPPGTGKTL

SEQ ID NO: 136830 - protein, 10 aa, Homo Sapiens
YIIKQDINSL

SEQ ID NO: 136831 - protein, 10 aa, Homo Sapiens
YIPDGHTKEM

SEQ ID NO: 136832 - protein, 10 aa, Homo Sapiens
YIPDYSVRAL

SEQ ID NO: 136833 - protein, 10 aa, Homo Sapiens
YIPQRPYMSL

SEQ ID NO: 136834 - protein, 10 aa, Homo Sapiens
YITNLEVKEL

SEQ ID NO: 136835 - protein, 10 aa, Homo Sapiens
YLDEEFHQSL

SEQ ID NO: 136836 - protein, 10 aa, Homo Sapiens
YLNDDQVKEL

SEQ ID NO: 136837 - protein, 10 aa, Homo Sapiens
YLPENKPCYL

SEQ ID NO: 136838 - protein, 10 aa, Homo Sapiens
YLPEWKENIM

SEQ ID NO: 136839 - protein, 10 aa, Homo Sapiens
YLPLAHVLEL

SEQ ID NO: 136840 - protein, 10 aa, Homo Sapiens
YVPEPENSAL

SEQ ID NO: 136841 - protein, 10 aa, Homo Sapiens
YVPQRPYMTL

SEQ ID NO: 136842 - protein, 11 aa, Homo Sapiens
AAPRTVALTAL

SEQ ID NO: 136843 - protein, 11 aa, Homo Sapiens
ATIDPDTISAL

SEQ ID NO: 136844 - protein, 11 aa, Homo Sapiens
CSPGGATIHAL

SEQ ID NO: 136845 - protein, 11 aa, Homo Sapiens
EGNCPERIITL

SEQ ID NO: 136846 - protein, 11 aa, Homo Sapiens
FLPDPSALQNL

SEQ ID NO: 136847 - protein, 11 aa, Homo Sapiens
GLIDTKELEPL

SEQ ID NO: 136848 - protein, 11 aa, Homo Sapiens
IAPDVDTYKEI

SEQ ID NO: 136849 - protein, 11 aa, Homo Sapiens
IAPGGGAFTTL

SEQ ID NO: 136850 - protein, 11 aa, Homo Sapiens
ILHPNGNITEL

SEQ ID NO: 136851 - protein, 11 aa, Homo Sapiens
ISLAPTDVKEL

SEQ ID NO: 136852 - protein, 11 aa, Homo Sapiens
KAPSYLEISSM

SEQ ID NO: 136853 - protein, 11 aa, Homo Sapiens
KSPAGSIVHEL

SEQ ID NO: 136854 - protein, 11 aa, Homo Sapiens
LAPTYLGEFSL

SEQ ID NO: 136855 - protein, 11 aa, Homo Sapiens
LGPAGGDREAL

SEQ ID NO: 136856 - protein, 11 aa, Homo Sapiens
LGPGPGPTTPL

SEQ ID NO: 136857 - protein, 11 aa, Homo Sapiens
LLPPVFNIRSL

SEQ ID NO: 136858 - protein, 11 aa, Homo Sapiens
MAPSETQFSHL

SEQ ID NO: 136859 - protein, 11 aa, Homo Sapiens
QAPLALAHDGV

SEQ ID NO: 136860 - protein, 11 aa, Homo Sapiens
RAPEAELQNCL

SEQ ID NO: 136861 - protein, 11 aa, Homo Sapiens
RLHEYYQPTAL

SEQ ID NO: 136862 - protein, 11 aa, Homo Sapiens
RLPETEMWAEL

SEQ ID NO: 136863 - protein, 11 aa, Homo Sapiens
RLPETIDLGAL

SEQ ID NO: 136864 - protein, 11 aa, Homo Sapiens
RPSSLPVGPVL

SEQ ID NO: 136865 - protein, 11 aa, Homo Sapiens
RSPSSVTGNAL

SEQ ID NO: 136866 - protein, 11 aa, Homo Sapiens
SAPVSERMNAL

SEQ ID NO: 136867 - protein, 11 aa, Homo Sapiens
SIPEAQWHSSL

SEQ ID NO: 136868 - protein, 11 aa, Homo Sapiens
SPLPDRSLPAL

SEQ ID NO: 136869 - protein, 11 aa, Homo Sapiens
SSPAGGGAEAL

SEQ ID NO: 136870 - protein, 11 aa, Homo Sapiens
SSPAGNSPAPL

SEQ ID NO: 136871 - protein, 11 aa, Homo Sapiens
SSPDMNETHPL

SEQ ID NO: 136872 - protein, 11 aa, Homo Sapiens
SSPGGATIHAL

SEQ ID NO: 136873 - protein, 11 aa, Homo Sapiens
TAPQTQHVSPM

SEQ ID NO: 136874 - protein, 11 aa, Homo Sapiens
TLPESSKLSSL

SEQ ID NO: 136875 - protein, 11 aa, Homo Sapiens
VAPGQEKISSL

SEQ ID NO: 136876 - protein, 11 aa, Homo Sapiens
VLPDSGHLHPL

SEQ ID NO: 136877 - protein, 11 aa, Homo Sapiens
YAYDGKDYIAL

SEQ ID NO: 136878 - protein, 11 aa, Homo Sapiens
YLPAHIPYQEL

SEQ ID NO: 136879 - protein, 8 aa, Homo Sapiens
ANALAHRY

SEQ ID NO: 136880 - protein, 8 aa, Homo Sapiens
FAAKQREL

SEQ ID NO: 136881 - protein, 8 aa, Homo Sapiens
FAFSGGLY

SEQ ID NO: 136882 - protein, 8 aa, Homo Sapiens
FAGAAREV

SEQ ID NO: 136883 - protein, 8 aa, Homo Sapiens
FAGLVQEI

SEQ ID NO: 136884 - protein, 8 aa, Homo Sapiens
FAGYVTSI

SEQ ID NO: 136885 - protein, 8 aa, Homo Sapiens
FGADARAL

SEQ ID NO: 136886 - protein, 8 aa, Homo Sapiens
FSFVNPKF

SEQ ID NO: 136887 - protein, 8 aa, Homo Sapiens
FSMEQAGV

SEQ ID NO: 136888 - protein, 8 aa, Homo Sapiens
IAGPVVEI

SEQ ID NO: 136889 - protein, 8 aa, Homo Sapiens
QFTGIKKY

SEQ ID NO: 136890 - protein, 8 aa, Homo Sapiens
SAGEPRVL

SEQ ID NO: 136891 - protein, 8 aa, Homo Sapiens
SAGPMRLY

SEQ ID NO: 136892 - protein, 8 aa, Homo Sapiens
SIFRTNTF

SEQ ID NO: 136893 - protein, 8 aa, Homo Sapiens
SVGPDRKL

SEQ ID NO: 136894 - protein, 8 aa, Homo Sapiens
VAKVGVSM

SEQ ID NO: 136895 - protein, 8 aa, Homo Sapiens
YAANPHSF

SEQ ID NO: 136896 - protein, 9 aa, Homo Sapiens
AAAALPTLY

SEQ ID NO: 136897 - protein, 9 aa, Homo Sapiens
AAAALYQQL

SEQ ID NO: 136898 - protein, 9 aa, Homo Sapiens
AAADIFKHY

SEQ ID NO: 136899 - protein, 9 aa, Homo Sapiens
AAAGGLHEF

SEQ ID NO: 136900 - protein, 9 aa, Homo Sapiens
AAAGLHSNV

SEQ ID NO: 136901 - protein, 9 aa, Homo Sapiens
AAAGVFALL

SEQ ID NO: 136902 - protein, 9 aa, Homo Sapiens
AAAPAGTTF

SEQ ID NO: 136903 - protein, 9 aa, Homo Sapiens
AAAPHTVSY

SEQ ID NO: 136904 - protein, 9 aa, Homo Sapiens
AAAPIISSV

SEQ ID NO: 136905 - protein, 9 aa, Homo Sapiens
AAAPVIKAY

SEQ ID NO: 136906 - protein, 9 aa, Homo Sapiens
AAASKLGEF

SEQ ID NO: 136907 - protein, 9 aa, Homo Sapiens
AAATRTTSF

SEQ ID NO: 136908 - protein, 9 aa, Homo Sapiens
AAAVPRAAF

SEQ ID NO: 136909 - protein, 9 aa, Homo Sapiens
AACDLVQRF

SEQ ID NO: 136910 - protein, 9 aa, Homo Sapiens
AADPQIRQF

SEQ ID NO: 136911 - protein, 9 aa, Homo Sapiens
AAFAYTVKY

SEQ ID NO: 136912 - protein, 9 aa, Homo Sapiens
AAFCKLIVY

SEQ ID NO: 136913 - protein, 9 aa, Homo Sapiens
AAFDHICTF

SEQ ID NO: 136914 - protein, 9 aa, Homo Sapiens
AAFGRDLFL

SEQ ID NO: 136915 - protein, 9 aa, Homo Sapiens
AAFLKAIGY

SEQ ID NO: 136916 - protein, 9 aa, Homo Sapiens
AAFPGASLY

SEQ ID NO: 136917 - protein, 9 aa, Homo Sapiens
AAFPKKLAF

SEQ ID NO: 136918 - protein, 9 aa, Homo Sapiens
AAFTRALEY

SEQ ID NO: 136919 - protein, 9 aa, Homo Sapiens
AAGPTGMFF

SEQ ID NO: 136920 - protein, 9 aa, Homo Sapiens
AAHTVTAAY

SEQ ID NO: 136921 - protein, 9 aa, Homo Sapiens
AAIDHQIEV

SEQ ID NO: 136922 - protein, 9 aa, Homo Sapiens
AAIGLVIYY

SEQ ID NO: 136923 - protein, 9 aa, Homo Sapiens
AAIKQAAGF

SEQ ID NO: 136924 - protein, 9 aa, Homo Sapiens
AAINFQPKM

SEQ ID NO: 136925 - protein, 9 aa, Homo Sapiens
AAIYHVLHF

SEQ ID NO: 136926 - protein, 9 aa, Homo Sapiens
AAKAAGVSF

SEQ ID NO: 136927 - protein, 9 aa, Homo Sapiens
AAKAALEEF

SEQ ID NO: 136928 - protein, 9 aa, Homo Sapiens
AAKCALAYF

SEQ ID NO: 136929 - protein, 9 aa, Homo Sapiens
AAKDKLSEL

SEQ ID NO: 136930 - protein, 9 aa, Homo Sapiens
AAKDKLTEL

SEQ ID NO: 136931 - protein, 9 aa, Homo Sapiens
AAKDLISKL

SEQ ID NO: 136932 - protein, 9 aa, Homo Sapiens
AAKDYNQKL

SEQ ID NO: 136933 - protein, 9 aa, Homo Sapiens
AAKFKTPEL

SEQ ID NO: 136934 - protein, 9 aa, Homo Sapiens
AAKLEPKSF

SEQ ID NO: 136935 - protein, 9 aa, Homo Sapiens
AAKPHNPGF

SEQ ID NO: 136936 - protein, 9 aa, Homo Sapiens
AAKQINIDF

SEQ ID NO: 136937 - protein, 9 aa, Homo Sapiens
AAMPRPVSY

SEQ ID NO: 136938 - protein, 9 aa, Homo Sapiens
AAMSHLLEM

SEQ ID NO: 136939 - protein, 9 aa, Homo Sapiens
AAMSVAKRV

SEQ ID NO: 136940 - protein, 9 aa, Homo Sapiens
AAMSVAQRV

SEQ ID NO: 136941 - protein, 9 aa, Homo Sapiens
AANPHSFVF

SEQ ID NO: 136942 - protein, 9 aa, Homo Sapiens
AANPISGHY

SEQ ID NO: 136943 - protein, 9 aa, Homo Sapiens
AAQDRDQIY

SEQ ID NO: 136944 - protein, 9 aa, Homo Sapiens
AAQEAVKLY

SEQ ID NO: 136945 - protein, 9 aa, Homo Sapiens
AAQFIPKFF

SEQ ID NO: 136946 - protein, 9 aa, Homo Sapiens
AARPATSTL

SEQ ID NO: 136947 - protein, 9 aa, Homo Sapiens
AARSGPLAM

SEQ ID NO: 136948 - protein, 9 aa, Homo Sapiens
AARVIIEKY

SEQ ID NO: 136949 - protein, 9 aa, Homo Sapiens
AASAIYSGY

SEQ ID NO: 136950 - protein, 9 aa, Homo Sapiens
AASGHFICV

SEQ ID NO: 136951 - protein, 9 aa, Homo Sapiens
AASPIITLV

SEQ ID NO: 136952 - protein, 9 aa, Homo Sapiens
AASQINRAY

SEQ ID NO: 136953 - protein, 9 aa, Homo Sapiens
AASSIYSMY

SEQ ID NO: 136954 - protein, 9 aa, Homo Sapiens
AASYIQSKF

SEQ ID NO: 136955 - protein, 9 aa, Homo Sapiens
AATDIARQV

SEQ ID NO: 136956 - protein, 9 aa, Homo Sapiens
AATEIVERV

SEQ ID NO: 136957 - protein, 9 aa, Homo Sapiens
AATPAVRTV

SEQ ID NO: 136958 - protein, 9 aa, Homo Sapiens
AAVGHVLVV

SEQ ID NO: 136959 - protein, 9 aa, Homo Sapiens
AAVPEVAVY

SEQ ID NO: 136960 - protein, 9 aa, Homo Sapiens
AAVSFISKF

SEQ ID NO: 136961 - protein, 9 aa, Homo Sapiens
AAYGYGIRY

SEQ ID NO: 136962 - protein, 9 aa, Homo Sapiens
AAYGYKITE

SEQ ID NO: 136963 - protein, 9 aa, Homo Sapiens
AAYKWLVCY

SEQ ID NO: 136964 - protein, 9 aa, Homo Sapiens
AAYPEIVAV

SEQ ID NO: 136965 - protein, 9 aa, Homo Sapiens
AAYPQVRCY

SEQ ID NO: 136966 - protein, 9 aa, Homo Sapiens
AAYQLAFRY

SEQ ID NO: 136967 - protein, 9 aa, Homo Sapiens
AAYYHPSYL

SEQ ID NO: 136968 - protein, 9 aa, Homo Sapiens
AFLILPELR

SEQ ID NO: 136969 - protein, 9 aa, Homo Sapiens
AGIGRTGTF

SEQ ID NO: 136970 - protein, 9 aa, Homo Sapiens
AIIDILTHY

SEQ ID NO: 136971 - protein, 9 aa, Homo Sapiens
AIIERTASF

SEQ ID NO: 136972 - protein, 9 aa, Homo Sapiens
AIIERVQRY

SEQ ID NO: 136973 - protein, 9 aa, Homo Sapiens
AIVEIFSKY

SEQ ID NO: 136974 - protein, 9 aa, Homo Sapiens
APASGVVPF

SEQ ID NO: 136975 - protein, 9 aa, Homo Sapiens
AQAQLQKRY

SEQ ID NO: 136976 - protein, 9 aa, Homo Sapiens
AQGPTPRYF

SEQ ID NO: 136977 - protein, 9 aa, Homo Sapiens
AQISWVTVF

SEQ ID NO: 136978 - protein, 9 aa, Homo Sapiens
AQKNHIPVF

SEQ ID NO: 136979 - protein, 9 aa, Homo Sapiens
AQVWMITRY

SEQ ID NO: 136980 - protein, 9 aa, Homo Sapiens
ASNPRVTRF

SEQ ID NO: 136981 - protein, 9 aa, Homo Sapiens
ASVGKTSIL

SEQ ID NO: 136982 - protein, 9 aa, Homo Sapiens
ASYPHCLQF

SEQ ID NO: 136983 - protein, 9 aa, Homo Sapiens
ATAAIHSFF

SEQ ID NO: 136984 - protein, 9 aa, Homo Sapiens
ATAPRIKKF

SEQ ID NO: 136985 - protein, 9 aa, Homo Sapiens
ATFPKEIQM

SEQ ID NO: 136986 - protein, 9 aa, Homo Sapiens
ATKARIPFY

SEQ ID NO: 136987 - protein, 9 aa, Homo Sapiens
ATSGVHSNF

SEQ ID NO: 136988 - protein, 9 aa, Homo Sapiens
ATYHRAIKV

SEQ ID NO: 136989 - protein, 9 aa, Homo Sapiens
AVIAPKSSY

SEQ ID NO: 136990 - protein, 9 aa, Homo Sapiens
AVNALQSVY

SEQ ID NO: 136991 - protein, 9 aa, Homo Sapiens
AVNGHTNSF

SEQ ID NO: 136992 - protein, 9 aa, Homo Sapiens
AYNPQLNLK

SEQ ID NO: 136993 - protein, 9 aa, Homo Sapiens
CSSPIVVKF

SEQ ID NO: 136994 - protein, 9 aa, Homo Sapiens
CTYGKPVTF

SEQ ID NO: 136995 - protein, 9 aa, Homo Sapiens
FAADIISVL

SEQ ID NO: 136996 - protein, 9 aa, Homo Sapiens
FAAGYNVKF

SEQ ID NO: 136997 - protein, 9 aa, Homo Sapiens
FAAHLRCTY

SEQ ID NO: 136998 - protein, 9 aa, Homo Sapiens
FAAKFVTSF

SEQ ID NO: 136999 - protein, 9 aa, Homo Sapiens
FAANVYEAF

SEQ ID NO: 137000 - protein, 9 aa, Homo Sapiens
FACEKNENL

SEQ ID NO: 137001 - protein, 9 aa, Homo Sapiens
FACPKTDSL

SEQ ID NO: 137002 - protein, 9 aa, Homo Sapiens
FADPHGKVF

SEQ ID NO: 137003 - protein, 9 aa, Homo Sapiens
FAFDPSVNY

SEQ ID NO: 137004 - protein, 9 aa, Homo Sapiens
FAFEHSEEY

SEQ ID NO: 137005 - protein, 9 aa, Homo Sapiens
FAFFDPVMY

SEQ ID NO: 137006 - protein, 9 aa, Homo Sapiens
FAFRYVTTI

SEQ ID NO: 137007 - protein, 9 aa, Homo Sapiens
FAFVTDNTY

SEQ ID NO: 137008 - protein, 9 aa, Homo Sapiens
FAHEVGHNF

SEQ ID NO: 137009 - protein, 9 aa, Homo Sapiens
FAHHASCHF

SEQ ID NO: 137010 - protein, 9 aa, Homo Sapiens
FAHLINVEF

SEQ ID NO: 137011 - protein, 9 aa, Homo Sapiens
FAHLPKSTF

SEQ ID NO: 137012 - protein, 9 aa, Homo Sapiens
FAHPSLWQL

SEQ ID NO: 137013 - protein, 9 aa, Homo Sapiens
FAHPYQYEL

SEQ ID NO: 137014 - protein, 9 aa, Homo Sapiens
FAIPLIEKL

SEQ ID NO: 137015 - protein, 9 aa, Homo Sapiens
FAIPLIERL

SEQ ID NO: 137016 - protein, 9 aa, Homo Sapiens
FAIQRTTNF

SEQ ID NO: 137017 - protein, 9 aa, Homo Sapiens
FAIYKMSFF

SEQ ID NO: 137018 - protein, 9 aa, Homo Sapiens
FAKEILPKY

SEQ ID NO: 137019 - protein, 9 aa, Homo Sapiens
FAKELQRSF

SEQ ID NO: 137020 - protein, 9 aa, Homo Sapiens
FAKEVLPKY

SEQ ID NO: 137021 - protein, 9 aa, Homo Sapiens
FAKEVSHEM

SEQ ID NO: 137022 - protein, 9 aa, Homo Sapiens
FAKPENIDL

SEQ ID NO: 137023 - protein, 9 aa, Homo Sapiens
FAMEFVKYY

SEQ ID NO: 137024 - protein, 9 aa, Homo Sapiens
FAMFSGTHV

SEQ ID NO: 137025 - protein, 9 aa, Homo Sapiens
FAMPYFIQV

SEQ ID NO: 137026 - protein, 9 aa, Homo Sapiens
FANERCLQL

SEQ ID NO: 137027 - protein, 9 aa, Homo Sapiens
FANGHVNSV

SEQ ID NO: 137028 - protein, 9 aa, Homo Sapiens
FANIDQETY

SEQ ID NO: 137029 - protein, 9 aa, Homo Sapiens
FAQDVGRMF

SEQ ID NO: 137030 - protein, 9 aa, Homo Sapiens
FASGLIHRV

SEQ ID NO: 137031 - protein, 9 aa, Homo Sapiens
FASHVSPEV

SEQ ID NO: 137032 - protein, 9 aa, Homo Sapiens
FASNVVEKC

SEQ ID NO: 137033 - protein, 9 aa, Homo Sapiens
FASPKIDSV

SEQ ID NO: 137034 - protein, 9 aa, Homo Sapiens
FAVPKNYKL

SEQ ID NO: 137035 - protein, 9 aa, Homo Sapiens
FAYEGPMYL

SEQ ID NO: 137036 - protein, 9 aa, Homo Sapiens
FAYHMIETY

SEQ ID NO: 137037 - protein, 9 aa, Homo Sapiens
FAYHYPYTY

SEQ ID NO: 137038 - protein, 9 aa, Homo Sapiens
FAYPAIRYL

SEQ ID NO: 137039 - protein, 9 aa, Homo Sapiens
FAYPSELKA

SEQ ID NO: 137040 - protein, 9 aa, Homo Sapiens
FAYTARISV

SEQ ID NO: 137041 - protein, 9 aa, Homo Sapiens
FAYYRVGEY

SEQ ID NO: 137042 - protein, 9 aa, Homo Sapiens
FFSEKIYKL

SEQ ID NO: 137043 - protein, 9 aa, Homo Sapiens
FGADARALM

SEQ ID NO: 137044 - protein, 9 aa, Homo Sapiens
FGADVVSKF

SEQ ID NO: 137045 - protein, 9 aa, Homo Sapiens
FGATNPKNF

SEQ ID NO: 137046 - protein, 9 aa, Homo Sapiens
FGFHKPKMY

SEQ ID NO: 137047 - protein, 9 aa, Homo Sapiens
FGFPDPKLF

SEQ ID NO: 137048 - protein, 9 aa, Homo Sapiens
FGHVQRAEM

SEQ ID NO: 137049 - protein, 9 aa, Homo Sapiens
FGYPKRLIM

SEQ ID NO: 137050 - protein, 9 aa, Homo Sapiens
FIANLFNRY

SEQ ID NO: 137051 - protein, 9 aa, Homo Sapiens
FIEELFSLM

SEQ ID NO: 137052 - protein, 9 aa, Homo Sapiens
FIIPQIVKY

SEQ ID NO: 137053 - protein, 9 aa, Homo Sapiens
FIIQGLRSV

SEQ ID NO: 137054 - protein, 9 aa, Homo Sapiens
FIISRTQAL

SEQ ID NO: 137055 - protein, 9 aa, Homo Sapiens
FIKDGSSTY

SEQ ID NO: 137056 - protein, 9 aa, Homo Sapiens
FIMGKTIEF

SEQ ID NO: 137057 - protein, 9 aa, Homo Sapiens
FIMGKVPVF

SEQ ID NO: 137058 - protein, 9 aa, Homo Sapiens
FIMPIEVHF

SEQ ID NO: 137059 - protein, 9 aa, Homo Sapiens
FINPKPITY

SEQ ID NO: 137060 - protein, 9 aa, Homo Sapiens
FINQNLRTY

SEQ ID NO: 137061 - protein, 9 aa, Homo Sapiens
FIRVVGSEF

SEQ ID NO: 137062 - protein, 9 aa, Homo Sapiens
FISKKEWYV

SEQ ID NO: 137063 - protein, 9 aa, Homo Sapiens
FITKIISKF

SEQ ID NO: 137064 - protein, 9 aa, Homo Sapiens
FIYHLPQEF

SEQ ID NO: 137065 - protein, 9 aa, Homo Sapiens
FLADIVQKL

SEQ ID NO: 137066 - protein, 9 aa, Homo Sapiens
FLAPLFSSF

SEQ ID NO: 137067 - protein, 9 aa, Homo Sapiens
FLAPLVTEY

SEQ ID NO: 137068 - protein, 9 aa, Homo Sapiens
FLCGVMKTY

SEQ ID NO: 137069 - protein, 9 aa, Homo Sapiens
FLIDRSPEY

SEQ ID NO: 137070 - protein, 9 aa, Homo Sapiens
FLKDLVASV

SEQ ID NO: 137071 - protein, 9 aa, Homo Sapiens
FLKEIVETF

SEQ ID NO: 137072 - protein, 9 aa, Homo Sapiens
FLKEVVETF

SEQ ID NO: 137073 - protein, 9 aa, Homo Sapiens
FLPKMPWSI

SEQ ID NO: 137074 - protein, 9 aa, Homo Sapiens
FLQQPRPLM

SEQ ID NO: 137075 - protein, 9 aa, Homo Sapiens
FLRDKIASY

SEQ ID NO: 137076 - protein, 9 aa, Homo Sapiens
FLYDKALTF

SEQ ID NO: 137077 - protein, 9 aa, Homo Sapiens
FLYPFPLAL

SEQ ID NO: 137078 - protein, 9 aa, Homo Sapiens
FQAEIAQLM

SEQ ID NO: 137079 - protein, 9 aa, Homo Sapiens
FQAHLTKKF

SEQ ID NO: 137080 - protein, 9 aa, Homo Sapiens
FQAPTAKEM

SEQ ID NO: 137081 - protein, 9 aa, Homo Sapiens
FQIDRSWKA

SEQ ID NO: 137082 - protein, 9 aa, Homo Sapiens
FQIGKMRYV

SEQ ID NO: 137083 - protein, 9 aa, Homo Sapiens
FQNKKRVLL

SEQ ID NO: 137084 - protein, 9 aa, Homo Sapiens
FQNPVVTKC

SEQ ID NO: 137085 - protein, 9 aa, Homo Sapiens
FQNTIREMF

SEQ ID NO: 137086 - protein, 9 aa, Homo Sapiens
FQNVQQVEY

SEQ ID NO: 137087 - protein, 9 aa, Homo Sapiens
FQRKAIERF

SEQ ID NO: 137088 - protein, 9 aa, Homo Sapiens
FQRNIKKEY

SEQ ID NO: 137089 - protein, 9 aa, Homo Sapiens
FQRPTIYYV

SEQ ID NO: 137090 - protein, 9 aa, Homo Sapiens
FQYAKESYI

SEQ ID NO: 137091 - protein, 9 aa, Homo Sapiens
FQYESKVFY

SEQ ID NO: 137092 - protein, 9 aa, Homo Sapiens
FSEPFHLIV

SEQ ID NO: 137093 - protein, 9 aa, Homo Sapiens
FSKDIVENY

SEQ ID NO: 137094 - protein, 9 aa, Homo Sapiens
FSKNITATF

SEQ ID NO: 137095 - protein, 9 aa, Homo Sapiens
FSKPSSDTF

SEQ ID NO: 137096 - protein, 9 aa, Homo Sapiens
FSNPNIQKI

SEQ ID NO: 137097 - protein, 9 aa, Homo Sapiens
FSNPRALYL

SEQ ID NO: 137098 - protein, 9 aa, Homo Sapiens
FSNPYSIEY

SEQ ID NO: 137099 - protein, 9 aa, Homo Sapiens
FSSDLQKTF

SEQ ID NO: 137100 - protein, 9 aa, Homo Sapiens
FSSPHLVQV

SEQ ID NO: 137101 - protein, 9 aa, Homo Sapiens
FSYAFPKEF

SEQ ID NO: 137102 - protein, 9 aa, Homo Sapiens
FSYQHAIEE

SEQ ID NO: 137103 - protein, 9 aa, Homo Sapiens
FTAAIISRV

SEQ ID NO: 137104 - protein, 9 aa, Homo Sapiens
FTAKVWDAV

SEQ ID NO: 137105 - protein, 9 aa, Homo Sapiens
FTFSGICRV

SEQ ID NO: 137106 - protein, 9 aa, Homo Sapiens
FTHASPTLF

SEQ ID NO: 137107 - protein, 9 aa, Homo Sapiens
FTHLSLQEF

SEQ ID NO: 137108 - protein, 9 aa, Homo Sapiens
FTIFRTISV

SEQ ID NO: 137109 - protein, 9 aa, Homo Sapiens
FTITKTVEY

SEQ ID NO: 137110 - protein, 9 aa, Homo Sapiens
FTKIMKSKY

SEQ ID NO: 137111 - protein, 9 aa, Homo Sapiens
FTVPHTHVF

SEQ ID NO: 137112 - protein, 9 aa, Homo Sapiens
FTVTFNPKY

SEQ ID NO: 137113 - protein, 9 aa, Homo Sapiens
FVAEQKVEY

SEQ ID NO: 137114 - protein, 9 aa, Homo Sapiens
FVANLFNKY

SEQ ID NO: 137115 - protein, 9 aa, Homo Sapiens
FVHPDPLWI

SEQ ID NO: 137116 - protein, 9 aa, Homo Sapiens
FVKDSGACF

SEQ ID NO: 137117 - protein, 9 aa, Homo Sapiens
FVKDSIRLV

SEQ ID NO: 137118 - protein, 9 aa, Homo Sapiens
FVKKIGGIF

SEQ ID NO: 137119 - protein, 9 aa, Homo Sapiens
FVKPAFEEF

SEQ ID NO: 137120 - protein, 9 aa, Homo Sapiens
FVKPAVVTV

SEQ ID NO: 137121 - protein, 9 aa, Homo Sapiens
FVNKFNVLY

SEQ ID NO: 137122 - protein, 9 aa, Homo Sapiens
FVNPHVSSF

SEQ ID NO: 137123 - protein, 9 aa, Homo Sapiens
FVRDMIREV

SEQ ID NO: 137124 - protein, 9 aa, Homo Sapiens
GAAGVHFIY

SEQ ID NO: 137125 - protein, 9 aa, Homo Sapiens
GADGSVRMF

SEQ ID NO: 137126 - protein, 9 aa, Homo Sapiens
GAFGLPITV

SEQ ID NO: 137127 - protein, 9 aa, Homo Sapiens
GAHGIIVVY

SEQ ID NO: 137128 - protein, 9 aa, Homo Sapiens
GAVGFFTHY

SEQ ID NO: 137129 - protein, 9 aa, Homo Sapiens
GAVTKTHVM

SEQ ID NO: 137130 - protein, 9 aa, Homo Sapiens
GAYGQAVRY

SEQ ID NO: 137131 - protein, 9 aa, Homo Sapiens
GAYGTPQKY

SEQ ID NO: 137132 - protein, 9 aa, Homo Sapiens
GAYKYIQEL

SEQ ID NO: 137133 - protein, 9 aa, Homo Sapiens
GAYTVTIKY

SEQ ID NO: 137134 - protein, 9 aa, Homo Sapiens
GIYPHKLVF

SEQ ID NO: 137135 - protein, 9 aa, Homo Sapiens
GQNKKVMIY

SEQ ID NO: 137136 - protein, 9 aa, Homo Sapiens
GTAMIFTCF

SEQ ID NO: 137137 - protein, 9 aa, Homo Sapiens
GVIKRTENV

SEQ ID NO: 137138 - protein, 9 aa, Homo Sapiens
GVIQPGRGF

SEQ ID NO: 137139 - protein, 9 aa, Homo Sapiens
GVKSVGQGY

SEQ ID NO: 137140 - protein, 9 aa, Homo Sapiens
HAAGFAYTY

SEQ ID NO: 137141 - protein, 9 aa, Homo Sapiens
HAAHIISEL

SEQ ID NO: 137142 - protein, 9 aa, Homo Sapiens
HAFGSATQF

SEQ ID NO: 137143 - protein, 9 aa, Homo Sapiens
HAIDIICGF

SEQ ID NO: 137144 - protein, 9 aa, Homo Sapiens
HAIKSVKIY

SEQ ID NO: 137145 - protein, 9 aa, Homo Sapiens
HAMEEVKKF

SEQ ID NO: 137146 - protein, 9 aa, Homo Sapiens
HAYIHSVQF

SEQ ID NO: 137147 - protein, 9 aa, Homo Sapiens
HAYPYPQMY

SEQ ID NO: 137148 - protein, 9 aa, Homo Sapiens
HGIDPTGTY

SEQ ID NO: 137149 - protein, 9 aa, Homo Sapiens
HIIGRIESY

SEQ ID NO: 137150 - protein, 9 aa, Homo Sapiens
HIMEIFSTY

SEQ ID NO: 137151 - protein, 9 aa, Homo Sapiens
HQITVLHVY

SEQ ID NO: 137152 - protein, 9 aa, Homo Sapiens
HQYDGLVEL

SEQ ID NO: 137153 - protein, 9 aa, Homo Sapiens
HTADISSHF

SEQ ID NO: 137154 - protein, 9 aa, Homo Sapiens
HTFLPKIFF

SEQ ID NO: 137155 - protein, 9 aa, Homo Sapiens
HTIGKTVEY

SEQ ID NO: 137156 - protein, 9 aa, Homo Sapiens
HVNGIVQKY

SEQ ID NO: 137157 - protein, 9 aa, Homo Sapiens
IAADILIKE

SEQ ID NO: 137158 - protein, 9 aa, Homo Sapiens
IAAGIFNDL

SEQ ID NO: 137159 - protein, 9 aa, Homo Sapiens
IAAKKVLRL

SEQ ID NO: 137160 - protein, 9 aa, Homo Sapiens
IAAPFTSKL

SEQ ID NO: 137161 - protein, 9 aa, Homo Sapiens
IAFGFHQLY

SEQ ID NO: 137162 - protein, 9 aa, Homo Sapiens
IAFPKAEEL

SEQ ID NO: 137163 - protein, 9 aa, Homo Sapiens
IAFPTSISV

SEQ ID NO: 137164 - protein, 9 aa, Homo Sapiens
IAFSRPVKY

SEQ ID NO: 137165 - protein, 9 aa, Homo Sapiens
IAGYVTHLM

SEQ ID NO: 137166 - protein, 9 aa, Homo Sapiens
IAIGKVLKL

SEQ ID NO: 137167 - protein, 9 aa, Homo Sapiens
IAIPFLIKL

SEQ ID NO: 137168 - protein, 9 aa, Homo Sapiens
IAIPVTVAF

SEQ ID NO: 137169 - protein, 9 aa, Homo Sapiens
IAISRTPVL

SEQ ID NO: 137170 - protein, 9 aa, Homo Sapiens
IAKHIDAEY

SEQ ID NO: 137171 - protein, 9 aa, Homo Sapiens
IAKKTTPLL

SEQ ID NO: 137172 - protein, 9 aa, Homo Sapiens
IAKSGTKAF

SEQ ID NO: 137173 - protein, 9 aa, Homo Sapiens
IAKSGTSEF

SEQ ID NO: 137174 - protein, 9 aa, Homo Sapiens
IASDIVSRF

SEQ ID NO: 137175 - protein, 9 aa, Homo Sapiens
IAVGHIYFF

SEQ ID NO: 137176 - protein, 9 aa, Homo Sapiens
IAVGHIYYF

SEQ ID NO: 137177 - protein, 9 aa, Homo Sapiens
IAVGIMSYY

SEQ ID NO: 137178 - protein, 9 aa, Homo Sapiens
IAVGTVIRY

SEQ ID NO: 137179 - protein, 9 aa, Homo Sapiens
IAYPKAVTM

SEQ ID NO: 137180 - protein, 9 aa, Homo Sapiens
IIAEPGRYY

SEQ ID NO: 137181 - protein, 9 aa, Homo Sapiens
IIAPPERKY

SEQ ID NO: 137182 - protein, 9 aa, Homo Sapiens
IIHDFPQFY

SEQ ID NO: 137183 - protein, 9 aa, Homo Sapiens
IISSVIQKF

SEQ ID NO: 137184 - protein, 9 aa, Homo Sapiens
ILGPPGSVY

SEQ ID NO: 137185 - protein, 9 aa, Homo Sapiens
IQAGIFQEF

SEQ ID NO: 137186 - protein, 9 aa, Homo Sapiens
ISKALVAYY

SEQ ID NO: 137187 - protein, 9 aa, Homo Sapiens
ISPVTKSSF

SEQ ID NO: 137188 - protein, 9 aa, Homo Sapiens
ISTPVIRTF

SEQ ID NO: 137189 - protein, 9 aa, Homo Sapiens
ITKVRTPVM

SEQ ID NO: 137190 - protein, 9 aa, Homo Sapiens
IVKKPGNIY

SEQ ID NO: 137191 - protein, 9 aa, Homo Sapiens
IVPGNVKSL

SEQ ID NO: 137192 - protein, 9 aa, Homo Sapiens
KAADIASKV

SEQ ID NO: 137193 - protein, 9 aa, Homo Sapiens
KAAPCIYWL

SEQ ID NO: 137194 - protein, 9 aa, Homo Sapiens
KACTIAIRY

SEQ ID NO: 137195 - protein, 9 aa, Homo Sapiens
KAFARPWSL

SEQ ID NO: 137196 - protein, 9 aa, Homo Sapiens
KAFDFPSSF

SEQ ID NO: 137197 - protein, 9 aa, Homo Sapiens
KAFDRPSLF

SEQ ID NO: 137198 - protein, 9 aa, Homo Sapiens
KAFDYPSRF

SEQ ID NO: 137199 - protein, 9 aa, Homo Sapiens
KAFPFHIIF

SEQ ID NO: 137200 - protein, 9 aa, Homo Sapiens
KAFPGIISE

SEQ ID NO: 137201 - protein, 9 aa, Homo Sapiens
KAGPIWDLR

SEQ ID NO: 137202 - protein, 9 aa, Homo Sapiens
KAIELLQEF

SEQ ID NO: 137203 - protein, 9 aa, Homo Sapiens
KAISGVHTV

SEQ ID NO: 137204 - protein, 9 aa, Homo Sapiens
KAITFVTQY

SEQ ID NO: 137205 - protein, 9 aa, Homo Sapiens
KAKEIYMTF

SEQ ID NO: 137206 - protein, 9 aa, Homo Sapiens
KAMGIMNSF

SEQ ID NO: 137207 - protein, 9 aa, Homo Sapiens
KANPALYVL

SEQ ID NO: 137208 - protein, 9 aa, Homo Sapiens
KARGDLGAF

SEQ ID NO: 137209 - protein, 9 aa, Homo Sapiens
KASDAFHFF

SEQ ID NO: 137210 - protein, 9 aa, Homo Sapiens
KATNVCTRF

SEQ ID NO: 137211 - protein, 9 aa, Homo Sapiens
KAVSLFLCY

SEQ ID NO: 137212 - protein, 9 aa, Homo Sapiens
KAYFDVKEY

SEQ ID NO: 137213 - protein, 9 aa, Homo Sapiens
KAYGASKTF

SEQ ID NO: 137214 - protein, 9 aa, Homo Sapiens
KIKEIAVTV

SEQ ID NO: 137215 - protein, 9 aa, Homo Sapiens
KISNIIKQF

SEQ ID NO: 137216 - protein, 9 aa, Homo Sapiens
KLPDIFSVY

SEQ ID NO: 137217 - protein, 9 aa, Homo Sapiens
KMKLNETSF

SEQ ID NO: 137218 - protein, 9 aa, Homo Sapiens
KQAEIVKRL

SEQ ID NO: 137219 - protein, 9 aa, Homo Sapiens
KQFHRIVTY

SEQ ID NO: 137220 - protein, 9 aa, Homo Sapiens
KQFPEVIKY

SEQ ID NO: 137221 - protein, 9 aa, Homo Sapiens
KSIARVLTV

SEQ ID NO: 137222 - protein, 9 aa, Homo Sapiens
KSSDIAKTF

SEQ ID NO: 137223 - protein, 9 aa, Homo Sapiens
KSVDWLLVF

SEQ ID NO: 137224 - protein, 9 aa, Homo Sapiens
KTFDHYCEY

SEQ ID NO: 137225 - protein, 9 aa, Homo Sapiens
KTIDKKTFY

SEQ ID NO: 137226 - protein, 9 aa, Homo Sapiens
KTPDFILQV

SEQ ID NO: 137227 - protein, 9 aa, Homo Sapiens
KVANLVKAY

SEQ ID NO: 137228 - protein, 9 aa, Homo Sapiens
KVSSINSRF

SEQ ID NO: 137229 - protein, 9 aa, Homo Sapiens
KYFDEHYEY

SEQ ID NO: 137230 - protein, 9 aa, Homo Sapiens
LAAGHLVQL

SEQ ID NO: 137231 - protein, 9 aa, Homo Sapiens
LAFPGEMLL

SEQ ID NO: 137232 - protein, 9 aa, Homo Sapiens
LAFSRALEL

SEQ ID NO: 137233 - protein, 9 aa, Homo Sapiens
LAIKRCKHF

SEQ ID NO: 137234 - protein, 9 aa, Homo Sapiens
LAINHAYFY

SEQ ID NO: 137235 - protein, 9 aa, Homo Sapiens
LAIYEPKTF

SEQ ID NO: 137236 - protein, 9 aa, Homo Sapiens
LAKDGVLTL

SEQ ID NO: 137237 - protein, 9 aa, Homo Sapiens
LAKEVGTSY

SEQ ID NO: 137238 - protein, 9 aa, Homo Sapiens
LAKGGTVEY

SEQ ID NO: 137239 - protein, 9 aa, Homo Sapiens
LALIIMKIL

SEQ ID NO: 137240 - protein, 9 aa, Homo Sapiens
LANGDVWKV

SEQ ID NO: 137241 - protein, 9 aa, Homo Sapiens
LANKLITVY

SEQ ID NO: 137242 - protein, 9 aa, Homo Sapiens
LARDFLDEY

SEQ ID NO: 137243 - protein, 9 aa, Homo Sapiens
LARIIDSEY

SEQ ID NO: 137244 - protein, 9 aa, Homo Sapiens
LARPLPVEY

SEQ ID NO: 137245 - protein, 9 aa, Homo Sapiens
LASKEIHQF

SEQ ID NO: 137246 - protein, 9 aa, Homo Sapiens
LASPIYTHF

SEQ ID NO: 137247 - protein, 9 aa, Homo Sapiens
LASSLLDRF

SEQ ID NO: 137248 - protein, 9 aa, Homo Sapiens
LASYVHYVF

SEQ ID NO: 137249 - protein, 9 aa, Homo Sapiens
LATASSPKF

SEQ ID NO: 137250 - protein, 9 aa, Homo Sapiens
LAVPFCVNF

SEQ ID NO: 137251 - protein, 9 aa, Homo Sapiens
LAYIHLIEF

SEQ ID NO: 137252 - protein, 9 aa, Homo Sapiens
LHYPIDSLT

SEQ ID NO: 137253 - protein, 9 aa, Homo Sapiens
LIYGRPVYV

SEQ ID NO: 137254 - protein, 9 aa, Homo Sapiens
LLADITSKY

SEQ ID NO: 137255 - protein, 9 aa, Homo Sapiens
LLKSPGACF

SEQ ID NO: 137256 - protein, 9 aa, Homo Sapiens
LREDGALSI

SEQ ID NO: 137257 - protein, 9 aa, Homo Sapiens
LSAPIHTQM

SEQ ID NO: 137258 - protein, 9 aa, Homo Sapiens
LSAPIMSRF

SEQ ID NO: 137259 - protein, 9 aa, Homo Sapiens
LSFPTTKTY

SEQ ID NO: 137260 - protein, 9 aa, Homo Sapiens
LSFTHPISF

SEQ ID NO: 137261 - protein, 9 aa, Homo Sapiens
LSGSYVVYT

SEQ ID NO: 137262 - protein, 9 aa, Homo Sapiens
LSKDDIENM

SEQ ID NO: 137263 - protein, 9 aa, Homo Sapiens
LSKDSILSL

SEQ ID NO: 137264 - protein, 9 aa, Homo Sapiens
LSKGPGLEV

SEQ ID NO: 137265 - protein, 9 aa, Homo Sapiens
LSNTVMPRF

SEQ ID NO: 137266 - protein, 9 aa, Homo Sapiens
LTDAIYDII

SEQ ID NO: 137267 - protein, 9 aa, Homo Sapiens
LTFPHPVYY

SEQ ID NO: 137268 - protein, 9 aa, Homo Sapiens
MAFGKPAKY

SEQ ID NO: 137269 - protein, 9 aa, Homo Sapiens
MASKILKSY

SEQ ID NO: 137270 - protein, 9 aa, Homo Sapiens
MAYGGKLKY

SEQ ID NO: 137271 - protein, 9 aa, Homo Sapiens
MAYGHIDSY

SEQ ID NO: 137272 - protein, 9 aa, Homo Sapiens
MSKAPSNTF

SEQ ID NO: 137273 - protein, 9 aa, Homo Sapiens
MTKKPGMFF

SEQ ID NO: 137274 - protein, 9 aa, Homo Sapiens
NAAAIYDLL

SEQ ID NO: 137275 - protein, 9 aa, Homo Sapiens
NADPNMKLF

SEQ ID NO: 137276 - protein, 9 aa, Homo Sapiens
NASPVISSV

SEQ ID NO: 137277 - protein, 9 aa, Homo Sapiens
NATGVAMLF

SEQ ID NO: 137278 - protein, 9 aa, Homo Sapiens
NAVNLAIKY

SEQ ID NO: 137279 - protein, 9 aa, Homo Sapiens
NAYAKVCLY

SEQ ID NO: 137280 - protein, 9 aa, Homo Sapiens
NQIPFIIQY

SEQ ID NO: 137281 - protein, 9 aa, Homo Sapiens
NTIPFIIRY

SEQ ID NO: 137282 - protein, 9 aa, Homo Sapiens
PPKYAKTLY

SEQ ID NO: 137283 - protein, 9 aa, Homo Sapiens
PSIVHRKCF

SEQ ID NO: 137284 - protein, 9 aa, Homo Sapiens
QAASILTKF

SEQ ID NO: 137285 - protein, 9 aa, Homo Sapiens
QAERIFSEV

SEQ ID NO: 137286 - protein, 9 aa, Homo Sapiens
QAIQWILHY

SEQ ID NO: 137287 - protein, 9 aa, Homo Sapiens
QAMGKTSFF

SEQ ID NO: 137288 - protein, 9 aa, Homo Sapiens
QAPQPQSSL

SEQ ID NO: 137289 - protein, 9 aa, Homo Sapiens
QAYSGIQQY

SEQ ID NO: 137290 - protein, 9 aa, Homo Sapiens
QIPEIKQTL

SEQ ID NO: 137291 - protein, 9 aa, Homo Sapiens
QSTTRLTEM

SEQ ID NO: 137292 - protein, 9 aa, Homo Sapiens
RAAKKLWKV

SEQ ID NO: 137293 - protein, 9 aa, Homo Sapiens
RAAPFSLEY

SEQ ID NO: 137294 - protein, 9 aa, Homo Sapiens
RAFASATNY

SEQ ID NO: 137295 - protein, 9 aa, Homo Sapiens
RAFDVPKRY

SEQ ID NO: 137296 - protein, 9 aa, Homo Sapiens
RAFEYEIRF

SEQ ID NO: 137297 - protein, 9 aa, Homo Sapiens
RAFGIPIRV

SEQ ID NO: 137298 - protein, 9 aa, Homo Sapiens
RAFPLPMSF

SEQ ID NO: 137299 - protein, 9 aa, Homo Sapiens
RAFPNKQGY

SEQ ID NO: 137300 - protein, 9 aa, Homo Sapiens
RAGPTAVYF

SEQ ID NO: 137301 - protein, 9 aa, Homo Sapiens
RAIDKCWKI

SEQ ID NO: 137302 - protein, 9 aa, Homo Sapiens
RAIEIYTDM

SEQ ID NO: 137303 - protein, 9 aa, Homo Sapiens
RAIGILSRF

SEQ ID NO: 137304 - protein, 9 aa, Homo Sapiens
RAINIALQL

SEQ ID NO: 137305 - protein, 9 aa, Homo Sapiens
RAIRPPRHF

SEQ ID NO: 137306 - protein, 9 aa, Homo Sapiens
RAITETHAF

SEQ ID NO: 137307 - protein, 9 aa, Homo Sapiens
RAKEYLEFF

SEQ ID NO: 137308 - protein, 9 aa, Homo Sapiens
RAKQPPSTF

SEQ ID NO: 137309 - protein, 9 aa, Homo Sapiens
RAMFHDKKF

SEQ ID NO: 137310 - protein, 9 aa, Homo Sapiens
RARELLVSY

SEQ ID NO: 137311 - protein, 9 aa, Homo Sapiens
RARYLAEKY

SEQ ID NO: 137312 - protein, 9 aa, Homo Sapiens
RASLLLKTY

SEQ ID NO: 137313 - protein, 9 aa, Homo Sapiens
RASPVNDIF

SEQ ID NO: 137314 - protein, 9 aa, Homo Sapiens
RASWIAQVF

SEQ ID NO: 137315 - protein, 9 aa, Homo Sapiens
RATPHPSEL

SEQ ID NO: 137316 - protein, 9 aa, Homo Sapiens
RAYAKALHY

SEQ ID NO: 137317 - protein, 9 aa, Homo Sapiens
RAYAKDVKF

SEQ ID NO: 137318 - protein, 9 aa, Homo Sapiens
RAYGRDIVE

SEQ ID NO: 137319 - protein, 9 aa, Homo Sapiens
RAYPAAITI

SEQ ID NO: 137320 - protein, 9 aa, Homo Sapiens
RAYPTVKFY

SEQ ID NO: 137321 - protein, 9 aa, Homo Sapiens
RIADISQVY

SEQ ID NO: 137322 - protein, 9 aa, Homo Sapiens
RIHFPLATY

SEQ ID NO: 137323 - protein, 9 aa, Homo Sapiens
RIKAINTFF

SEQ ID NO: 137324 - protein, 9 aa, Homo Sapiens
RISGVDRYY

SEQ ID NO: 137325 - protein, 9 aa, Homo Sapiens
RLSKLIKKF

SEQ ID NO: 137326 - protein, 9 aa, Homo Sapiens
RQADFVQVL

SEQ ID NO: 137327 - protein, 9 aa, Homo Sapiens
RQADKVWRL

SEQ ID NO: 137328 - protein, 9 aa, Homo Sapiens
RQIDFVLSY

SEQ ID NO: 137329 - protein, 9 aa, Homo Sapiens
RQIKHMIKY

SEQ ID NO: 137330 - protein, 9 aa, Homo Sapiens
RQINWTVLY

SEQ ID NO: 137331 - protein, 9 aa, Homo Sapiens
RQTTITSHF

SEQ ID NO: 137332 - protein, 9 aa, Homo Sapiens
RQYAKDIGF

SEQ ID NO: 137333 - protein, 9 aa, Homo Sapiens
RQYPEVIKY

SEQ ID NO: 137334 - protein, 9 aa, Homo Sapiens
RSSGRVYYF

SEQ ID NO: 137335 - protein, 9 aa, Homo Sapiens
RTFGHLLRY

SEQ ID NO: 137336 - protein, 9 aa, Homo Sapiens
RTMEIESTF

SEQ ID NO: 137337 - protein, 9 aa, Homo Sapiens
RTVEKTWKL

SEQ ID NO: 137338 - protein, 9 aa, Homo Sapiens
RVFPSPMRI

SEQ ID NO: 137339 - protein, 9 aa, Homo Sapiens
RVFPYSVFY

SEQ ID NO: 137340 - protein, 9 aa, Homo Sapiens
RVKEIGSTM

SEQ ID NO: 137341 - protein, 9 aa, Homo Sapiens
RVKEIYNTY

SEQ ID NO: 137342 - protein, 9 aa, Homo Sapiens
RVQGFQVEY

SEQ ID NO: 137343 - protein, 9 aa, Homo Sapiens
RVVDIYSKF

SEQ ID NO: 137344 - protein, 9 aa, Homo Sapiens
RVYPQAVYF

SEQ ID NO: 137345 - protein, 9 aa, Homo Sapiens
SAAAVFSHF

SEQ ID NO: 137346 - protein, 9 aa, Homo Sapiens
SAADFFSHY

SEQ ID NO: 137347 - protein, 9 aa, Homo Sapiens
SAAFAVKLF

SEQ ID NO: 137348 - protein, 9 aa, Homo Sapiens
SAANIQPIF

SEQ ID NO: 137349 - protein, 9 aa, Homo Sapiens
SAAPFAQRY

SEQ ID NO: 137350 - protein, 9 aa, Homo Sapiens
SAAPFFVLF

SEQ ID NO: 137351 - protein, 9 aa, Homo Sapiens
SAAQPGVAF

SEQ ID NO: 137352 - protein, 9 aa, Homo Sapiens
SAASEQHVF

SEQ ID NO: 137353 - protein, 9 aa, Homo Sapiens
SAASICAKV

SEQ ID NO: 137354 - protein, 9 aa, Homo Sapiens
SAASITPLL

SEQ ID NO: 137355 - protein, 9 aa, Homo Sapiens
SAASLTSKY

SEQ ID NO: 137356 - protein, 9 aa, Homo Sapiens
SAASLYPVL

SEQ ID NO: 137357 - protein, 9 aa, Homo Sapiens
SACGHTAVL

SEQ ID NO: 137358 - protein, 9 aa, Homo Sapiens
SACGKTFRY

SEQ ID NO: 137359 - protein, 9 aa, Homo Sapiens
SACIKVTKY

SEQ ID NO: 137360 - protein, 9 aa, Homo Sapiens
SACKNILRF

SEQ ID NO: 137361 - protein, 9 aa, Homo Sapiens
SACPFSSKF

SEQ ID NO: 137362 - protein, 9 aa, Homo Sapiens
SADEVQRFF

SEQ ID NO: 137363 - protein, 9 aa, Homo Sapiens
SAFGQIYKV

SEQ ID NO: 137364 - protein, 9 aa, Homo Sapiens
SAFGRALRY

SEQ ID NO: 137365 - protein, 9 aa, Homo Sapiens
SAFNLLMHY

SEQ ID NO: 137366 - protein, 9 aa, Homo Sapiens
SAFPFPVTV

SEQ ID NO: 137367 - protein, 9 aa, Homo Sapiens
SAFPSNIFY

SEQ ID NO: 137368 - protein, 9 aa, Homo Sapiens
SAFPYAHRF

SEQ ID NO: 137369 - protein, 9 aa, Homo Sapiens
SAFSGPYKF

SEQ ID NO: 137370 - protein, 9 aa, Homo Sapiens
SAFSRIMKL

SEQ ID NO: 137371 - protein, 9 aa, Homo Sapiens
SAFTNRIFF

SEQ ID NO: 137372 - protein, 9 aa, Homo Sapiens
SAFYDSELF

SEQ ID NO: 137373 - protein, 9 aa, Homo Sapiens
SAHAGTYEV

SEQ ID NO: 137374 - protein, 9 aa, Homo Sapiens
SAHNLQSVF

SEQ ID NO: 137375 - protein, 9 aa, Homo Sapiens
SAIASTKVM

SEQ ID NO: 137376 - protein, 9 aa, Homo Sapiens
SAIGKILKF

SEQ ID NO: 137377 - protein, 9 aa, Homo Sapiens
SAIPHPLIM

SEQ ID NO: 137378 - protein, 9 aa, Homo Sapiens
SAITKPWEV

SEQ ID NO: 137379 - protein, 9 aa, Homo Sapiens
SAKFASCFY

SEQ ID NO: 137380 - protein, 9 aa, Homo Sapiens
SAKHIFKTY

SEQ ID NO: 137381 - protein, 9 aa, Homo Sapiens
SAKPEISAM

SEQ ID NO: 137382 - protein, 9 aa, Homo Sapiens
SAKPQTTVF

SEQ ID NO: 137383 - protein, 9 aa, Homo Sapiens
SAKSGAVTF

SEQ ID NO: 137384 - protein, 9 aa, Homo Sapiens
SAKSPTATF

SEQ ID NO: 137385 - protein, 9 aa, Homo Sapiens
SAKTPGFSV

SEQ ID NO: 137386 - protein, 9 aa, Homo Sapiens
SAKVKIAEF

SEQ ID NO: 137387 - protein, 9 aa, Homo Sapiens
SAMGSATRY

SEQ ID NO: 137388 - protein, 9 aa, Homo Sapiens
SAMKEFAYM

SEQ ID NO: 137389 - protein, 9 aa, Homo Sapiens
SAMMVESRY

SEQ ID NO: 137390 - protein, 9 aa, Homo Sapiens
SAMPTVRSF

SEQ ID NO: 137391 - protein, 9 aa, Homo Sapiens
SAMSNPRAM

SEQ ID NO: 137392 - protein, 9 aa, Homo Sapiens
SAMYSRKAM

SEQ ID NO: 137393 - protein, 9 aa, Homo Sapiens
SANADFANF

SEQ ID NO: 137394 - protein, 9 aa, Homo Sapiens
SANHNILQI

SEQ ID NO: 137395 - protein, 9 aa, Homo Sapiens
SANVSKVSF

SEQ ID NO: 137396 - protein, 9 aa, Homo Sapiens
SAQGKPLAL

SEQ ID NO: 137397 - protein, 9 aa, Homo Sapiens
SASDVHGNF

SEQ ID NO: 137398 - protein, 9 aa, Homo Sapiens
SASFLPKYF

SEQ ID NO: 137399 - protein, 9 aa, Homo Sapiens
SASGIYGNF

SEQ ID NO: 137400 - protein, 9 aa, Homo Sapiens
SASPHAAYY

SEQ ID NO: 137401 - protein, 9 aa, Homo Sapiens
SASPIFTHV

SEQ ID NO: 137402 - protein, 9 aa, Homo Sapiens
SATSVHTSV

SEQ ID NO: 137403 - protein, 9 aa, Homo Sapiens
SATYIAEEY

SEQ ID NO: 137404 - protein, 9 aa, Homo Sapiens
SAVGKIMKF

SEQ ID NO: 137405 - protein, 9 aa, Homo Sapiens
SAVNIIRTF

SEQ ID NO: 137406 - protein, 9 aa, Homo Sapiens
SAVPKVMKV

SEQ ID NO: 137407 - protein, 9 aa, Homo Sapiens
SAVPSTSTM

SEQ ID NO: 137408 - protein, 9 aa, Homo Sapiens
SAVTFVLTY

SEQ ID NO: 137409 - protein, 9 aa, Homo Sapiens
SAYAKSEEF

SEQ ID NO: 137410 - protein, 9 aa, Homo Sapiens
SAYAQIVQF

SEQ ID NO: 137411 - protein, 9 aa, Homo Sapiens
SAYARLIDY

SEQ ID NO: 137412 - protein, 9 aa, Homo Sapiens
SAYGSVKAY

SEQ ID NO: 137413 - protein, 9 aa, Homo Sapiens
SAYKRAAQF

SEQ ID NO: 137414 - protein, 9 aa, Homo Sapiens
SAYPHRLNL

SEQ ID NO: 137415 - protein, 9 aa, Homo Sapiens
SAYQHPASF

SEQ ID NO: 137416 - protein, 9 aa, Homo Sapiens
SAYQHPTTF

SEQ ID NO: 137417 - protein, 9 aa, Homo Sapiens
SAYQSITHY

SEQ ID NO: 137418 - protein, 9 aa, Homo Sapiens
SAYSDIVKM

SEQ ID NO: 137419 - protein, 9 aa, Homo Sapiens
SAYSGKVRY

SEQ ID NO: 137420 - protein, 9 aa, Homo Sapiens
SAYYALTKF

SEQ ID NO: 137421 - protein, 9 aa, Homo Sapiens
SGGPGPRVY

SEQ ID NO: 137422 - protein, 9 aa, Homo Sapiens
SGMGKTAVF

SEQ ID NO: 137423 - protein, 9 aa, Homo Sapiens
SGPGPAAAL

SEQ ID NO: 137424 - protein, 9 aa, Homo Sapiens
SIESIHSEM

SEQ ID NO: 137425 - protein, 9 aa, Homo Sapiens
SIIGRLLEV

SEQ ID NO: 137426 - protein, 9 aa, Homo Sapiens
SIKDRMAKY

SEQ ID NO: 137427 - protein, 9 aa, Homo Sapiens
SINGAITQF

SEQ ID NO: 137428 - protein, 9 aa, Homo Sapiens
SIPKGNSAL

SEQ ID NO: 137429 - protein, 9 aa, Homo Sapiens
SIRDGVRAY

SEQ ID NO: 137430 - protein, 9 aa, Homo Sapiens
SITRLIKKY

SEQ ID NO: 137431 - protein, 9 aa, Homo Sapiens
SPGAAVVML

SEQ ID NO: 137432 - protein, 9 aa, Homo Sapiens
SQADIKKAY

SEQ ID NO: 137433 - protein, 9 aa, Homo Sapiens
SQCQKLWKL

SEQ ID NO: 137434 - protein, 9 aa, Homo Sapiens
SQFGGGSQY

SEQ ID NO: 137435 - protein, 9 aa, Homo Sapiens
SQHYHQGYY

SEQ ID NO: 137436 - protein, 9 aa, Homo Sapiens
SQYPFPVTL

SEQ ID NO: 137437 - protein, 9 aa, Homo Sapiens
SQYQGVVVY

SEQ ID NO: 137438 - protein, 9 aa, Homo Sapiens
SSADIRKAY

SEQ ID NO: 137439 - protein, 9 aa, Homo Sapiens
SSHVTNVSF

SEQ ID NO: 137440 - protein, 9 aa, Homo Sapiens
SSPAPRTAL

SEQ ID NO: 137441 - protein, 9 aa, Homo Sapiens
SSQGTVRFF

SEQ ID NO: 137442 - protein, 9 aa, Homo Sapiens
SSSSLEKSY

SEQ ID NO: 137443 - protein, 9 aa, Homo Sapiens
SSTPIAPVF

SEQ ID NO: 137444 - protein, 9 aa, Homo Sapiens
STRDHLQTM

SEQ ID NO: 137445 - protein, 9 aa, Homo Sapiens
STYGRTPMY

SEQ ID NO: 137446 - protein, 9 aa, Homo Sapiens
SVASIKTGF

SEQ ID NO: 137447 - protein, 9 aa, Homo Sapiens
SVIDYQTHF

SEQ ID NO: 137448 - protein, 9 aa, Homo Sapiens
SVISHLLRV

SEQ ID NO: 137449 - protein, 9 aa, Homo Sapiens
SVKPASSSF

SEQ ID NO: 137450 - protein, 9 aa, Homo Sapiens
SVRSNLTSF

SEQ ID NO: 137451 - protein, 9 aa, Homo Sapiens
TAAAVGAVF

SEQ ID NO: 137452 - protein, 9 aa, Homo Sapiens
TAADIFKQY

SEQ ID NO: 137453 - protein, 9 aa, Homo Sapiens
TAFPGTGGF

SEQ ID NO: 137454 - protein, 9 aa, Homo Sapiens
TAHQINIGY

SEQ ID NO: 137455 - protein, 9 aa, Homo Sapiens
TAIGHINRY

SEQ ID NO: 137456 - protein, 9 aa, Homo Sapiens
TAKSVTCTY

SEQ ID NO: 137457 - protein, 9 aa, Homo Sapiens
TAMFIASKY

SEQ ID NO: 137458 - protein, 9 aa, Homo Sapiens
TASGVFSKF

SEQ ID NO: 137459 - protein, 9 aa, Homo Sapiens
TASPVIKAV

SEQ ID NO: 137460 - protein, 9 aa, Homo Sapiens
TAVYKVSEY

SEQ ID NO: 137461 - protein, 9 aa, Homo Sapiens
TAYPGQTQY

SEQ ID NO: 137462 - protein, 9 aa, Homo Sapiens
TIMAHVTEF

SEQ ID NO: 137463 - protein, 9 aa, Homo Sapiens
TINGHNAEV

SEQ ID NO: 137464 - protein, 9 aa, Homo Sapiens
VAAPLFELY

SEQ ID NO: 137465 - protein, 9 aa, Homo Sapiens
VAASNIVQM

SEQ ID NO: 137466 - protein, 9 aa, Homo Sapiens
VAFKKTFSY

SEQ ID NO: 137467 - protein, 9 aa, Homo Sapiens
VAFKNAKQF

SEQ ID NO: 137468 - protein, 9 aa, Homo Sapiens
VAFPSSSVY

SEQ ID NO: 137469 - protein, 9 aa, Homo Sapiens
VAFPTEIKV

SEQ ID NO: 137470 - protein, 9 aa, Homo Sapiens
VAIAKVKLY

SEQ ID NO: 137471 - protein, 9 aa, Homo Sapiens
VAINHIVDF

SEQ ID NO: 137472 - protein, 9 aa, Homo Sapiens
VAIQSVRCY

SEQ ID NO: 137473 - protein, 9 aa, Homo Sapiens
VAIVKALYY

SEQ ID NO: 137474 - protein, 9 aa, Homo Sapiens
VAKAIATTV

SEQ ID NO: 137475 - protein, 9 aa, Homo Sapiens
VAKDYVRLM

SEQ ID NO: 137476 - protein, 9 aa, Homo Sapiens
VAKESIPLF

SEQ ID NO: 137477 - protein, 9 aa, Homo Sapiens
VAKLILVNF

SEQ ID NO: 137478 - protein, 9 aa, Homo Sapiens
VAKMGITEY

SEQ ID NO: 137479 - protein, 9 aa, Homo Sapiens
VAMGRVVKV

SEQ ID NO: 137480 - protein, 9 aa, Homo Sapiens
VAMKFAQVF

SEQ ID NO: 137481 - protein, 9 aa, Homo Sapiens
VANALAHRY

SEQ ID NO: 137482 - protein, 9 aa, Homo Sapiens
VANPNSAIF

SEQ ID NO: 137483 - protein, 9 aa, Homo Sapiens
VAPPGCSHL

SEQ ID NO: 137484 - protein, 9 aa, Homo Sapiens
VAQKKASFL

SEQ ID NO: 137485 - protein, 9 aa, Homo Sapiens
VARDLRAEF

SEQ ID NO: 137486 - protein, 9 aa, Homo Sapiens
VARLIAIFF

SEQ ID NO: 137487 - protein, 9 aa, Homo Sapiens
VARPDVVEM

SEQ ID NO: 137488 - protein, 9 aa, Homo Sapiens
VASAIYAKY

SEQ ID NO: 137489 - protein, 9 aa, Homo Sapiens
VASEGIKRY

SEQ ID NO: 137490 - protein, 9 aa, Homo Sapiens
VASSVNTEF

SEQ ID NO: 137491 - protein, 9 aa, Homo Sapiens
VATSRIIKY

SEQ ID NO: 137492 - protein, 9 aa, Homo Sapiens
VAVGRALYY

SEQ ID NO: 137493 - protein, 9 aa, Homo Sapiens
VAVHVFSEF

SEQ ID NO: 137494 - protein, 9 aa, Homo Sapiens
VAVHVVDFF

SEQ ID NO: 137495 - protein, 9 aa, Homo Sapiens
VAVNKPAEF

SEQ ID NO: 137496 - protein, 9 aa, Homo Sapiens
VAYDSKQYY

SEQ ID NO: 137497 - protein, 9 aa, Homo Sapiens
VAYGKGTYF

SEQ ID NO: 137498 - protein, 9 aa, Homo Sapiens
VAYPCAILY

SEQ ID NO: 137499 - protein, 9 aa, Homo Sapiens
VIHKIFSKF

SEQ ID NO: 137500 - protein, 9 aa, Homo Sapiens
VINGNIKTV

SEQ ID NO: 137501 - protein, 9 aa, Homo Sapiens
VIRELKEQY

SEQ ID NO: 137502 - protein, 9 aa, Homo Sapiens
VNWPESLTL

SEQ ID NO: 137503 - protein, 9 aa, Homo Sapiens
VQGPVGTDF

SEQ ID NO: 137504 - protein, 9 aa, Homo Sapiens
VQSDLLHKY

SEQ ID NO: 137505 - protein, 9 aa, Homo Sapiens
VRDTKTSHF

SEQ ID NO: 137506 - protein, 9 aa, Homo Sapiens
VSAGIQTSF

SEQ ID NO: 137507 - protein, 9 aa, Homo Sapiens
VTAAHIKKF

SEQ ID NO: 137508 - protein, 9 aa, Homo Sapiens
VTKDPGVGM

SEQ ID NO: 137509 - protein, 9 aa, Homo Sapiens
VTKPVGGNY

SEQ ID NO: 137510 - protein, 9 aa, Homo Sapiens
VTYNYPVHY

SEQ ID NO: 137511 - protein, 9 aa, Homo Sapiens
VTYVPVTTF

SEQ ID NO: 137512 - protein, 9 aa, Homo Sapiens
VVKMPSGEF

SEQ ID NO: 137513 - protein, 9 aa, Homo Sapiens
VVKPPGSSL

SEQ ID NO: 137514 - protein, 9 aa, Homo Sapiens
VVNGKVEYF

SEQ ID NO: 137515 - protein, 9 aa, Homo Sapiens
VVPQFVVFY

SEQ ID NO: 137516 - protein, 9 aa, Homo Sapiens
VVREMTEGY

SEQ ID NO: 137517 - protein, 9 aa, Homo Sapiens
VVYPWTQRF

SEQ ID NO: 137518 - protein, 9 aa, Homo Sapiens
WAHAQVKRY

SEQ ID NO: 137519 - protein, 9 aa, Homo Sapiens
WARPLSVSF

SEQ ID NO: 137520 - protein, 9 aa, Homo Sapiens
WAYARTINV

SEQ ID NO: 137521 - protein, 9 aa, Homo Sapiens
WAYPRQVFI

SEQ ID NO: 137522 - protein, 9 aa, Homo Sapiens
YAAAQLRQY

SEQ ID NO: 137523 - protein, 9 aa, Homo Sapiens
YAAASHSYY

SEQ ID NO: 137524 - protein, 9 aa, Homo Sapiens
YAAELIERV

SEQ ID NO: 137525 - protein, 9 aa, Homo Sapiens
YAAGVHSVL

SEQ ID NO: 137526 - protein, 9 aa, Homo Sapiens
YAALHGEFY

SEQ ID NO: 137527 - protein, 9 aa, Homo Sapiens
YAANPGQLF

SEQ ID NO: 137528 - protein, 9 aa, Homo Sapiens
YAAPYKSDF

SEQ ID NO: 137529 - protein, 9 aa, Homo Sapiens
YAAQQAASY

SEQ ID NO: 137530 - protein, 9 aa, Homo Sapiens
YACSILYKT

SEQ ID NO: 137531 - protein, 9 aa, Homo Sapiens
YAFAHILTV

SEQ ID NO: 137532 - protein, 9 aa, Homo Sapiens
YAFDFARQS

SEQ ID NO: 137533 - protein, 9 aa, Homo Sapiens
YAFGGGCEL

SEQ ID NO: 137534 - protein, 9 aa, Homo Sapiens
YAFGSCINH

SEQ ID NO: 137535 - protein, 9 aa, Homo Sapiens
YAFNGTQRF

SEQ ID NO: 137536 - protein, 9 aa, Homo Sapiens
YAFNHSADF

SEQ ID NO: 137537 - protein, 9 aa, Homo Sapiens
YAFNMKATV

SEQ ID NO: 137538 - protein, 9 aa, Homo Sapiens
YAFPKAVSV

SEQ ID NO: 137539 - protein, 9 aa, Homo Sapiens
YAFPKAVTV

SEQ ID NO: 137540 - protein, 9 aa, Homo Sapiens
YAFPKEFPY

SEQ ID NO: 137541 - protein, 9 aa, Homo Sapiens
YAFPKSITV

SEQ ID NO: 137542 - protein, 9 aa, Homo Sapiens
YAFQPKCTY

SEQ ID NO: 137543 - protein, 9 aa, Homo Sapiens
YAFSGVEEL

SEQ ID NO: 137544 - protein, 9 aa, Homo Sapiens
YAFSLDSKY

SEQ ID NO: 137545 - protein, 9 aa, Homo Sapiens
YAFVRPVIL

SEQ ID NO: 137546 - protein, 9 aa, Homo Sapiens
YAHFPINVV

SEQ ID NO: 137547 - protein, 9 aa, Homo Sapiens
YAIDNPLHY

SEQ ID NO: 137548 - protein, 9 aa, Homo Sapiens
YAIEKIERI

SEQ ID NO: 137549 - protein, 9 aa, Homo Sapiens
YAIGLVMRL

SEQ ID NO: 137550 - protein, 9 aa, Homo Sapiens
YAIHGVLEV

SEQ ID NO: 137551 - protein, 9 aa, Homo Sapiens
YAIKNIHGV

SEQ ID NO: 137552 - protein, 9 aa, Homo Sapiens
YAISKPEVL

SEQ ID NO: 137553 - protein, 9 aa, Homo Sapiens
YAITRVLRL

SEQ ID NO: 137554 - protein, 9 aa, Homo Sapiens
YAKDDPLEF

SEQ ID NO: 137555 - protein, 9 aa, Homo Sapiens
YAKDGRVSY

SEQ ID NO: 137556 - protein, 9 aa, Homo Sapiens
YAKDKTCFY

SEQ ID NO: 137557 - protein, 9 aa, Homo Sapiens
YAKEKLESF

SEQ ID NO: 137558 - protein, 9 aa, Homo Sapiens
YAKIVEIPF

SEQ ID NO: 137559 - protein, 9 aa, Homo Sapiens
YAKNNIPII

SEQ ID NO: 137560 - protein, 9 aa, Homo Sapiens
YAKQYEEFY

SEQ ID NO: 137561 - protein, 9 aa, Homo Sapiens
YAKRPGIGL

SEQ ID NO: 137562 - protein, 9 aa, Homo Sapiens
YALNHTLSV

SEQ ID NO: 137563 - protein, 9 aa, Homo Sapiens
YAMKLLSKF

SEQ ID NO: 137564 - protein, 9 aa, Homo Sapiens
YAMTRAQRV

SEQ ID NO: 137565 - protein, 9 aa, Homo Sapiens
YANAKGIGY

SEQ ID NO: 137566 - protein, 9 aa, Homo Sapiens
YANAKIYKL

SEQ ID NO: 137567 - protein, 9 aa, Homo Sapiens
YANEVGEAF

SEQ ID NO: 137568 - protein, 9 aa, Homo Sapiens
YANSKAVTL

SEQ ID NO: 137569 - protein, 9 aa, Homo Sapiens
YANYYTREV

SEQ ID NO: 137570 - protein, 9 aa, Homo Sapiens
YARDETEFY

SEQ ID NO: 137571 - protein, 9 aa, Homo Sapiens
YARNDTVRF

SEQ ID NO: 137572 - protein, 9 aa, Homo Sapiens
YARTDGKVF

SEQ ID NO: 137573 - protein, 9 aa, Homo Sapiens
YARVVGSEY

SEQ ID NO: 137574 - protein, 9 aa, Homo Sapiens
YASDCASFF

SEQ ID NO: 137575 - protein, 9 aa, Homo Sapiens
YASENVNKL

SEQ ID NO: 137576 - protein, 9 aa, Homo Sapiens
YASGAAAYY

SEQ ID NO: 137577 - protein, 9 aa, Homo Sapiens
YASGKISQF

SEQ ID NO: 137578 - protein, 9 aa, Homo Sapiens
YASNITSVL

SEQ ID NO: 137579 - protein, 9 aa, Homo Sapiens
YASSKLLKI

SEQ ID NO: 137580 - protein, 9 aa, Homo Sapiens
YASSPGGVY

SEQ ID NO: 137581 - protein, 9 aa, Homo Sapiens
YATFIVTNY

SEQ ID NO: 137582 - protein, 9 aa, Homo Sapiens
YATIILSKM

SEQ ID NO: 137583 - protein, 9 aa, Homo Sapiens
YAVDRAITH

SEQ ID NO: 137584 - protein, 9 aa, Homo Sapiens
YAVGDVEKM

SEQ ID NO: 137585 - protein, 9 aa, Homo Sapiens
YAVSELAGH

SEQ ID NO: 137586 - protein, 9 aa, Homo Sapiens
YAYEKPHVV

SEQ ID NO: 137587 - protein, 9 aa, Homo Sapiens
YAYPYSYYY

SEQ ID NO: 137588 - protein, 9 aa, Homo Sapiens
YAYRDAVFL

SEQ ID NO: 137589 - protein, 9 aa, Homo Sapiens
YGMERVWCV

SEQ ID NO: 137590 - protein, 9 aa, Homo Sapiens
YGNGQVHLY

SEQ ID NO: 137591 - protein, 9 aa, Homo Sapiens
YGYDNVKEY

SEQ ID NO: 137592 - protein, 9 aa, Homo Sapiens
YGYEHILTL

SEQ ID NO: 137593 - protein, 9 aa, Homo Sapiens
YGYGHESEL

SEQ ID NO: 137594 - protein, 9 aa, Homo Sapiens
YGYSKLIEL

SEQ ID NO: 137595 - protein, 9 aa, Homo Sapiens
YIAPLFDKF

SEQ ID NO: 137596 - protein, 9 aa, Homo Sapiens
YIISGLTGF

SEQ ID NO: 137597 - protein, 9 aa, Homo Sapiens
YIKEYVTCH

SEQ ID NO: 137598 - protein, 9 aa, Homo Sapiens
YIRDLALEY

SEQ ID NO: 137599 - protein, 9 aa, Homo Sapiens
YIRGSTIKY

SEQ ID NO: 137600 - protein, 9 aa, Homo Sapiens
YIRPNIAQK

SEQ ID NO: 137601 - protein, 9 aa, Homo Sapiens
YIVKWPLSL

SEQ ID NO: 137602 - protein, 9 aa, Homo Sapiens
YIYPKHLKY

SEQ ID NO: 137603 - protein, 9 aa, Homo Sapiens
YLADIFTKL

SEQ ID NO: 137604 - protein, 9 aa, Homo Sapiens
YLADLYHFV

SEQ ID NO: 137605 - protein, 9 aa, Homo Sapiens
YLKDLIEEV

SEQ ID NO: 137606 - protein, 9 aa, Homo Sapiens
YLRELLTTM

SEQ ID NO: 137607 - protein, 9 aa, Homo Sapiens
YLSPKLWAL

SEQ ID NO: 137608 - protein, 9 aa, Homo Sapiens
YLYPDQTHF

SEQ ID NO: 137609 - protein, 9 aa, Homo Sapiens
YQADIERMY

SEQ ID NO: 137610 - protein, 9 aa, Homo Sapiens
YQASYNQSF

SEQ ID NO: 137611 - protein, 9 aa, Homo Sapiens
YQFTGIKKY

SEQ ID NO: 137612 - protein, 9 aa, Homo Sapiens
YQHGGVTGL

SEQ ID NO: 137613 - protein, 9 aa, Homo Sapiens
YQVGINQRF

SEQ ID NO: 137614 - protein, 9 aa, Homo Sapiens
YQYGAVVTL

SEQ ID NO: 137615 - protein, 9 aa, Homo Sapiens
YQYPRPLLI

SEQ ID NO: 137616 - protein, 9 aa, Homo Sapiens
YQYPVIIHL

SEQ ID NO: 137617 - protein, 9 aa, Homo Sapiens
YSFDYPSDM

SEQ ID NO: 137618 - protein, 9 aa, Homo Sapiens
YSFGGCHRY

SEQ ID NO: 137619 - protein, 9 aa, Homo Sapiens
YSGPSREFF

SEQ ID NO: 137620 - protein, 9 aa, Homo Sapiens
YSIDKAKKF

SEQ ID NO: 137621 - protein, 9 aa, Homo Sapiens
YSKPRLATF

SEQ ID NO: 137622 - protein, 9 aa, Homo Sapiens
YSMPSTHAM

SEQ ID NO: 137623 - protein, 9 aa, Homo Sapiens
YSNGFCTVY

SEQ ID NO: 137624 - protein, 9 aa, Homo Sapiens
YSSENISNF

SEQ ID NO: 137625 - protein, 9 aa, Homo Sapiens
YSSPYPQEY

SEQ ID NO: 137626 - protein, 9 aa, Homo Sapiens
YSVDRLYEL

SEQ ID NO: 137627 - protein, 9 aa, Homo Sapiens
YSYFSPRTM

SEQ ID NO: 137628 - protein, 9 aa, Homo Sapiens
YSYPELVKM

SEQ ID NO: 137629 - protein, 9 aa, Homo Sapiens
YTAQPTQGY

SEQ ID NO: 137630 - protein, 9 aa, Homo Sapiens
YTCPFVEKF

SEQ ID NO: 137631 - protein, 9 aa, Homo Sapiens
YTFGRIVIY

SEQ ID NO: 137632 - protein, 9 aa, Homo Sapiens
YTIPPGHQV

SEQ ID NO: 137633 - protein, 9 aa, Homo Sapiens
YTKAWEEYY

SEQ ID NO: 137634 - protein, 9 aa, Homo Sapiens
YTNGKCVIL

SEQ ID NO: 137635 - protein, 9 aa, Homo Sapiens
YTNKYSSQF

SEQ ID NO: 137636 - protein, 9 aa, Homo Sapiens
YTRPGLPTF

SEQ ID NO: 137637 - protein, 9 aa, Homo Sapiens
YTSGTFRTV

SEQ ID NO: 137638 - protein, 9 aa, Homo Sapiens
YTTDRVMTV

SEQ ID NO: 137639 - protein, 9 aa, Homo Sapiens
YTYRGPKAF

SEQ ID NO: 137640 - protein, 9 aa, Homo Sapiens
YVAEILPKY

SEQ ID NO: 137641 - protein, 9 aa, Homo Sapiens
YVFPGVTRL

SEQ ID NO: 137642 - protein, 9 aa, Homo Sapiens
YVHALVAYF

SEQ ID NO: 137643 - protein, 9 aa, Homo Sapiens
YVIPKTGFY

SEQ ID NO: 137644 - protein, 9 aa, Homo Sapiens
YVIQKFFEF

SEQ ID NO: 137645 - protein, 9 aa, Homo Sapiens
YVKDRVEKV

SEQ ID NO: 137646 - protein, 9 aa, Homo Sapiens
YVKSIVQEY

SEQ ID NO: 137647 - protein, 9 aa, Homo Sapiens
YVSDIQELY

SEQ ID NO: 137648 - protein, 9 aa, Homo Sapiens
YVTTSTRTY

SEQ ID NO: 137649 - protein, 9 aa, Homo Sapiens
YVYPKYLKY

SEQ ID NO: 137650 - protein, 9 aa, Homo Sapiens
YVYPLQLKY

SEQ ID NO: 137651 - protein, 10 aa, Homo Sapiens
AAAAAAAAAY

SEQ ID NO: 137652 - protein, 10 aa, Homo Sapiens
AAAAAAAAQY

SEQ ID NO: 137653 - protein, 10 aa, Homo Sapiens
AAAAAAAATM

SEQ ID NO: 137654 - protein, 10 aa, Homo Sapiens
AAAAAAALLY

SEQ ID NO: 137655 - protein, 10 aa, Homo Sapiens
AAAAAAATMA

SEQ ID NO: 137656 - protein, 10 aa, Homo Sapiens
AAAAAAQSVY

SEQ ID NO: 137657 - protein, 10 aa, Homo Sapiens
AAFGGNPKSV

SEQ ID NO: 137658 - protein, 10 aa, Homo Sapiens
AAFPGASLYL

SEQ ID NO: 137659 - protein, 10 aa, Homo Sapiens
AIAQFPYVEF

SEQ ID NO: 137660 - protein, 10 aa, Homo Sapiens
ATPVFNPTVF

SEQ ID NO: 137661 - protein, 10 aa, Homo Sapiens
FADPHGKRVF

SEQ ID NO: 137662 - protein, 10 aa, Homo Sapiens
FADPHSKRVF

SEQ ID NO: 137663 - protein, 10 aa, Homo Sapiens
FAFADAPNHY

SEQ ID NO: 137664 - protein, 10 aa, Homo Sapiens
FAHQGNPAVY

SEQ ID NO: 137665 - protein, 10 aa, Homo Sapiens
FAIDLNGKKY

SEQ ID NO: 137666 - protein, 10 aa, Homo Sapiens
FAIGGIARTY

SEQ ID NO: 137667 - protein, 10 aa, Homo Sapiens
FAIGGSGSSY

SEQ ID NO: 137668 - protein, 10 aa, Homo Sapiens
FAIGSQVSEH

SEQ ID NO: 137669 - protein, 10 aa, Homo Sapiens
FAKGPTLTVY

SEQ ID NO: 137670 - protein, 10 aa, Homo Sapiens
FAKPRNQGGY

SEQ ID NO: 137671 - protein, 10 aa, Homo Sapiens
FAPNFKESEM

SEQ ID NO: 137672 - protein, 10 aa, Homo Sapiens
FAWEPNGSKF

SEQ ID NO: 137673 - protein, 10 aa, Homo Sapiens
FAYGGHPYPF

SEQ ID NO: 137674 - protein, 10 aa, Homo Sapiens
FAYPNRPDVL

SEQ ID NO: 137675 - protein, 10 aa, Homo Sapiens
FAYSDSRVGF

SEQ ID NO: 137676 - protein, 10 aa, Homo Sapiens
FIIDTRDAGY

SEQ ID NO: 137677 - protein, 10 aa, Homo Sapiens
FIPSSVPATF

SEQ ID NO: 137678 - protein, 10 aa, Homo Sapiens
FLFDGSPTYV

SEQ ID NO: 137679 - protein, 10 aa, Homo Sapiens
FQASLTGRLL

SEQ ID NO: 137680 - protein, 10 aa, Homo Sapiens
FQPPFQPGRM

SEQ ID NO: 137681 - protein, 10 aa, Homo Sapiens
FSFGGKLVTF

SEQ ID NO: 137682 - protein, 10 aa, Homo Sapiens
FTNQGTVIHF

SEQ ID NO: 137683 - protein, 10 aa, Homo Sapiens
FTPFVDPRVY

SEQ ID NO: 137684 - protein, 10 aa, Homo Sapiens
FVHWYVGEGM

SEQ ID NO: 137685 - protein, 10 aa, Homo Sapiens
FVRAQELHTF

SEQ ID NO: 137686 - protein, 10 aa, Homo Sapiens
GAIGGTPPAF

SEQ ID NO: 137687 - protein, 10 aa, Homo Sapiens
GIPTHHPRVY

SEQ ID NO: 137688 - protein, 10 aa, Homo Sapiens
HVPNFIFDEF

SEQ ID NO: 137689 - protein, 10 aa, Homo Sapiens
IAKSGTKAFM

SEQ ID NO: 137690 - protein, 10 aa, Homo Sapiens
IALSLASFRG

SEQ ID NO: 137691 - protein, 10 aa, Homo Sapiens
ISHDTFGTTY

SEQ ID NO: 137692 - protein, 10 aa, Homo Sapiens
IVKKPGNIYY

SEQ ID NO: 137693 - protein, 10 aa, Homo Sapiens
KAFDTAGNGY

SEQ ID NO: 137694 - protein, 10 aa, Homo Sapiens
KAFISNLNEM

SEQ ID NO: 137695 - protein, 10 aa, Homo Sapiens
KLFPGSPAIY

SEQ ID NO: 137696 - protein, 10 aa, Homo Sapiens
KLPEFTKSEY

SEQ ID NO: 137697 - protein, 10 aa, Homo Sapiens
KLPNFGFVVF

SEQ ID NO: 137698 - protein, 10 aa, Homo Sapiens
KVAEAAIQIF

SEQ ID NO: 137699 - protein, 10 aa, Homo Sapiens
LAAADISAYY

SEQ ID NO: 137700 - protein, 10 aa, Homo Sapiens
LAADFEIGHF

SEQ ID NO: 137701 - protein, 10 aa, Homo Sapiens
LALAPAGFSY

SEQ ID NO: 137702 - protein, 10 aa, Homo Sapiens
LARDLKAVKY

SEQ ID NO: 137703 - protein, 10 aa, Homo Sapiens
LAYGAQAASY

SEQ ID NO: 137704 - protein, 10 aa, Homo Sapiens
MAYGASFLSF

SEQ ID NO: 137705 - protein, 10 aa, Homo Sapiens
RAATPTLTTF

SEQ ID NO: 137706 - protein, 10 aa, Homo Sapiens
RALPFVPMSY

SEQ ID NO: 137707 - protein, 10 aa, Homo Sapiens
RAYPHNLMTF

SEQ ID NO: 137708 - protein, 10 aa, Homo Sapiens
RIPEFNMAAF

SEQ ID NO: 137709 - protein, 10 aa, Homo Sapiens
RNFDTGLQEY

SEQ ID NO: 137710 - protein, 10 aa, Homo Sapiens
RTVDWALAEY

SEQ ID NO: 137711 - protein, 10 aa, Homo Sapiens
SAAAPAGTTF

SEQ ID NO: 137712 - protein, 10 aa, Homo Sapiens
SAANPRGVFM

SEQ ID NO: 137713 - protein, 10 aa, Homo Sapiens
SACGRTVSLF

SEQ ID NO: 137714 - protein, 10 aa, Homo Sapiens
SACRTSGQTF

SEQ ID NO: 137715 - protein, 10 aa, Homo Sapiens
SAKPPESEGF

SEQ ID NO: 137716 - protein, 10 aa, Homo Sapiens
SIKDPKDLKF

SEQ ID NO: 137717 - protein, 10 aa, Homo Sapiens
SLLGKLLGTV

SEQ ID NO: 137718 - protein, 10 aa, Homo Sapiens
SLPNFKQNEF

SEQ ID NO: 137719 - protein, 10 aa, Homo Sapiens
TAKRPSDIKF

SEQ ID NO: 137720 - protein, 10 aa, Homo Sapiens
VAAMPRPVSY

SEQ ID NO: 137721 - protein, 10 aa, Homo Sapiens
VAAPPPKNSF

SEQ ID NO: 137722 - protein, 10 aa, Homo Sapiens
VAFTPDGNHF

SEQ ID NO: 137723 - protein, 10 aa, Homo Sapiens
VAKEARNVTM

SEQ ID NO: 137724 - protein, 10 aa, Homo Sapiens
VAMNPTNTVF

SEQ ID NO: 137725 - protein, 10 aa, Homo Sapiens
VLPHQPLATY

SEQ ID NO: 137726 - protein, 10 aa, Homo Sapiens
VLSAADKGNV

SEQ ID NO: 137727 - protein, 10 aa, Homo Sapiens
YAADIFYSRY

SEQ ID NO: 137728 - protein, 10 aa, Homo Sapiens
YAAPHPLQSY

SEQ ID NO: 137729 - protein, 10 aa, Homo Sapiens
YAFGRVFSGL

SEQ ID NO: 137730 - protein, 10 aa, Homo Sapiens
YAFPKAVSVF

SEQ ID NO: 137731 - protein, 10 aa, Homo Sapiens
YAFPKSITVF

SEQ ID NO: 137732 - protein, 10 aa, Homo Sapiens
YALDPLHPVM

SEQ ID NO: 137733 - protein, 10 aa, Homo Sapiens
YANDFASEYY

SEQ ID NO: 137734 - protein, 10 aa, Homo Sapiens
YATTVIPRVY

SEQ ID NO: 137735 - protein, 10 aa, Homo Sapiens
YGYNNDNQEF

SEQ ID NO: 137736 - protein, 10 aa, Homo Sapiens
YINPAKLTPY

SEQ ID NO: 137737 - protein, 10 aa, Homo Sapiens
YIPEHSPEYY

SEQ ID NO: 137738 - protein, 10 aa, Homo Sapiens
YLAPFSLSNY

SEQ ID NO: 137739 - protein, 10 aa, Homo Sapiens
YLKRPGLTYL

SEQ ID NO: 137740 - protein, 10 aa, Homo Sapiens
YLPDFRFTPF

SEQ ID NO: 137741 - protein, 10 aa, Homo Sapiens
YMIDPSGVSY

SEQ ID NO: 137742 - protein, 10 aa, Homo Sapiens
YQFTGIKKYF

SEQ ID NO: 137743 - protein, 10 aa, Homo Sapiens
YQRDGYQQNF

SEQ ID NO: 137744 - protein, 10 aa, Homo Sapiens
YSYSREYNEY

SEQ ID NO: 137745 - protein, 10 aa, Homo Sapiens
YTNGSFGSNF

SEQ ID NO: 137746 - protein, 10 aa, Homo Sapiens
YVIEPHSMEF

SEQ ID NO: 137747 - protein, 10 aa, Homo Sapiens
YVIPHPVHAF

SEQ ID NO: 137748 - protein, 10 aa, Homo Sapiens
YVNPANTHQF

SEQ ID NO: 137749 - protein, 11 aa, Homo Sapiens
AAAAAAAAATY

SEQ ID NO: 137750 - protein, 11 aa, Homo Sapiens
AAAAAAAALLY

SEQ ID NO: 137751 - protein, 11 aa, Homo Sapiens
AAAAAAATARY

SEQ ID NO: 137752 - protein, 11 aa, Homo Sapiens
AAAQAASQHVF

SEQ ID NO: 137753 - protein, 11 aa, Homo Sapiens
AAFQPNQYQML

SEQ ID NO: 137754 - protein, 11 aa, Homo Sapiens
AAINPELLQLL

SEQ ID NO: 137755 - protein, 11 aa, Homo Sapiens
AAKDPANGRQF

SEQ ID NO: 137756 - protein, 11 aa, Homo Sapiens
AFLEQMSKAFL

SEQ ID NO: 137757 - protein, 11 aa, Homo Sapiens
AVRDISEASVF

SEQ ID NO: 137758 - protein, 11 aa, Homo Sapiens
EVVEEAENGRD

SEQ ID NO: 137759 - protein, 11 aa, Homo Sapiens
FAALVASKVFY

SEQ ID NO: 137760 - protein, 11 aa, Homo Sapiens
FAKPVYPGQTL

SEQ ID NO: 137761 - protein, 11 aa, Homo Sapiens
FAKSVSFSDVF

SEQ ID NO: 137762 - protein, 11 aa, Homo Sapiens
FAVDPEKIQLY

SEQ ID NO: 137763 - protein, 11 aa, Homo Sapiens
FAYDGKDYLTL

SEQ ID NO: 137764 - protein, 11 aa, Homo Sapiens
FSKYPASSSVF

SEQ ID NO: 137765 - protein, 11 aa, Homo Sapiens
FVYDVTKMTSF

SEQ ID NO: 137766 - protein, 11 aa, Homo Sapiens
GIHETTFNSIM

SEQ ID NO: 137767 - protein, 11 aa, Homo Sapiens
HATVATQTQFF

SEQ ID NO: 137768 - protein, 11 aa, Homo Sapiens
HTSDVPGKLIY

SEQ ID NO: 137769 - protein, 11 aa, Homo Sapiens
KAAEAAASAYY

SEQ ID NO: 137770 - protein, 11 aa, Homo Sapiens
LAAAAAASYQV

SEQ ID NO: 137771 - protein, 11 aa, Homo Sapiens
LAAALPDLCGG

SEQ ID NO: 137772 - protein, 11 aa, Homo Sapiens
LAKDPKLQQGY

SEQ ID NO: 137773 - protein, 11 aa, Homo Sapiens
LALDPSLVPTF

SEQ ID NO: 137774 - protein, 11 aa, Homo Sapiens
LSRDPETLVGY

SEQ ID NO: 137775 - protein, 11 aa, Homo Sapiens
RAAAAAAAATM

SEQ ID NO: 137776 - protein, 11 aa, Homo Sapiens
RIMDPDVITGY

SEQ ID NO: 137777 - protein, 11 aa, Homo Sapiens
SAAAAAAAAAY

SEQ ID NO: 137778 - protein, 11 aa, Homo Sapiens
SAAAPRQPGLM

SEQ ID NO: 137779 - protein, 11 aa, Homo Sapiens
SAVNPEHLSYF

SEQ ID NO: 137780 - protein, 11 aa, Homo Sapiens
SAYGEVGRVFF

SEQ ID NO: 137781 - protein, 11 aa, Homo Sapiens
SIKDVLDSEGY

SEQ ID NO: 137782 - protein, 11 aa, Homo Sapiens
SSAKVANASYY

SEQ ID NO: 137783 - protein, 11 aa, Homo Sapiens
SSINPDHLSYF

SEQ ID NO: 137784 - protein, 11 aa, Homo Sapiens
SSINPDHLTYF

SEQ ID NO: 137785 - protein, 11 aa, Homo Sapiens
STINPDHLSYF

SEQ ID NO: 137786 - protein, 11 aa, Homo Sapiens
SVIDSAELQAY

SEQ ID NO: 137787 - protein, 11 aa, Homo Sapiens
SVNSHAATTQY

SEQ ID NO: 137788 - protein, 11 aa, Homo Sapiens
TTIDPRWLVEF

SEQ ID NO: 137789 - protein, 11 aa, Homo Sapiens
VAIQPDVFSHY

SEQ ID NO: 137790 - protein, 11 aa, Homo Sapiens
VAMSPELIQQF

SEQ ID NO: 137791 - protein, 11 aa, Homo Sapiens
VANPNSAIFGG

SEQ ID NO: 137792 - protein, 11 aa, Homo Sapiens
VAQNPANMSKY

SEQ ID NO: 137793 - protein, 11 aa, Homo Sapiens
VAYPHDGKIFF

SEQ ID NO: 137794 - protein, 11 aa, Homo Sapiens
YAISPGLDITF

SEQ ID NO: 137795 - protein, 11 aa, Homo Sapiens
YAKSSVGETVY

SEQ ID NO: 137796 - protein, 11 aa, Homo Sapiens
YAQDPSTGCYM

SEQ ID NO: 137797 - protein, 11 aa, Homo Sapiens
YARYSGSYNDY

SEQ ID NO: 137798 - protein, 11 aa, Homo Sapiens
YASGRTTGIVM

SEQ ID NO: 137799 - protein, 11 aa, Homo Sapiens
YAWESSAGGSF

SEQ ID NO: 137800 - protein, 11 aa, Homo Sapiens
YIAGHPAFVNY

SEQ ID NO: 137801 - protein, 11 aa, Homo Sapiens
YLFEPHSGEEY

SEQ ID NO: 137802 - protein, 11 aa, Homo Sapiens
YQIDITTENQY

SEQ ID NO: 137803 - protein, 8 aa, Homo Sapiens
AAAQLPSL

SEQ ID NO: 137804 - protein, 8 aa, Homo Sapiens
AAAVLFRM

SEQ ID NO: 137805 - protein, 8 aa, Homo Sapiens
AAGPGFSL

SEQ ID NO: 137806 - protein, 8 aa, Homo Sapiens
AAGVVLEM

SEQ ID NO: 137807 - protein, 8 aa, Homo Sapiens
AAHEFTVY

SEQ ID NO: 137808 - protein, 8 aa, Homo Sapiens
AAIELPSL

SEQ ID NO: 137809 - protein, 8 aa, Homo Sapiens
AASVRPVL

SEQ ID NO: 137810 - protein, 8 aa, Homo Sapiens
AATIILRE

SEQ ID NO: 137811 - protein, 8 aa, Homo Sapiens
AATILREL

SEQ ID NO: 137812 - protein, 8 aa, Homo Sapiens
AFAEALLL

SEQ ID NO: 137813 - protein, 8 aa, Homo Sapiens
AGGKILTF

SEQ ID NO: 137814 - protein, 8 aa, Homo Sapiens
ALKEEIAL

SEQ ID NO: 137815 - protein, 8 aa, Homo Sapiens
AMGPILEF

SEQ ID NO: 137816 - protein, 8 aa, Homo Sapiens
ASIPRPSI

SEQ ID NO: 137817 - protein, 8 aa, Homo Sapiens
ASYLLAAL

SEQ ID NO: 137818 - protein, 8 aa, Homo Sapiens
ASYVHYVF

SEQ ID NO: 137819 - protein, 8 aa, Homo Sapiens
FAAEAIAM

SEQ ID NO: 137820 - protein, 8 aa, Homo Sapiens
FAAEILHR

SEQ ID NO: 137821 - protein, 8 aa, Homo Sapiens
FAAFLTEL

SEQ ID NO: 137822 - protein, 8 aa, Homo Sapiens
FAALLHEY

SEQ ID NO: 137823 - protein, 8 aa, Homo Sapiens
FAASLARL

SEQ ID NO: 137824 - protein, 8 aa, Homo Sapiens
FAASLLAM

SEQ ID NO: 137825 - protein, 8 aa, Homo Sapiens
FAAVIQAL

SEQ ID NO: 137826 - protein, 8 aa, Homo Sapiens
FAEHRPIL

SEQ ID NO: 137827 - protein, 8 aa, Homo Sapiens
FAELLRAL

SEQ ID NO: 137828 - protein, 8 aa, Homo Sapiens
FAFHLRVL

SEQ ID NO: 137829 - protein, 8 aa, Homo Sapiens
FAFNIMEI

SEQ ID NO: 137830 - protein, 8 aa, Homo Sapiens
FAFSLSVM

SEQ ID NO: 137831 - protein, 8 aa, Homo Sapiens
FAFVHISF

SEQ ID NO: 137832 - protein, 8 aa, Homo Sapiens
FAFVLLDT

SEQ ID NO: 137833 - protein, 8 aa, Homo Sapiens
FAGSFLEY

SEQ ID NO: 137834 - protein, 8 aa, Homo Sapiens
FAHGLGEL

SEQ ID NO: 137835 - protein, 8 aa, Homo Sapiens
FAHILTVL

SEQ ID NO: 137836 - protein, 8 aa, Homo Sapiens
FAHSFIEL

SEQ ID NO: 137837 - protein, 8 aa, Homo Sapiens
FAIILKSM

SEQ ID NO: 137838 - protein, 8 aa, Homo Sapiens
FAISTGSL

SEQ ID NO: 137839 - protein, 8 aa, Homo Sapiens
FAKSLAML

SEQ ID NO: 137840 - protein, 8 aa, Homo Sapiens
FALAHAAF

SEQ ID NO: 137841 - protein, 8 aa, Homo Sapiens
FALEHLEM

SEQ ID NO: 137842 - protein, 8 aa, Homo Sapiens
FALLLPVY

SEQ ID NO: 137843 - protein, 8 aa, Homo Sapiens
FALNHPEL

SEQ ID NO: 137844 - protein, 8 aa, Homo Sapiens
FALVLSSM

SEQ ID NO: 137845 - protein, 8 aa, Homo Sapiens
FASDPILY

SEQ ID NO: 137846 - protein, 8 aa, Homo Sapiens
FASVFEKY

SEQ ID NO: 137847 - protein, 8 aa, Homo Sapiens
FATVVEEL

SEQ ID NO: 137848 - protein, 8 aa, Homo Sapiens
FAVALPQL

SEQ ID NO: 137849 - protein, 8 aa, Homo Sapiens
FAVTLETV

SEQ ID NO: 137850 - protein, 8 aa, Homo Sapiens
FAWGHDEL

SEQ ID NO: 137851 - protein, 8 aa, Homo Sapiens
FFRLFPEY

SEQ ID NO: 137852 - protein, 8 aa, Homo Sapiens
FGFDLPAV

SEQ ID NO: 137853 - protein, 8 aa, Homo Sapiens
FGGEPLSY

SEQ ID NO: 137854 - protein, 8 aa, Homo Sapiens
FGHEFLEF

SEQ ID NO: 137855 - protein, 8 aa, Homo Sapiens
FGILLTEI

SEQ ID NO: 137856 - protein, 8 aa, Homo Sapiens
FGIVLYEL

SEQ ID NO: 137857 - protein, 8 aa, Homo Sapiens
FGLVLQTL

SEQ ID NO: 137858 - protein, 8 aa, Homo Sapiens
FGTVLTEH

SEQ ID NO: 137859 - protein, 8 aa, Homo Sapiens
FGVLLMEV

SEQ ID NO: 137860 - protein, 8 aa, Homo Sapiens
FGVLLYEM

SEQ ID NO: 137861 - protein, 8 aa, Homo Sapiens
FGVTLHEL

SEQ ID NO: 137862 - protein, 8 aa, Homo Sapiens
FGVTLYEL

SEQ ID NO: 137863 - protein, 8 aa, Homo Sapiens
FGVVLDEI

SEQ ID NO: 137864 - protein, 8 aa, Homo Sapiens
FGYVLPII

SEQ ID NO: 137865 - protein, 8 aa, Homo Sapiens
FIAKLLEL

SEQ ID NO: 137866 - protein, 8 aa, Homo Sapiens
FIFQQPEA

SEQ ID NO: 137867 - protein, 8 aa, Homo Sapiens
FIGEKAVL

SEQ ID NO: 137868 - protein, 8 aa, Homo Sapiens
FIGPALLF

SEQ ID NO: 137869 - protein, 8 aa, Homo Sapiens
FIGYPITL

SEQ ID NO: 137870 - protein, 8 aa, Homo Sapiens
FIHEFISF

SEQ ID NO: 137871 - protein, 8 aa, Homo Sapiens
FIIILNHM

SEQ ID NO: 137872 - protein, 8 aa, Homo Sapiens
FIIKKPEM

SEQ ID NO: 137873 - protein, 8 aa, Homo Sapiens
FILLLREV

SEQ ID NO: 137874 - protein, 8 aa, Homo Sapiens
FIQLLPVL

SEQ ID NO: 137875 - protein, 8 aa, Homo Sapiens
FIWLHDSF

SEQ ID NO: 137876 - protein, 8 aa, Homo Sapiens
FIYEFEHF

SEQ ID NO: 137877 - protein, 8 aa, Homo Sapiens
FLHILPAH

SEQ ID NO: 137878 - protein, 8 aa, Homo Sapiens
FLHVLSEL

SEQ ID NO: 137879 - protein, 8 aa, Homo Sapiens
FLQQPRPL

SEQ ID NO: 137880 - protein, 8 aa, Homo Sapiens
FQVLLAEL

SEQ ID NO: 137881 - protein, 8 aa, Homo Sapiens
FSATLPKL

SEQ ID NO: 137882 - protein, 8 aa, Homo Sapiens
FSFQRPLL

SEQ ID NO: 137883 - protein, 8 aa, Homo Sapiens
FSFRHLEL

SEQ ID NO: 137884 - protein, 8 aa, Homo Sapiens
FSFVMPSL

SEQ ID NO: 137885 - protein, 8 aa, Homo Sapiens
FSGPAITL

SEQ ID NO: 137886 - protein, 8 aa, Homo Sapiens
FSHLLEIL

SEQ ID NO: 137887 - protein, 8 aa, Homo Sapiens
FSHLQPTL

SEQ ID NO: 137888 - protein, 8 aa, Homo Sapiens
FSHQLLEL

SEQ ID NO: 137889 - protein, 8 aa, Homo Sapiens
FSIFLQEM

SEQ ID NO: 137890 - protein, 8 aa, Homo Sapiens
FSKIRPQL

SEQ ID NO: 137891 - protein, 8 aa, Homo Sapiens
FSPVGSVL

SEQ ID NO: 137892 - protein, 8 aa, Homo Sapiens
FSQIQPKL

SEQ ID NO: 137893 - protein, 8 aa, Homo Sapiens
FSQLLHQI

SEQ ID NO: 137894 - protein, 8 aa, Homo Sapiens
FSQSLQEL

SEQ ID NO: 137895 - protein, 8 aa, Homo Sapiens
FSRVALEF

SEQ ID NO: 137896 - protein, 8 aa, Homo Sapiens
FSSQIFSL

SEQ ID NO: 137897 - protein, 8 aa, Homo Sapiens
FSSVLQEI

SEQ ID NO: 137898 - protein, 8 aa, Homo Sapiens
FSTNLQRL

SEQ ID NO: 137899 - protein, 8 aa, Homo Sapiens
FSVSLGEL

SEQ ID NO: 137900 - protein, 8 aa, Homo Sapiens
FSYAGFEM

SEQ ID NO: 137901 - protein, 8 aa, Homo Sapiens
FSYILPIL

SEQ ID NO: 137902 - protein, 8 aa, Homo Sapiens
FSYVSPEL

SEQ ID NO: 137903 - protein, 8 aa, Homo Sapiens
FTADPLSL

SEQ ID NO: 137904 - protein, 8 aa, Homo Sapiens
FTIIVAEL

SEQ ID NO: 137905 - protein, 8 aa, Homo Sapiens
FTLNLREV

SEQ ID NO: 137906 - protein, 8 aa, Homo Sapiens
FTMGGPAI

SEQ ID NO: 137907 - protein, 8 aa, Homo Sapiens
FTQKLQEL

SEQ ID NO: 137908 - protein, 8 aa, Homo Sapiens
FTVLIHEL

SEQ ID NO: 137909 - protein, 8 aa, Homo Sapiens
FTYLHRAL

SEQ ID NO: 137910 - protein, 8 aa, Homo Sapiens
FVAEFEEF

SEQ ID NO: 137911 - protein, 8 aa, Homo Sapiens
FVEVGRLG

SEQ ID NO: 137912 - protein, 8 aa, Homo Sapiens
FVEVGRVA

SEQ ID NO: 137913 - protein, 8 aa, Homo Sapiens
FVFTHSPF

SEQ ID NO: 137914 - protein, 8 aa, Homo Sapiens
FVIKRPEL

SEQ ID NO: 137915 - protein, 8 aa, Homo Sapiens
FVLLLQVL

SEQ ID NO: 137916 - protein, 8 aa, Homo Sapiens
FVNVVPTF

SEQ ID NO: 137917 - protein, 8 aa, Homo Sapiens
FVPVANEL

SEQ ID NO: 137918 - protein, 8 aa, Homo Sapiens
FVQVLETL

SEQ ID NO: 137919 - protein, 8 aa, Homo Sapiens
FVTELKEL

SEQ ID NO: 137920 - protein, 8 aa, Homo Sapiens
GGLRAELL

SEQ ID NO: 137921 - protein, 8 aa, Homo Sapiens
GIYDLPHL

SEQ ID NO: 137922 - protein, 8 aa, Homo Sapiens
GLGPALEF

SEQ ID NO: 137923 - protein, 8 aa, Homo Sapiens
GVFVLYEL

SEQ ID NO: 137924 - protein, 8 aa, Homo Sapiens
HAMELSEL

SEQ ID NO: 137925 - protein, 8 aa, Homo Sapiens
HILLRPTM

SEQ ID NO: 137926 - protein, 8 aa, Homo Sapiens
IAALLQEI

SEQ ID NO: 137927 - protein, 8 aa, Homo Sapiens
IAGHIMEF

SEQ ID NO: 137928 - protein, 8 aa, Homo Sapiens
IAGPVVEI

SEQ ID NO: 137929 - protein, 8 aa, Homo Sapiens
IAHLLTSL

SEQ ID NO: 137930 - protein, 8 aa, Homo Sapiens
IAHVLPAL

SEQ ID NO: 137931 - protein, 8 aa, Homo Sapiens
IAINRMPF

SEQ ID NO: 137932 - protein, 8 aa, Homo Sapiens
IALERPDI

SEQ ID NO: 137933 - protein, 8 aa, Homo Sapiens
IALKISQI

SEQ ID NO: 137934 - protein, 8 aa, Homo Sapiens
IAMQLPVL

SEQ ID NO: 137935 - protein, 8 aa, Homo Sapiens
IANYRPTL

SEQ ID NO: 137936 - protein, 8 aa, Homo Sapiens
IAQVLAEL

SEQ ID NO: 137937 - protein, 8 aa, Homo Sapiens
IATILREI

SEQ ID NO: 137938 - protein, 8 aa, Homo Sapiens
IAWPLSTL

SEQ ID NO: 137939 - protein, 8 aa, Homo Sapiens
IAYEFVEM

SEQ ID NO: 137940 - protein, 8 aa, Homo Sapiens
IAYIMPGL

SEQ ID NO: 137941 - protein, 8 aa, Homo Sapiens
IILLLRIA

SEQ ID NO: 137942 - protein, 8 aa, Homo Sapiens
ISAVRPVI

SEQ ID NO: 137943 - protein, 8 aa, Homo Sapiens
IVGKDLEF

SEQ ID NO: 137944 - protein, 8 aa, Homo Sapiens
IVGVILRY

SEQ ID NO: 137945 - protein, 8 aa, Homo Sapiens
IVYVTPEY

SEQ ID NO: 137946 - protein, 8 aa, Homo Sapiens
KAMVFLEY

SEQ ID NO: 137947 - protein, 8 aa, Homo Sapiens
LAAKLMEL

SEQ ID NO: 137948 - protein, 8 aa, Homo Sapiens
LAALLHET

SEQ ID NO: 137949 - protein, 8 aa, Homo Sapiens
LAFEFIQF

SEQ ID NO: 137950 - protein, 8 aa, Homo Sapiens
LAFHLAVL

SEQ ID NO: 137951 - protein, 8 aa, Homo Sapiens
LAFLLAEL

SEQ ID NO: 137952 - protein, 8 aa, Homo Sapiens
LAFLLLPR

SEQ ID NO: 137953 - protein, 8 aa, Homo Sapiens
LAFLVHEL

SEQ ID NO: 137954 - protein, 8 aa, Homo Sapiens
LAFVLQHL

SEQ ID NO: 137955 - protein, 8 aa, Homo Sapiens
LAGPALEL

SEQ ID NO: 137956 - protein, 8 aa, Homo Sapiens
LAGPPLEI

SEQ ID NO: 137957 - protein, 8 aa, Homo Sapiens
LAHHLVAL

SEQ ID NO: 137958 - protein, 8 aa, Homo Sapiens
LAKLLSQL

SEQ ID NO: 137959 - protein, 8 aa, Homo Sapiens
LAKLMSEL

SEQ ID NO: 137960 - protein, 8 aa, Homo Sapiens
LAKYLMEL

SEQ ID NO: 137961 - protein, 8 aa, Homo Sapiens
LALEIRSL

SEQ ID NO: 137962 - protein, 8 aa, Homo Sapiens
LALILKAM

SEQ ID NO: 137963 - protein, 8 aa, Homo Sapiens
LALPRPVI

SEQ ID NO: 137964 - protein, 8 aa, Homo Sapiens
LALQLAEM

SEQ ID NO: 137965 - protein, 8 aa, Homo Sapiens
LAMLLQET

SEQ ID NO: 137966 - protein, 8 aa, Homo Sapiens
LAQALHEM

SEQ ID NO: 137967 - protein, 8 aa, Homo Sapiens
LAQALQEL

SEQ ID NO: 137968 - protein, 8 aa, Homo Sapiens
LAQLLAEL

SEQ ID NO: 137969 - protein, 8 aa, Homo Sapiens
LATHLQEL

SEQ ID NO: 137970 - protein, 8 aa, Homo Sapiens
LATILAQL

SEQ ID NO: 137971 - protein, 8 aa, Homo Sapiens
LATVLQAV

SEQ ID NO: 137972 - protein, 8 aa, Homo Sapiens
LAVLLRQL

SEQ ID NO: 137973 - protein, 8 aa, Homo Sapiens
LAVLRPLL

SEQ ID NO: 137974 - protein, 8 aa, Homo Sapiens
LAYIHIVF

SEQ ID NO: 137975 - protein, 8 aa, Homo Sapiens
LAYLHTEL

SEQ ID NO: 137976 - protein, 8 aa, Homo Sapiens
LGHLLMEL

SEQ ID NO: 137977 - protein, 8 aa, Homo Sapiens
LIHEFVEY

SEQ ID NO: 137978 - protein, 8 aa, Homo Sapiens
LIKLLEVL

SEQ ID NO: 137979 - protein, 8 aa, Homo Sapiens
LITYLMEH

SEQ ID NO: 137980 - protein, 8 aa, Homo Sapiens
LIYLHAVL

SEQ ID NO: 137981 - protein, 8 aa, Homo Sapiens
LKALLGAL

SEQ ID NO: 137982 - protein, 8 aa, Homo Sapiens
LQQPRPLM

SEQ ID NO: 137983 - protein, 8 aa, Homo Sapiens
LSALLHEL

SEQ ID NO: 137984 - protein, 8 aa, Homo Sapiens
LSKTIAAL

SEQ ID NO: 137985 - protein, 8 aa, Homo Sapiens
LSLERPTM

SEQ ID NO: 137986 - protein, 8 aa, Homo Sapiens
LSNVLAAM

SEQ ID NO: 137987 - protein, 8 aa, Homo Sapiens
LSRLFRVF

SEQ ID NO: 137988 - protein, 8 aa, Homo Sapiens
LSYIFPTY

SEQ ID NO: 137989 - protein, 8 aa, Homo Sapiens
LTALLMVL

SEQ ID NO: 137990 - protein, 8 aa, Homo Sapiens
LTALLSEF

SEQ ID NO: 137991 - protein, 8 aa, Homo Sapiens
LTGPVLEL

SEQ ID NO: 137992 - protein, 8 aa, Homo Sapiens
LTHLLFEF

SEQ ID NO: 137993 - protein, 8 aa, Homo Sapiens
LTYELPTL

SEQ ID NO: 137994 - protein, 8 aa, Homo Sapiens
LTYVHNEL

SEQ ID NO: 137995 - protein, 8 aa, Homo Sapiens
LVMLLAEM

SEQ ID NO: 137996 - protein, 8 aa, Homo Sapiens
LVQPLREL

SEQ ID NO: 137997 - protein, 8 aa, Homo Sapiens
LVYQFKEM

SEQ ID NO: 137998 - protein, 8 aa, Homo Sapiens
MAFLLPLI

SEQ ID NO: 137999 - protein, 8 aa, Homo Sapiens
MAFTFAAF

SEQ ID NO: 138000 - protein, 8 aa, Homo Sapiens
MALVLEAL

SEQ ID NO: 138001 - protein, 8 aa, Homo Sapiens
MSTLLREI

SEQ ID NO: 138002 - protein, 8 aa, Homo Sapiens
MTILLSEV

SEQ ID NO: 138003 - protein, 8 aa, Homo Sapiens
MTVLLHEV

SEQ ID NO: 138004 - protein, 8 aa, Homo Sapiens
MTYVGAVF

SEQ ID NO: 138005 - protein, 8 aa, Homo Sapiens
MVGPILEM

SEQ ID NO: 138006 - protein, 8 aa, Homo Sapiens
NSAVLPEM

SEQ ID NO: 138007 - protein, 8 aa, Homo Sapiens
RIHIFSSF

SEQ ID NO: 138008 - protein, 8 aa, Homo Sapiens
SAFPLAAL

SEQ ID NO: 138009 - protein, 8 aa, Homo Sapiens
SALPRLSP

SEQ ID NO: 138010 - protein, 8 aa, Homo Sapiens
SALPRPSL

SEQ ID NO: 138011 - protein, 8 aa, Homo Sapiens
SAMLLAQL

SEQ ID NO: 138012 - protein, 8 aa, Homo Sapiens
SAQLLPVL

SEQ ID NO: 138013 - protein, 8 aa, Homo Sapiens
SFYNGLSF

SEQ ID NO: 138014 - protein, 8 aa, Homo Sapiens
SITPLSEL

SEQ ID NO: 138015 - protein, 8 aa, Homo Sapiens
SSVLLQAL

SEQ ID NO: 138016 - protein, 8 aa, Homo Sapiens
STYKFFEV

SEQ ID NO: 138017 - protein, 8 aa, Homo Sapiens
SVFEFLAF

SEQ ID NO: 138018 - protein, 8 aa, Homo Sapiens
TAFLLDAL

SEQ ID NO: 138019 - protein, 8 aa, Homo Sapiens
TSWIHPVM

SEQ ID NO: 138020 - protein, 8 aa, Homo Sapiens
VAAYLRAL

SEQ ID NO: 138021 - protein, 8 aa, Homo Sapiens
VAFIVGEM

SEQ ID NO: 138022 - protein, 8 aa, Homo Sapiens
VAIVRPSI

SEQ ID NO: 138023 - protein, 8 aa, Homo Sapiens
VALVLEEM

SEQ ID NO: 138024 - protein, 8 aa, Homo Sapiens
VALVLKEM

SEQ ID NO: 138025 - protein, 8 aa, Homo Sapiens
VAVGLYAM

SEQ ID NO: 138026 - protein, 8 aa, Homo Sapiens
VAVLRPEL

SEQ ID NO: 138027 - protein, 8 aa, Homo Sapiens
VAVPLPLH

SEQ ID NO: 138028 - protein, 8 aa, Homo Sapiens
VAYHQPTL

SEQ ID NO: 138029 - protein, 8 aa, Homo Sapiens
VFFVHEGY

SEQ ID NO: 138030 - protein, 8 aa, Homo Sapiens
VFRVGISF

SEQ ID NO: 138031 - protein, 8 aa, Homo Sapiens
VIYVLPML

SEQ ID NO: 138032 - protein, 8 aa, Homo Sapiens
VMSVGFLL

SEQ ID NO: 138033 - protein, 8 aa, Homo Sapiens
VNFEFPEF

SEQ ID NO: 138034 - protein, 8 aa, Homo Sapiens
VSFLLPTL

SEQ ID NO: 138035 - protein, 8 aa, Homo Sapiens
VSHVLAAL

SEQ ID NO: 138036 - protein, 8 aa, Homo Sapiens
VSTVLHEL

SEQ ID NO: 138037 - protein, 8 aa, Homo Sapiens
VTLLIQEL

SEQ ID NO: 138038 - protein, 8 aa, Homo Sapiens
WAAELSEL

SEQ ID NO: 138039 - protein, 8 aa, Homo Sapiens
YAAEIAIG

SEQ ID NO: 138040 - protein, 8 aa, Homo Sapiens
YAALHGEF

SEQ ID NO: 138041 - protein, 8 aa, Homo Sapiens
YAAQLPAL

SEQ ID NO: 138042 - protein, 8 aa, Homo Sapiens
YAFLHRTL

SEQ ID NO: 138043 - protein, 8 aa, Homo Sapiens
YAHLFEVF

SEQ ID NO: 138044 - protein, 8 aa, Homo Sapiens
YAHPLETL

SEQ ID NO: 138045 - protein, 8 aa, Homo Sapiens
YAHSLVEL

SEQ ID NO: 138046 - protein, 8 aa, Homo Sapiens
YAHYLLVL

SEQ ID NO: 138047 - protein, 8 aa, Homo Sapiens
YAIPQPDL

SEQ ID NO: 138048 - protein, 8 aa, Homo Sapiens
YAKLIAEL

SEQ ID NO: 138049 - protein, 8 aa, Homo Sapiens
YALLLQHL

SEQ ID NO: 138050 - protein, 8 aa, Homo Sapiens
YALLLTEH

SEQ ID NO: 138051 - protein, 8 aa, Homo Sapiens
YALPHAIL

SEQ ID NO: 138052 - protein, 8 aa, Homo Sapiens
YAQFLREM

SEQ ID NO: 138053 - protein, 8 aa, Homo Sapiens
YAQILRDL

SEQ ID NO: 138054 - protein, 8 aa, Homo Sapiens
YAQVFREH

SEQ ID NO: 138055 - protein, 8 aa, Homo Sapiens
YASFLEVL

SEQ ID NO: 138056 - protein, 8 aa, Homo Sapiens
YAVLLEAL

SEQ ID NO: 138057 - protein, 8 aa, Homo Sapiens
YAVQLVEM

SEQ ID NO: 138058 - protein, 8 aa, Homo Sapiens
YAWGLNEL

SEQ ID NO: 138059 - protein, 8 aa, Homo Sapiens
YAWVLDKL

SEQ ID NO: 138060 - protein, 8 aa, Homo Sapiens
YFLEHLAF

SEQ ID NO: 138061 - protein, 8 aa, Homo Sapiens
YFQLHRAL

SEQ ID NO: 138062 - protein, 8 aa, Homo Sapiens
YGIVLYEL

SEQ ID NO: 138063 - protein, 8 aa, Homo Sapiens
YGVLLHEL

SEQ ID NO: 138064 - protein, 8 aa, Homo Sapiens
YGVVLWEM

SEQ ID NO: 138065 - protein, 8 aa, Homo Sapiens
YGVVLYEL

SEQ ID NO: 138066 - protein, 8 aa, Homo Sapiens
YIAHLRQI

SEQ ID NO: 138067 - protein, 8 aa, Homo Sapiens
YITPMMEL

SEQ ID NO: 138068 - protein, 8 aa, Homo Sapiens
YLGKVLEL

SEQ ID NO: 138069 - protein, 8 aa, Homo Sapiens
YLGPILKF

SEQ ID NO: 138070 - protein, 8 aa, Homo Sapiens
YLILLQEM

SEQ ID NO: 138071 - protein, 8 aa, Homo Sapiens
YNFVFTSF

SEQ ID NO: 138072 - protein, 8 aa, Homo Sapiens
YSAPLPAL

SEQ ID NO: 138073 - protein, 8 aa, Homo Sapiens
YSFWLYEL

SEQ ID NO: 138074 - protein, 8 aa, Homo Sapiens
YSTIRPYL

SEQ ID NO: 138075 - protein, 8 aa, Homo Sapiens
YSTRLAVL

SEQ ID NO: 138076 - protein, 8 aa, Homo Sapiens
YSWDQPGL

SEQ ID NO: 138077 - protein, 8 aa, Homo Sapiens
YSWLLNVL

SEQ ID NO: 138078 - protein, 8 aa, Homo Sapiens
YTLNLHEL

SEQ ID NO: 138079 - protein, 8 aa, Homo Sapiens
YTQLLQEL

SEQ ID NO: 138080 - protein, 8 aa, Homo Sapiens
YTQLLTEM

SEQ ID NO: 138081 - protein, 8 aa, Homo Sapiens
YVANLTEL

SEQ ID NO: 138082 - protein, 8 aa, Homo Sapiens
YVFLISEL

SEQ ID NO: 138083 - protein, 8 aa, Homo Sapiens
YVFNLAEL

SEQ ID NO: 138084 - protein, 8 aa, Homo Sapiens
YVFNLRDL

SEQ ID NO: 138085 - protein, 8 aa, Homo Sapiens
YVQLMPAL

SEQ ID NO: 138086 - protein, 8 aa, Homo Sapiens
YVTELAEL

SEQ ID NO: 138087 - protein, 8 aa, Homo Sapiens
YVTILPEL

SEQ ID NO: 138088 - protein, 8 aa, Homo Sapiens
YWQNHPEL

SEQ ID NO: 138089 - protein, 9 aa, Homo Sapiens
AAAGGLHEF

SEQ ID NO: 138090 - protein, 9 aa, Homo Sapiens
AAANPTLAF

SEQ ID NO: 138091 - protein, 9 aa, Homo Sapiens
AAAPLLPMI

SEQ ID NO: 138092 - protein, 9 aa, Homo Sapiens
AAAPSLLIL

SEQ ID NO: 138093 - protein, 9 aa, Homo Sapiens
AAAVPRAAF

SEQ ID NO: 138094 - protein, 9 aa, Homo Sapiens
AAFADALEF

SEQ ID NO: 138095 - protein, 9 aa, Homo Sapiens
AAFDFPTSF

SEQ ID NO: 138096 - protein, 9 aa, Homo Sapiens
AAFDNFKEV

SEQ ID NO: 138097 - protein, 9 aa, Homo Sapiens
AAFQGFPSM

SEQ ID NO: 138098 - protein, 9 aa, Homo Sapiens
AAFTRALEY

SEQ ID NO: 138099 - protein, 9 aa, Homo Sapiens
AAFWAFTVF

SEQ ID NO: 138100 - protein, 9 aa, Homo Sapiens
AAIASLLYL

SEQ ID NO: 138101 - protein, 9 aa, Homo Sapiens
AAIAVLEEL

SEQ ID NO: 138102 - protein, 9 aa, Homo Sapiens
AAIDPRVQY

SEQ ID NO: 138103 - protein, 9 aa, Homo Sapiens
AAIGLVIYY

SEQ ID NO: 138104 - protein, 9 aa, Homo Sapiens
AAIKPGTPL

SEQ ID NO: 138105 - protein, 9 aa, Homo Sapiens
AALLFVEAF

SEQ ID NO: 138106 - protein, 9 aa, Homo Sapiens
AALPFTKSL

SEQ ID NO: 138107 - protein, 9 aa, Homo Sapiens
AALPIFSSF

SEQ ID NO: 138108 - protein, 9 aa, Homo Sapiens
AALPKATIL

SEQ ID NO: 138109 - protein, 9 aa, Homo Sapiens
AALPVYQEL

SEQ ID NO: 138110 - protein, 9 aa, Homo Sapiens
AAMKALQAL

SEQ ID NO: 138111 - protein, 9 aa, Homo Sapiens
AAMSHLLEM

SEQ ID NO: 138112 - protein, 9 aa, Homo Sapiens
AANLFAQTY

SEQ ID NO: 138113 - protein, 9 aa, Homo Sapiens
AANPHSFVF

SEQ ID NO: 138114 - protein, 9 aa, Homo Sapiens
AAPIRLLAA

SEQ ID NO: 138115 - protein, 9 aa, Homo Sapiens
AARFVSTPF

SEQ ID NO: 138116 - protein, 9 aa, Homo Sapiens
AATPVWLLF

SEQ ID NO: 138117 - protein, 9 aa, Homo Sapiens
AAYVFEDPF

SEQ ID NO: 138118 - protein, 9 aa, Homo Sapiens
AGVPLFLLE

SEQ ID NO: 138119 - protein, 9 aa, Homo Sapiens
AINPKLLQL

SEQ ID NO: 138120 - protein, 9 aa, Homo Sapiens
AIVKPGVPM

SEQ ID NO: 138121 - protein, 9 aa, Homo Sapiens
AIYDGFDGF

SEQ ID NO: 138122 - protein, 9 aa, Homo Sapiens
ALLSALQAL

SEQ ID NO: 138123 - protein, 9 aa, Homo Sapiens
ASHLHIHVF

SEQ ID NO: 138124 - protein, 9 aa, Homo Sapiens
ATYIFLQTF

SEQ ID NO: 138125 - protein, 9 aa, Homo Sapiens
AVFGDFEQF

SEQ ID NO: 138126 - protein, 9 aa, Homo Sapiens
AYAIYELAV

SEQ ID NO: 138127 - protein, 9 aa, Homo Sapiens
CAIPDLGPA

SEQ ID NO: 138128 - protein, 9 aa, Homo Sapiens
CAIPQVMAI

SEQ ID NO: 138129 - protein, 9 aa, Homo Sapiens
CAMPVAMEF

SEQ ID NO: 138130 - protein, 9 aa, Homo Sapiens
CASDKILEF

SEQ ID NO: 138131 - protein, 9 aa, Homo Sapiens
CINGKVLIM

SEQ ID NO: 138132 - protein, 9 aa, Homo Sapiens
CSSPHALVL

SEQ ID NO: 138133 - protein, 9 aa, Homo Sapiens
CTYGKPVTF

SEQ ID NO: 138134 - protein, 9 aa, Homo Sapiens
CVSPWIVTM

SEQ ID NO: 138135 - protein, 9 aa, Homo Sapiens
EVYDDFLHY

SEQ ID NO: 138136 - protein, 9 aa, Homo Sapiens
FAAASFMSY

SEQ ID NO: 138137 - protein, 9 aa, Homo Sapiens
FAADIISVL

SEQ ID NO: 138138 - protein, 9 aa, Homo Sapiens
FAADVRLMF

SEQ ID NO: 138139 - protein, 9 aa, Homo Sapiens
FAAKFVTSF

SEQ ID NO: 138140 - protein, 9 aa, Homo Sapiens
FAALHGPAL

SEQ ID NO: 138141 - protein, 9 aa, Homo Sapiens
FAANVYEAF

SEQ ID NO: 138142 - protein, 9 aa, Homo Sapiens
FAASGGFLH

SEQ ID NO: 138143 - protein, 9 aa, Homo Sapiens
FAASVAHLY

SEQ ID NO: 138144 - protein, 9 aa, Homo Sapiens
FAATHSLEF

SEQ ID NO: 138145 - protein, 9 aa, Homo Sapiens
FAATLEQVY

SEQ ID NO: 138146 - protein, 9 aa, Homo Sapiens
FADGFVLVY

SEQ ID NO: 138147 - protein, 9 aa, Homo Sapiens
FADGHVLEL

SEQ ID NO: 138148 - protein, 9 aa, Homo Sapiens
FADGVILLL

SEQ ID NO: 138149 - protein, 9 aa, Homo Sapiens
FADGVYLVL

SEQ ID NO: 138150 - protein, 9 aa, Homo Sapiens
FADPHGKVF

SEQ ID NO: 138151 - protein, 9 aa, Homo Sapiens
FAEDSLRVI

SEQ ID NO: 138152 - protein, 9 aa, Homo Sapiens
FAEGFVRAL

SEQ ID NO: 138153 - protein, 9 aa, Homo Sapiens
FAFDPSVNY

SEQ ID NO: 138154 - protein, 9 aa, Homo Sapiens
FAFEHSEEY

SEQ ID NO: 138155 - protein, 9 aa, Homo Sapiens
FAFLFNSEL

SEQ ID NO: 138156 - protein, 9 aa, Homo Sapiens
FAFPGEILM

SEQ ID NO: 138157 - protein, 9 aa, Homo Sapiens
FAFRNFLYL

SEQ ID NO: 138158 - protein, 9 aa, Homo Sapiens
FAFTPSRIY

SEQ ID NO: 138159 - protein, 9 aa, Homo Sapiens
FAFVTDNTY

SEQ ID NO: 138160 - protein, 9 aa, Homo Sapiens
FAGSFLEYY

SEQ ID NO: 138161 - protein, 9 aa, Homo Sapiens
FAHDSTRVI

SEQ ID NO: 138162 - protein, 9 aa, Homo Sapiens
FAHEVGHNF

SEQ ID NO: 138163 - protein, 9 aa, Homo Sapiens
FAHLINVEF

SEQ ID NO: 138164 - protein, 9 aa, Homo Sapiens
FAHLPKSTF

SEQ ID NO: 138165 - protein, 9 aa, Homo Sapiens
FAHLRLEVL

SEQ ID NO: 138166 - protein, 9 aa, Homo Sapiens
FAHPYQYEL

SEQ ID NO: 138167 - protein, 9 aa, Homo Sapiens
FAIDPHLLL

SEQ ID NO: 138168 - protein, 9 aa, Homo Sapiens
FAIDSSHPW

SEQ ID NO: 138169 - protein, 9 aa, Homo Sapiens
FAIGILCSL

SEQ ID NO: 138170 - protein, 9 aa, Homo Sapiens
FAIKSLRKL

SEQ ID NO: 138171 - protein, 9 aa, Homo Sapiens
FAILRQAEL

SEQ ID NO: 138172 - protein, 9 aa, Homo Sapiens
FAINNSKSF

SEQ ID NO: 138173 - protein, 9 aa, Homo Sapiens
FAIPGSSFL

SEQ ID NO: 138174 - protein, 9 aa, Homo Sapiens
FAIPLIEKL

SEQ ID NO: 138175 - protein, 9 aa, Homo Sapiens
FAIPMIHAV

SEQ ID NO: 138176 - protein, 9 aa, Homo Sapiens
FAIPVGSGL

SEQ ID NO: 138177 - protein, 9 aa, Homo Sapiens
FAIQRTTNF

SEQ ID NO: 138178 - protein, 9 aa, Homo Sapiens
FAIRRLPAF

SEQ ID NO: 138179 - protein, 9 aa, Homo Sapiens
FAIRSLAEL

SEQ ID NO: 138180 - protein, 9 aa, Homo Sapiens
FAISIKYNV

SEQ ID NO: 138181 - protein, 9 aa, Homo Sapiens
FAISILQQI

SEQ ID NO: 138182 - protein, 9 aa, Homo Sapiens
FAIWHIIAF

SEQ ID NO: 138183 - protein, 9 aa, Homo Sapiens
FAIYKMSFF

SEQ ID NO: 138184 - protein, 9 aa, Homo Sapiens
FAKPENIDL

SEQ ID NO: 138185 - protein, 9 aa, Homo Sapiens
FALDSGLEI

SEQ ID NO: 138186 - protein, 9 aa, Homo Sapiens
FALGAGTAL

SEQ ID NO: 138187 - protein, 9 aa, Homo Sapiens
FALGPTISF

SEQ ID NO: 138188 - protein, 9 aa, Homo Sapiens
FALGSPIAM

SEQ ID NO: 138189 - protein, 9 aa, Homo Sapiens
FALGVYRTL

SEQ ID NO: 138190 - protein, 9 aa, Homo Sapiens
FALHKTLEF

SEQ ID NO: 138191 - protein, 9 aa, Homo Sapiens
FALHSASVF

SEQ ID NO: 138192 - protein, 9 aa, Homo Sapiens
FALLPRLEY

SEQ ID NO: 138193 - protein, 9 aa, Homo Sapiens
FALNLFKHL

SEQ ID NO: 138194 - protein, 9 aa, Homo Sapiens
FALPFGRTA

SEQ ID NO: 138195 - protein, 9 aa, Homo Sapiens
FALPILNAL

SEQ ID NO: 138196 - protein, 9 aa, Homo Sapiens
FALPVGLIV

SEQ ID NO: 138197 - protein, 9 aa, Homo Sapiens
FALPYIRDV

SEQ ID NO: 138198 - protein, 9 aa, Homo Sapiens
FALPYVIVL

SEQ ID NO: 138199 - protein, 9 aa, Homo Sapiens
FALSQPRAM

SEQ ID NO: 138200 - protein, 9 aa, Homo Sapiens
FALSVTNPL

SEQ ID NO: 138201 - protein, 9 aa, Homo Sapiens
FALVFPLMY

SEQ ID NO: 138202 - protein, 9 aa, Homo Sapiens
FAMDVYKNL

SEQ ID NO: 138203 - protein, 9 aa, Homo Sapiens
FAMEFVKYY

SEQ ID NO: 138204 - protein, 9 aa, Homo Sapiens
FAMPPPHGM

SEQ ID NO: 138205 - protein, 9 aa, Homo Sapiens
FAMPSSTPL

SEQ ID NO: 138206 - protein, 9 aa, Homo Sapiens
FAMPYFIQV

SEQ ID NO: 138207 - protein, 9 aa, Homo Sapiens
FAMTLTGPL

SEQ ID NO: 138208 - protein, 9 aa, Homo Sapiens
FANDATFEI

SEQ ID NO: 138209 - protein, 9 aa, Homo Sapiens
FANEPFADF

SEQ ID NO: 138210 - protein, 9 aa, Homo Sapiens
FANLPNQVY

SEQ ID NO: 138211 - protein, 9 aa, Homo Sapiens
FANNVQLSL

SEQ ID NO: 138212 - protein, 9 aa, Homo Sapiens
FAQDVGRMF

SEQ ID NO: 138213 - protein, 9 aa, Homo Sapiens
FAQEAISVL

SEQ ID NO: 138214 - protein, 9 aa, Homo Sapiens
FAQEALTVL

SEQ ID NO: 138215 - protein, 9 aa, Homo Sapiens
FAQPGSFEY

SEQ ID NO: 138216 - protein, 9 aa, Homo Sapiens
FAQPSGLSL

SEQ ID NO: 138217 - protein, 9 aa, Homo Sapiens
FARPASPSL

SEQ ID NO: 138218 - protein, 9 aa, Homo Sapiens
FARVPVATY

SEQ ID NO: 138219 - protein, 9 aa, Homo Sapiens
FASDVQFVL

SEQ ID NO: 138220 - protein, 9 aa, Homo Sapiens
FASEVSNVL

SEQ ID NO: 138221 - protein, 9 aa, Homo Sapiens
FASEYPLIL

SEQ ID NO: 138222 - protein, 9 aa, Homo Sapiens
FASFPHMVL

SEQ ID NO: 138223 - protein, 9 aa, Homo Sapiens
FASGAFLHI

SEQ ID NO: 138224 - protein, 9 aa, Homo Sapiens
FASHVSPEV

SEQ ID NO: 138225 - protein, 9 aa, Homo Sapiens
FASIPGLEF

SEQ ID NO: 138226 - protein, 9 aa, Homo Sapiens
FASTILHLV

SEQ ID NO: 138227 - protein, 9 aa, Homo Sapiens
FASYATIIL

SEQ ID NO: 138228 - protein, 9 aa, Homo Sapiens
FATDAILAT

SEQ ID NO: 138229 - protein, 9 aa, Homo Sapiens
FATDSGLEF

SEQ ID NO: 138230 - protein, 9 aa, Homo Sapiens
FATFPSSAF

SEQ ID NO: 138231 - protein, 9 aa, Homo Sapiens
FATGVWHQM

SEQ ID NO: 138232 - protein, 9 aa, Homo Sapiens
FATMVRPVA

SEQ ID NO: 138233 - protein, 9 aa, Homo Sapiens
FATPVFITK

SEQ ID NO: 138234 - protein, 9 aa, Homo Sapiens
FATTSPLVL

SEQ ID NO: 138235 - protein, 9 aa, Homo Sapiens
FAVAIYAVY

SEQ ID NO: 138236 - protein, 9 aa, Homo Sapiens
FAVAMHLVY

SEQ ID NO: 138237 - protein, 9 aa, Homo Sapiens
FAVARLEIL

SEQ ID NO: 138238 - protein, 9 aa, Homo Sapiens
FAVDSLRQL

SEQ ID NO: 138239 - protein, 9 aa, Homo Sapiens
FAVGSFHTL

SEQ ID NO: 138240 - protein, 9 aa, Homo Sapiens
FAVGVQQVL

SEQ ID NO: 138241 - protein, 9 aa, Homo Sapiens
FAVIAHVGM

SEQ ID NO: 138242 - protein, 9 aa, Homo Sapiens
FAVISRHSL

SEQ ID NO: 138243 - protein, 9 aa, Homo Sapiens
FAVNMFRTL

SEQ ID NO: 138244 - protein, 9 aa, Homo Sapiens
FAVSDGLEL

SEQ ID NO: 138245 - protein, 9 aa, Homo Sapiens
FAYAHTLAL

SEQ ID NO: 138246 - protein, 9 aa, Homo Sapiens
FAYEGPMYL

SEQ ID NO: 138247 - protein, 9 aa, Homo Sapiens
FAYHYPYTY

SEQ ID NO: 138248 - protein, 9 aa, Homo Sapiens
FAYKDYLSF

SEQ ID NO: 138249 - protein, 9 aa, Homo Sapiens
FAYLGRLAH

SEQ ID NO: 138250 - protein, 9 aa, Homo Sapiens
FAYMPNNSL

SEQ ID NO: 138251 - protein, 9 aa, Homo Sapiens
FAYNFREEL

SEQ ID NO: 138252 - protein, 9 aa, Homo Sapiens
FAYPAIRYL

SEQ ID NO: 138253 - protein, 9 aa, Homo Sapiens
FAYPAPLEV

SEQ ID NO: 138254 - protein, 9 aa, Homo Sapiens
FAYRGFKYL

SEQ ID NO: 138255 - protein, 9 aa, Homo Sapiens
FAYSSRIAI

SEQ ID NO: 138256 - protein, 9 aa, Homo Sapiens
FAYTARISV

SEQ ID NO: 138257 - protein, 9 aa, Homo Sapiens
FAYYRDLVF

SEQ ID NO: 138258 - protein, 9 aa, Homo Sapiens
FAYYRVGEY

SEQ ID NO: 138259 - protein, 9 aa, Homo Sapiens
FCMDRALEF

SEQ ID NO: 138260 - protein, 9 aa, Homo Sapiens
FCVDSITAL

SEQ ID NO: 138261 - protein, 9 aa, Homo Sapiens
FFFTARTSF

SEQ ID NO: 138262 - protein, 9 aa, Homo Sapiens
FFYKFFQEF

SEQ ID NO: 138263 - protein, 9 aa, Homo Sapiens
FFYQRLVEF

SEQ ID NO: 138264 - protein, 9 aa, Homo Sapiens
FGEMGGKFM

SEQ ID NO: 138265 - protein, 9 aa, Homo Sapiens
FGFVRFTEY

SEQ ID NO: 138266 - protein, 9 aa, Homo Sapiens
FGHYFETTY

SEQ ID NO: 138267 - protein, 9 aa, Homo Sapiens
FGIDRPAEL

SEQ ID NO: 138268 - protein, 9 aa, Homo Sapiens
FGNNKLTTF

SEQ ID NO: 138269 - protein, 9 aa, Homo Sapiens
FGSEFSPEL

SEQ ID NO: 138270 - protein, 9 aa, Homo Sapiens
FGVIPSTPL

SEQ ID NO: 138271 - protein, 9 aa, Homo Sapiens
FIDKQLELL

SEQ ID NO: 138272 - protein, 9 aa, Homo Sapiens
FIIDDKGIL

SEQ ID NO: 138273 - protein, 9 aa, Homo Sapiens
FIIQGLRSV

SEQ ID NO: 138274 - protein, 9 aa, Homo Sapiens
FIISRTQAL

SEQ ID NO: 138275 - protein, 9 aa, Homo Sapiens
FILEHIMVI

SEQ ID NO: 138276 - protein, 9 aa, Homo Sapiens
FIMDRAQAL

SEQ ID NO: 138277 - protein, 9 aa, Homo Sapiens
FIMGKTIEF

SEQ ID NO: 138278 - protein, 9 aa, Homo Sapiens
FIMINPLEY

SEQ ID NO: 138279 - protein, 9 aa, Homo Sapiens
FINPKPITY

SEQ ID NO: 138280 - protein, 9 aa, Homo Sapiens
FIPFLPLEY

SEQ ID NO: 138281 - protein, 9 aa, Homo Sapiens
FIRVSGSEL

SEQ ID NO: 138282 - protein, 9 aa, Homo Sapiens
FIRVVGSEF

SEQ ID NO: 138283 - protein, 9 aa, Homo Sapiens
FIVDARPAM

SEQ ID NO: 138284 - protein, 9 aa, Homo Sapiens
FIVEETLPL

SEQ ID NO: 138285 - protein, 9 aa, Homo Sapiens
FIYHLPQEF

SEQ ID NO: 138286 - protein, 9 aa, Homo Sapiens
FIYLHLSYY

SEQ ID NO: 138287 - protein, 9 aa, Homo Sapiens
FLADPVSNM

SEQ ID NO: 138288 - protein, 9 aa, Homo Sapiens
FLANVSTVL

SEQ ID NO: 138289 - protein, 9 aa, Homo Sapiens
FLAPLVTEY

SEQ ID NO: 138290 - protein, 9 aa, Homo Sapiens
FLCGVMKTY

SEQ ID NO: 138291 - protein, 9 aa, Homo Sapiens
FLFDGSPTY

SEQ ID NO: 138292 - protein, 9 aa, Homo Sapiens
FLFSKFIEL

SEQ ID NO: 138293 - protein, 9 aa, Homo Sapiens
FLHEFSMAY

SEQ ID NO: 138294 - protein, 9 aa, Homo Sapiens
FLIDRSPEY

SEQ ID NO: 138295 - protein, 9 aa, Homo Sapiens
FLIEPFVPH

SEQ ID NO: 138296 - protein, 9 aa, Homo Sapiens
FLKLFITEF

SEQ ID NO: 138297 - protein, 9 aa, Homo Sapiens
FLLDRLLQY

SEQ ID NO: 138298 - protein, 9 aa, Homo Sapiens
FLLPVINEM

SEQ ID NO: 138299 - protein, 9 aa, Homo Sapiens
FLMDPFAIH

SEQ ID NO: 138300 - protein, 9 aa, Homo Sapiens
FLNDSYLKY

SEQ ID NO: 138301 - protein, 9 aa, Homo Sapiens
FLNFHYLTY

SEQ ID NO: 138302 - protein, 9 aa, Homo Sapiens
FLNKEILEL

SEQ ID NO: 138303 - protein, 9 aa, Homo Sapiens
FLPEAPAEL

SEQ ID NO: 138304 - protein, 9 aa, Homo Sapiens
FLRDKIASY

SEQ ID NO: 138305 - protein, 9 aa, Homo Sapiens
FLREWVESM

SEQ ID NO: 138306 - protein, 9 aa, Homo Sapiens
FLRIAFNSY

SEQ ID NO: 138307 - protein, 9 aa, Homo Sapiens
FLRVPTASY

SEQ ID NO: 138308 - protein, 9 aa, Homo Sapiens
FLYDKALTF

SEQ ID NO: 138309 - protein, 9 aa, Homo Sapiens
FLYPFFGVL

SEQ ID NO: 138310 - protein, 9 aa, Homo Sapiens
FLYPFPLAL

SEQ ID NO: 138311 - protein, 9 aa, Homo Sapiens
FLYSGHLAL

SEQ ID NO: 138312 - protein, 9 aa, Homo Sapiens
FNRWFAEKF

SEQ ID NO: 138313 - protein, 9 aa, Homo Sapiens
FNYPGGVAM

SEQ ID NO: 138314 - protein, 9 aa, Homo Sapiens
FPVFLAILI

SEQ ID NO: 138315 - protein, 9 aa, Homo Sapiens
FQNPFRSEL

SEQ ID NO: 138316 - protein, 9 aa, Homo Sapiens
FQNPSTVTL

SEQ ID NO: 138317 - protein, 9 aa, Homo Sapiens
FQRPNALAV

SEQ ID NO: 138318 - protein, 9 aa, Homo Sapiens
FQYESKVFY

SEQ ID NO: 138319 - protein, 9 aa, Homo Sapiens
FQYPDTRYL

SEQ ID NO: 138320 - protein, 9 aa, Homo Sapiens
FQYSKSPSL

SEQ ID NO: 138321 - protein, 9 aa, Homo Sapiens
FSAPLFLSH

SEQ ID NO: 138322 - protein, 9 aa, Homo Sapiens
FSEPFHLIV

SEQ ID NO: 138323 - protein, 9 aa, Homo Sapiens
FSEPHARFY

SEQ ID NO: 138324 - protein, 9 aa, Homo Sapiens
FSFDGPEIM

SEQ ID NO: 138325 - protein, 9 aa, Homo Sapiens
FSFHHVLSL

SEQ ID NO: 138326 - protein, 9 aa, Homo Sapiens
FSFVFKPVF

SEQ ID NO: 138327 - protein, 9 aa, Homo Sapiens
FSFVRITAL

SEQ ID NO: 138328 - protein, 9 aa, Homo Sapiens
FSFYFHEAL

SEQ ID NO: 138329 - protein, 9 aa, Homo Sapiens
FSHAQTVVL

SEQ ID NO: 138330 - protein, 9 aa, Homo Sapiens
FSHEVGSEL

SEQ ID NO: 138331 - protein, 9 aa, Homo Sapiens
FSIEPWLKV

SEQ ID NO: 138332 - protein, 9 aa, Homo Sapiens
FSIPILMQL

SEQ ID NO: 138333 - protein, 9 aa, Homo Sapiens
FSITPLSEL

SEQ ID NO: 138334 - protein, 9 aa, Homo Sapiens
FSKWWINEF

SEQ ID NO: 138335 - protein, 9 aa, Homo Sapiens
FSLEELRVA

SEQ ID NO: 138336 - protein, 9 aa, Homo Sapiens
FSLPPGHAV

SEQ ID NO: 138337 - protein, 9 aa, Homo Sapiens
FSNAHMIMY

SEQ ID NO: 138338 - protein, 9 aa, Homo Sapiens
FSNDIPHVV

SEQ ID NO: 138339 - protein, 9 aa, Homo Sapiens
FSNGHIKVL

SEQ ID NO: 138340 - protein, 9 aa, Homo Sapiens
FSNPFFVNY

SEQ ID NO: 138341 - protein, 9 aa, Homo Sapiens
FSNPRALYL

SEQ ID NO: 138342 - protein, 9 aa, Homo Sapiens
FSNPYSIEY

SEQ ID NO: 138343 - protein, 9 aa, Homo Sapiens
FSPFHASVL

SEQ ID NO: 138344 - protein, 9 aa, Homo Sapiens
FSQDHLVIY

SEQ ID NO: 138345 - protein, 9 aa, Homo Sapiens
FSQSSLALH

SEQ ID NO: 138346 - protein, 9 aa, Homo Sapiens
FSSDVTHEM

SEQ ID NO: 138347 - protein, 9 aa, Homo Sapiens
FSSPVCMAF

SEQ ID NO: 138348 - protein, 9 aa, Homo Sapiens
FSSWVQLEV

SEQ ID NO: 138349 - protein, 9 aa, Homo Sapiens
FSTPVFNLV

SEQ ID NO: 138350 - protein, 9 aa, Homo Sapiens
FSVDQLMEL

SEQ ID NO: 138351 - protein, 9 aa, Homo Sapiens
FSVDSPRIY

SEQ ID NO: 138352 - protein, 9 aa, Homo Sapiens
FSVEGQLEF

SEQ ID NO: 138353 - protein, 9 aa, Homo Sapiens
FSVNLFRTL

SEQ ID NO: 138354 - protein, 9 aa, Homo Sapiens
FSWLFHTVY

SEQ ID NO: 138355 - protein, 9 aa, Homo Sapiens
FSYAFPKAV

SEQ ID NO: 138356 - protein, 9 aa, Homo Sapiens
FSYAFPKEF

SEQ ID NO: 138357 - protein, 9 aa, Homo Sapiens
FSYDTFVDY

SEQ ID NO: 138358 - protein, 9 aa, Homo Sapiens
FSYVTPRAF

SEQ ID NO: 138359 - protein, 9 aa, Homo Sapiens
FTADPLSLL

SEQ ID NO: 138360 - protein, 9 aa, Homo Sapiens
FTAPATVSL

SEQ ID NO: 138361 - protein, 9 aa, Homo Sapiens
FTDASFLTL

SEQ ID NO: 138362 - protein, 9 aa, Homo Sapiens
FTIFRTISV

SEQ ID NO: 138363 - protein, 9 aa, Homo Sapiens
FTIKELREM

SEQ ID NO: 138364 - protein, 9 aa, Homo Sapiens
FTMPLHMTF

SEQ ID NO: 138365 - protein, 9 aa, Homo Sapiens
FTNPWTKEL

SEQ ID NO: 138366 - protein, 9 aa, Homo Sapiens
FTSEKFLVM

SEQ ID NO: 138367 - protein, 9 aa, Homo Sapiens
FTSLPGSTM

SEQ ID NO: 138368 - protein, 9 aa, Homo Sapiens
FTSPVSLEA

SEQ ID NO: 138369 - protein, 9 aa, Homo Sapiens
FTTHVMNLL

SEQ ID NO: 138370 - protein, 9 aa, Homo Sapiens
FTVGKLGPF

SEQ ID NO: 138371 - protein, 9 aa, Homo Sapiens
FTVMPGQTL

SEQ ID NO: 138372 - protein, 9 aa, Homo Sapiens
FTVPHTHVF

SEQ ID NO: 138373 - protein, 9 aa, Homo Sapiens
FTYDQRTEF

SEQ ID NO: 138374 - protein, 9 aa, Homo Sapiens
FTYKGLRAL

SEQ ID NO: 138375 - protein, 9 aa, Homo Sapiens
FVADVRLIF

SEQ ID NO: 138376 - protein, 9 aa, Homo Sapiens
FVALPGVAV

SEQ ID NO: 138377 - protein, 9 aa, Homo Sapiens
FVAPPTAAV

SEQ ID NO: 138378 - protein, 9 aa, Homo Sapiens
FVEVGRVAY

SEQ ID NO: 138379 - protein, 9 aa, Homo Sapiens
FVFGFRTHF

SEQ ID NO: 138380 - protein, 9 aa, Homo Sapiens
FVFKGFDAL

SEQ ID NO: 138381 - protein, 9 aa, Homo Sapiens
FVFPGELLL

SEQ ID NO: 138382 - protein, 9 aa, Homo Sapiens
FVHEFFYSF

SEQ ID NO: 138383 - protein, 9 aa, Homo Sapiens
FVIETARQL

SEQ ID NO: 138384 - protein, 9 aa, Homo Sapiens
FVIHNLPVL

SEQ ID NO: 138385 - protein, 9 aa, Homo Sapiens
FVIPVVQAL

SEQ ID NO: 138386 - protein, 9 aa, Homo Sapiens
FVKGQFHEF

SEQ ID NO: 138387 - protein, 9 aa, Homo Sapiens
FVKGWGAEY

SEQ ID NO: 138388 - protein, 9 aa, Homo Sapiens
FVKPAFEEF

SEQ ID NO: 138389 - protein, 9 aa, Homo Sapiens
FVNDYILYY

SEQ ID NO: 138390 - protein, 9 aa, Homo Sapiens
FVNPGVVEF

SEQ ID NO: 138391 - protein, 9 aa, Homo Sapiens
FVNPHVSSF

SEQ ID NO: 138392 - protein, 9 aa, Homo Sapiens
FVNPSLRVL

SEQ ID NO: 138393 - protein, 9 aa, Homo Sapiens
FVNPTSFVY

SEQ ID NO: 138394 - protein, 9 aa, Homo Sapiens
FVNPVQVVL

SEQ ID NO: 138395 - protein, 9 aa, Homo Sapiens
FVRDMIREV

SEQ ID NO: 138396 - protein, 9 aa, Homo Sapiens
FVRDYMAVL

SEQ ID NO: 138397 - protein, 9 aa, Homo Sapiens
FVSPSLAVH

SEQ ID NO: 138398 - protein, 9 aa, Homo Sapiens
FVSSFMSEL

SEQ ID NO: 138399 - protein, 9 aa, Homo Sapiens
FVVDRLIAL

SEQ ID NO: 138400 - protein, 9 aa, Homo Sapiens
FVVPYGTPL

SEQ ID NO: 138401 - protein, 9 aa, Homo Sapiens
FVYENPISL

SEQ ID NO: 138402 - protein, 9 aa, Homo Sapiens
FVYGESVEL

SEQ ID NO: 138403 - protein, 9 aa, Homo Sapiens
FVYITDNAY

SEQ ID NO: 138404 - protein, 9 aa, Homo Sapiens
FVYKGGKIY

SEQ ID NO: 138405 - protein, 9 aa, Homo Sapiens
FVYLRQPYY

SEQ ID NO: 138406 - protein, 9 aa, Homo Sapiens
FVYPFGATL

SEQ ID NO: 138407 - protein, 9 aa, Homo Sapiens
GAAGVHFIY

SEQ ID NO: 138408 - protein, 9 aa, Homo Sapiens
GALDLLKEL

SEQ ID NO: 138409 - protein, 9 aa, Homo Sapiens
GAMDLLREL

SEQ ID NO: 138410 - protein, 9 aa, Homo Sapiens
GAMGIMLVY

SEQ ID NO: 138411 - protein, 9 aa, Homo Sapiens
GAVDPLLAL

SEQ ID NO: 138412 - protein, 9 aa, Homo Sapiens
GAVPIFIEL

SEQ ID NO: 138413 - protein, 9 aa, Homo Sapiens
GGLFGTSSF

SEQ ID NO: 138414 - protein, 9 aa, Homo Sapiens
GIYPHKLVF

SEQ ID NO: 138415 - protein, 9 aa, Homo Sapiens
GLAEFLQSF

SEQ ID NO: 138416 - protein, 9 aa, Homo Sapiens
GVFQFKVDY

SEQ ID NO: 138417 - protein, 9 aa, Homo Sapiens
GVYLFTEAY

SEQ ID NO: 138418 - protein, 9 aa, Homo Sapiens
HAAGFFIAF

SEQ ID NO: 138419 - protein, 9 aa, Homo Sapiens
HAASVFLTL

SEQ ID NO: 138420 - protein, 9 aa, Homo Sapiens
HADDSFLVL

SEQ ID NO: 138421 - protein, 9 aa, Homo Sapiens
HAFVTEVAY

SEQ ID NO: 138422 - protein, 9 aa, Homo Sapiens
HAIPPTLAM

SEQ ID NO: 138423 - protein, 9 aa, Homo Sapiens
HAPFTATSL

SEQ ID NO: 138424 - protein, 9 aa, Homo Sapiens
HAYDNFLEH

SEQ ID NO: 138425 - protein, 9 aa, Homo Sapiens
HAYIHSVQF

SEQ ID NO: 138426 - protein, 9 aa, Homo Sapiens
HLRDYFEEY

SEQ ID NO: 138427 - protein, 9 aa, Homo Sapiens
HLRDYFEQY

SEQ ID NO: 138428 - protein, 9 aa, Homo Sapiens
HQDISLLYT

SEQ ID NO: 138429 - protein, 9 aa, Homo Sapiens
HSFYNGLSF

SEQ ID NO: 138430 - protein, 9 aa, Homo Sapiens
HSHLLKTPL

SEQ ID NO: 138431 - protein, 9 aa, Homo Sapiens
HSRLFDQAF

SEQ ID NO: 138432 - protein, 9 aa, Homo Sapiens
IAAPNMKAM

SEQ ID NO: 138433 - protein, 9 aa, Homo Sapiens
IAAVPATAM

SEQ ID NO: 138434 - protein, 9 aa, Homo Sapiens
IAFDPRSAY

SEQ ID NO: 138435 - protein, 9 aa, Homo Sapiens
IAFHFRVYF

SEQ ID NO: 138436 - protein, 9 aa, Homo Sapiens
IAHGFFSVY

SEQ ID NO: 138437 - protein, 9 aa, Homo Sapiens
IAHLFNVEW

SEQ ID NO: 138438 - protein, 9 aa, Homo Sapiens
IAHMYQVEF

SEQ ID NO: 138439 - protein, 9 aa, Homo Sapiens
IAIDVIDAY

SEQ ID NO: 138440 - protein, 9 aa, Homo Sapiens
IAIFKLPAF

SEQ ID NO: 138441 - protein, 9 aa, Homo Sapiens
IAIPFGTAL

SEQ ID NO: 138442 - protein, 9 aa, Homo Sapiens
IAIPVTQEL

SEQ ID NO: 138443 - protein, 9 aa, Homo Sapiens
IAIPVTVAF

SEQ ID NO: 138444 - protein, 9 aa, Homo Sapiens
IAISRTPVL

SEQ ID NO: 138445 - protein, 9 aa, Homo Sapiens
IAMPLHMIF

SEQ ID NO: 138446 - protein, 9 aa, Homo Sapiens
IANHQVLII

SEQ ID NO: 138447 - protein, 9 aa, Homo Sapiens
IAPGVTHEL

SEQ ID NO: 138448 - protein, 9 aa, Homo Sapiens
IAQDFKTDL

SEQ ID NO: 138449 - protein, 9 aa, Homo Sapiens
IAQPVRSFL

SEQ ID NO: 138450 - protein, 9 aa, Homo Sapiens
IARFFTEYF

SEQ ID NO: 138451 - protein, 9 aa, Homo Sapiens
IARLPSSTL

SEQ ID NO: 138452 - protein, 9 aa, Homo Sapiens
IASPALDTL

SEQ ID NO: 138453 - protein, 9 aa, Homo Sapiens
IASPVIAAV

SEQ ID NO: 138454 - protein, 9 aa, Homo Sapiens
IASPVQPVL

SEQ ID NO: 138455 - protein, 9 aa, Homo Sapiens
IATEIILEI

SEQ ID NO: 138456 - protein, 9 aa, Homo Sapiens
IAVYHLQEL

SEQ ID NO: 138457 - protein, 9 aa, Homo Sapiens
IAYDVTYSL

SEQ ID NO: 138458 - protein, 9 aa, Homo Sapiens
IAYIRDLAL

SEQ ID NO: 138459 - protein, 9 aa, Homo Sapiens
IAYTFARAF

SEQ ID NO: 138460 - protein, 9 aa, Homo Sapiens
IIAEPGRYY

SEQ ID NO: 138461 - protein, 9 aa, Homo Sapiens
IIAPPERKY

SEQ ID NO: 138462 - protein, 9 aa, Homo Sapiens
IIEPSLRQL

SEQ ID NO: 138463 - protein, 9 aa, Homo Sapiens
IINDLLQSL

SEQ ID NO: 138464 - protein, 9 aa, Homo Sapiens
IIYHLFDAF

SEQ ID NO: 138465 - protein, 9 aa, Homo Sapiens
ILGPPGSVY

SEQ ID NO: 138466 - protein, 9 aa, Homo Sapiens
ILMDDLSPK

SEQ ID NO: 138467 - protein, 9 aa, Homo Sapiens
ILYEFPRVF

SEQ ID NO: 138468 - protein, 9 aa, Homo Sapiens
ILYIRNLPY

SEQ ID NO: 138469 - protein, 9 aa, Homo Sapiens
ISEENFRVM

SEQ ID NO: 138470 - protein, 9 aa, Homo Sapiens
ISSPVILQF

SEQ ID NO: 138471 - protein, 9 aa, Homo Sapiens
ISTPVIRTF

SEQ ID NO: 138472 - protein, 9 aa, Homo Sapiens
IVIDPKNPL

SEQ ID NO: 138473 - protein, 9 aa, Homo Sapiens
IVNGHTLLV

SEQ ID NO: 138474 - protein, 9 aa, Homo Sapiens
IYRWFNISF

SEQ ID NO: 138475 - protein, 9 aa, Homo Sapiens
KAFDFPSSF

SEQ ID NO: 138476 - protein, 9 aa, Homo Sapiens
KAFPFHIIF

SEQ ID NO: 138477 - protein, 9 aa, Homo Sapiens
KAFPFYSSY

SEQ ID NO: 138478 - protein, 9 aa, Homo Sapiens
KAFSFLSSF

SEQ ID NO: 138479 - protein, 9 aa, Homo Sapiens
KAFSFPSSF

SEQ ID NO: 138480 - protein, 9 aa, Homo Sapiens
KAFTDFLAF

SEQ ID NO: 138481 - protein, 9 aa, Homo Sapiens
KAFVFSVAL

SEQ ID NO: 138482 - protein, 9 aa, Homo Sapiens
KAIELLQEF

SEQ ID NO: 138483 - protein, 9 aa, Homo Sapiens
KAINPINTF

SEQ ID NO: 138484 - protein, 9 aa, Homo Sapiens
KAIYHLEAF

SEQ ID NO: 138485 - protein, 9 aa, Homo Sapiens
KALEVFPEF

SEQ ID NO: 138486 - protein, 9 aa, Homo Sapiens
KANPALYVL

SEQ ID NO: 138487 - protein, 9 aa, Homo Sapiens
KARPFFNEF

SEQ ID NO: 138488 - protein, 9 aa, Homo Sapiens
KIHLFSMAF

SEQ ID NO: 138489 - protein, 9 aa, Homo Sapiens
KINEAFIEM

SEQ ID NO: 138490 - protein, 9 aa, Homo Sapiens
LAAARLAAA

SEQ ID NO: 138491 - protein, 9 aa, Homo Sapiens
LAAMLRGLA

SEQ ID NO: 138492 - protein, 9 aa, Homo Sapiens
LAAPVISVL

SEQ ID NO: 138493 - protein, 9 aa, Homo Sapiens
LADPVFRTL

SEQ ID NO: 138494 - protein, 9 aa, Homo Sapiens
LAFSRALEL

SEQ ID NO: 138495 - protein, 9 aa, Homo Sapiens
LAHAYFAQY

SEQ ID NO: 138496 - protein, 9 aa, Homo Sapiens
LAHEFLQNF

SEQ ID NO: 138497 - protein, 9 aa, Homo Sapiens
LAHLHLIEY

SEQ ID NO: 138498 - protein, 9 aa, Homo Sapiens
LAHSFVTSF

SEQ ID NO: 138499 - protein, 9 aa, Homo Sapiens
LAIEHVRFF

SEQ ID NO: 138500 - protein, 9 aa, Homo Sapiens
LAIPITNTY

SEQ ID NO: 138501 - protein, 9 aa, Homo Sapiens
LAIPQLPSL

SEQ ID NO: 138502 - protein, 9 aa, Homo Sapiens
LAIPVFLTL

SEQ ID NO: 138503 - protein, 9 aa, Homo Sapiens
LAIVPVNTL

SEQ ID NO: 138504 - protein, 9 aa, Homo Sapiens
LAKDFYVAF

SEQ ID NO: 138505 - protein, 9 aa, Homo Sapiens
LAKGWAPTF

SEQ ID NO: 138506 - protein, 9 aa, Homo Sapiens
LAKNFFNEL

SEQ ID NO: 138507 - protein, 9 aa, Homo Sapiens
LALAIAQEL

SEQ ID NO: 138508 - protein, 9 aa, Homo Sapiens
LALAQLSIA

SEQ ID NO: 138509 - protein, 9 aa, Homo Sapiens
LALDHLHSL

SEQ ID NO: 138510 - protein, 9 aa, Homo Sapiens
LALEPGVAY

SEQ ID NO: 138511 - protein, 9 aa, Homo Sapiens
LALFPGVAL

SEQ ID NO: 138512 - protein, 9 aa, Homo Sapiens
LALLRPALP

SEQ ID NO: 138513 - protein, 9 aa, Homo Sapiens
LALSPRLEY

SEQ ID NO: 138514 - protein, 9 aa, Homo Sapiens
LAMEPTPEL

SEQ ID NO: 138515 - protein, 9 aa, Homo Sapiens
LAMKLLKEL

SEQ ID NO: 138516 - protein, 9 aa, Homo Sapiens
LAMRPLASL

SEQ ID NO: 138517 - protein, 9 aa, Homo Sapiens
LANGEVRIY

SEQ ID NO: 138518 - protein, 9 aa, Homo Sapiens
LANGSILVY

SEQ ID NO: 138519 - protein, 9 aa, Homo Sapiens
LANIRSPVF

SEQ ID NO: 138520 - protein, 9 aa, Homo Sapiens
LANPHELSL

SEQ ID NO: 138521 - protein, 9 aa, Homo Sapiens
LAQQYYLVY

SEQ ID NO: 138522 - protein, 9 aa, Homo Sapiens
LAREFLAAM

SEQ ID NO: 138523 - protein, 9 aa, Homo Sapiens
LARFNAHEF

SEQ ID NO: 138524 - protein, 9 aa, Homo Sapiens
LARIIDSEY

SEQ ID NO: 138525 - protein, 9 aa, Homo Sapiens
LARPASAAL

SEQ ID NO: 138526 - protein, 9 aa, Homo Sapiens
LASPESLEL

SEQ ID NO: 138527 - protein, 9 aa, Homo Sapiens
LASPVSPEL

SEQ ID NO: 138528 - protein, 9 aa, Homo Sapiens
LASYVHYVF

SEQ ID NO: 138529 - protein, 9 aa, Homo Sapiens
LATAAALTY

SEQ ID NO: 138530 - protein, 9 aa, Homo Sapiens
LATDFIQSL

SEQ ID NO: 138531 - protein, 9 aa, Homo Sapiens
LATGAAMVL

SEQ ID NO: 138532 - protein, 9 aa, Homo Sapiens
LATRAIPEL

SEQ ID NO: 138533 - protein, 9 aa, Homo Sapiens
LATSHMLEL

SEQ ID NO: 138534 - protein, 9 aa, Homo Sapiens
LATWATKEL

SEQ ID NO: 138535 - protein, 9 aa, Homo Sapiens
LAVDGLMEM

SEQ ID NO: 138536 - protein, 9 aa, Homo Sapiens
LAVENLPSL

SEQ ID NO: 138537 - protein, 9 aa, Homo Sapiens
LAVEPGSNL

SEQ ID NO: 138538 - protein, 9 aa, Homo Sapiens
LAVPDMSSL

SEQ ID NO: 138539 - protein, 9 aa, Homo Sapiens
LAVSVLREI

SEQ ID NO: 138540 - protein, 9 aa, Homo Sapiens
LAWVHATVY

SEQ ID NO: 138541 - protein, 9 aa, Homo Sapiens
LAWVSSQFY

SEQ ID NO: 138542 - protein, 9 aa, Homo Sapiens
LAYIAHPKL

SEQ ID NO: 138543 - protein, 9 aa, Homo Sapiens
LAYIHLIEF

SEQ ID NO: 138544 - protein, 9 aa, Homo Sapiens
LAYLQRIAL

SEQ ID NO: 138545 - protein, 9 aa, Homo Sapiens
LAYTLARVY

SEQ ID NO: 138546 - protein, 9 aa, Homo Sapiens
LGYYHKHAF

SEQ ID NO: 138547 - protein, 9 aa, Homo Sapiens
LIHGDFNEF

SEQ ID NO: 138548 - protein, 9 aa, Homo Sapiens
LIIANTMAF

SEQ ID NO: 138549 - protein, 9 aa, Homo Sapiens
LIREYIVEY

SEQ ID NO: 138550 - protein, 9 aa, Homo Sapiens
LIRPVSASF

SEQ ID NO: 138551 - protein, 9 aa, Homo Sapiens
LIRPWFPEF

SEQ ID NO: 138552 - protein, 9 aa, Homo Sapiens
LIYEHLQQY

SEQ ID NO: 138553 - protein, 9 aa, Homo Sapiens
LLHAFQATF

SEQ ID NO: 138554 - protein, 9 aa, Homo Sapiens
LLHVFSTEF

SEQ ID NO: 138555 - protein, 9 aa, Homo Sapiens
LLNGQRLEL

SEQ ID NO: 138556 - protein, 9 aa, Homo Sapiens
LLRAPGAEL

SEQ ID NO: 138557 - protein, 9 aa, Homo Sapiens
LLRTPGASL

SEQ ID NO: 138558 - protein, 9 aa, Homo Sapiens
LLYIFKQPF

SEQ ID NO: 138559 - protein, 9 aa, Homo Sapiens
LQFPVGRVH

SEQ ID NO: 138560 - protein, 9 aa, Homo Sapiens
LSFPTTKTY

SEQ ID NO: 138561 - protein, 9 aa, Homo Sapiens
LSFTHPISF

SEQ ID NO: 138562 - protein, 9 aa, Homo Sapiens
LSFTHPTSF

SEQ ID NO: 138563 - protein, 9 aa, Homo Sapiens
LSHSLLVTL

SEQ ID NO: 138564 - protein, 9 aa, Homo Sapiens
LSIPRLPSM

SEQ ID NO: 138565 - protein, 9 aa, Homo Sapiens
LSIPYRLIF

SEQ ID NO: 138566 - protein, 9 aa, Homo Sapiens
LSKGPGLEV

SEQ ID NO: 138567 - protein, 9 aa, Homo Sapiens
LSMERMVPA

SEQ ID NO: 138568 - protein, 9 aa, Homo Sapiens
LSSTVTLEH

SEQ ID NO: 138569 - protein, 9 aa, Homo Sapiens
LTHLFKNYF

SEQ ID NO: 138570 - protein, 9 aa, Homo Sapiens
LTHPFFEPF

SEQ ID NO: 138571 - protein, 9 aa, Homo Sapiens
LTTDISLIF

SEQ ID NO: 138572 - protein, 9 aa, Homo Sapiens
LTVEPGASL

SEQ ID NO: 138573 - protein, 9 aa, Homo Sapiens
LVFPFRTFY

SEQ ID NO: 138574 - protein, 9 aa, Homo Sapiens
LVIDKLKEM

SEQ ID NO: 138575 - protein, 9 aa, Homo Sapiens
LVLAPTREL

SEQ ID NO: 138576 - protein, 9 aa, Homo Sapiens
LVNGKSLEL

SEQ ID NO: 138577 - protein, 9 aa, Homo Sapiens
LVREIAQDF

SEQ ID NO: 138578 - protein, 9 aa, Homo Sapiens
MAAMPQTVY

SEQ ID NO: 138579 - protein, 9 aa, Homo Sapiens
MADPNIRFL

SEQ ID NO: 138580 - protein, 9 aa, Homo Sapiens
MAFLYHVAY

SEQ ID NO: 138581 - protein, 9 aa, Homo Sapiens
MAHSFGESY

SEQ ID NO: 138582 - protein, 9 aa, Homo Sapiens
MALAVRVVY

SEQ ID NO: 138583 - protein, 9 aa, Homo Sapiens
MALLFLLPL

SEQ ID NO: 138584 - protein, 9 aa, Homo Sapiens
MANGAVIHL

SEQ ID NO: 138585 - protein, 9 aa, Homo Sapiens
MANPTALLL

SEQ ID NO: 138586 - protein, 9 aa, Homo Sapiens
MAPLKMLAL

SEQ ID NO: 138587 - protein, 9 aa, Homo Sapiens
MATVVYKVF

SEQ ID NO: 138588 - protein, 9 aa, Homo Sapiens
MAVEFLHEL

SEQ ID NO: 138589 - protein, 9 aa, Homo Sapiens
MAYVSGLSF

SEQ ID NO: 138590 - protein, 9 aa, Homo Sapiens
MIIEPTSPC

SEQ ID NO: 138591 - protein, 9 aa, Homo Sapiens
MSVQPTVSL

SEQ ID NO: 138592 - protein, 9 aa, Homo Sapiens
MVADKFTEL

SEQ ID NO: 138593 - protein, 9 aa, Homo Sapiens
NAFDVFAAY

SEQ ID NO: 138594 - protein, 9 aa, Homo Sapiens
NAHEFITSF

SEQ ID NO: 138595 - protein, 9 aa, Homo Sapiens
NAIEGLTEY

SEQ ID NO: 138596 - protein, 9 aa, Homo Sapiens
NAIIFRESF

SEQ ID NO: 138597 - protein, 9 aa, Homo Sapiens
NALPALLIY

SEQ ID NO: 138598 - protein, 9 aa, Homo Sapiens
NAMDVVVQF

SEQ ID NO: 138599 - protein, 9 aa, Homo Sapiens
NAVAALSEI

SEQ ID NO: 138600 - protein, 9 aa, Homo Sapiens
NGFGGFGSY

SEQ ID NO: 138601 - protein, 9 aa, Homo Sapiens
NIREIEIDY

SEQ ID NO: 138602 - protein, 9 aa, Homo Sapiens
NVYDFKTTY

SEQ ID NO: 138603 - protein, 9 aa, Homo Sapiens
PIRLLAAAA

SEQ ID NO: 138604 - protein, 9 aa, Homo Sapiens
QAFEFSEAF

SEQ ID NO: 138605 - protein, 9 aa, Homo Sapiens
QATPVPLEF

SEQ ID NO: 138606 - protein, 9 aa, Homo Sapiens
QAVAIFTVY

SEQ ID NO: 138607 - protein, 9 aa, Homo Sapiens
QIAEFKEAF

SEQ ID NO: 138608 - protein, 9 aa, Homo Sapiens
QQNPQPLIF

SEQ ID NO: 138609 - protein, 9 aa, Homo Sapiens
RAAPFSLEY

SEQ ID NO: 138610 - protein, 9 aa, Homo Sapiens
RAINIALQL

SEQ ID NO: 138611 - protein, 9 aa, Homo Sapiens
RAIQFYLEF

SEQ ID NO: 138612 - protein, 9 aa, Homo Sapiens
RALDHYLTL

SEQ ID NO: 138613 - protein, 9 aa, Homo Sapiens
RGYDFPAVL

SEQ ID NO: 138614 - protein, 9 aa, Homo Sapiens
RIADLISSF

SEQ ID NO: 138615 - protein, 9 aa, Homo Sapiens
RIIEETLAL

SEQ ID NO: 138616 - protein, 9 aa, Homo Sapiens
RIVDALNEF

SEQ ID NO: 138617 - protein, 9 aa, Homo Sapiens
RSFPGFQAF

SEQ ID NO: 138618 - protein, 9 aa, Homo Sapiens
SAADFFSHY

SEQ ID NO: 138619 - protein, 9 aa, Homo Sapiens
SAAFPGASL

SEQ ID NO: 138620 - protein, 9 aa, Homo Sapiens
SAAQPGVAF

SEQ ID NO: 138621 - protein, 9 aa, Homo Sapiens
SAFDHFASV

SEQ ID NO: 138622 - protein, 9 aa, Homo Sapiens
SAFGYFITA

SEQ ID NO: 138623 - protein, 9 aa, Homo Sapiens
SAFSGFPSF

SEQ ID NO: 138624 - protein, 9 aa, Homo Sapiens
SAHLAFMTF

SEQ ID NO: 138625 - protein, 9 aa, Homo Sapiens
SAHLFEVEL

SEQ ID NO: 138626 - protein, 9 aa, Homo Sapiens
SAIGYIHSL

SEQ ID NO: 138627 - protein, 9 aa, Homo Sapiens
SAIHVLASL

SEQ ID NO: 138628 - protein, 9 aa, Homo Sapiens
SAINELMQM

SEQ ID NO: 138629 - protein, 9 aa, Homo Sapiens
SAIPHPLIM

SEQ ID NO: 138630 - protein, 9 aa, Homo Sapiens
SALEKFFYF

SEQ ID NO: 138631 - protein, 9 aa, Homo Sapiens
SALFFGNAF

SEQ ID NO: 138632 - protein, 9 aa, Homo Sapiens
SAMPTVRSF

SEQ ID NO: 138633 - protein, 9 aa, Homo Sapiens
SANDIYLIF

SEQ ID NO: 138634 - protein, 9 aa, Homo Sapiens
SANIRLTAM

SEQ ID NO: 138635 - protein, 9 aa, Homo Sapiens
SANNVYLVM

SEQ ID NO: 138636 - protein, 9 aa, Homo Sapiens
SAPIFTTSL

SEQ ID NO: 138637 - protein, 9 aa, Homo Sapiens
SAVSIFHEL

SEQ ID NO: 138638 - protein, 9 aa, Homo Sapiens
SAWSFITTF

SEQ ID NO: 138639 - protein, 9 aa, Homo Sapiens
SAYAGFLAL

SEQ ID NO: 138640 - protein, 9 aa, Homo Sapiens
SAYNAFNRF

SEQ ID NO: 138641 - protein, 9 aa, Homo Sapiens
SAYVKKIQF

SEQ ID NO: 138642 - protein, 9 aa, Homo Sapiens
SGIERMGPL

SEQ ID NO: 138643 - protein, 9 aa, Homo Sapiens
SIFDDFAHY

SEQ ID NO: 138644 - protein, 9 aa, Homo Sapiens
SIFDDFSHY

SEQ ID NO: 138645 - protein, 9 aa, Homo Sapiens
SIFDGFRDF

SEQ ID NO: 138646 - protein, 9 aa, Homo Sapiens
SIFDSFPTY

SEQ ID NO: 138647 - protein, 9 aa, Homo Sapiens
SIIEYLPTL

SEQ ID NO: 138648 - protein, 9 aa, Homo Sapiens
SIIGRLLEV

SEQ ID NO: 138649 - protein, 9 aa, Homo Sapiens
SIIKKLAAL

SEQ ID NO: 138650 - protein, 9 aa, Homo Sapiens
SIIQRLLEV

SEQ ID NO: 138651 - protein, 9 aa, Homo Sapiens
SIKDYFLEF

SEQ ID NO: 138652 - protein, 9 aa, Homo Sapiens
SILEKTSAY

SEQ ID NO: 138653 - protein, 9 aa, Homo Sapiens
SILGNLKDM

SEQ ID NO: 138654 - protein, 9 aa, Homo Sapiens
SIMDEFQEY

SEQ ID NO: 138655 - protein, 9 aa, Homo Sapiens
SIQVPGMQM

SEQ ID NO: 138656 - protein, 9 aa, Homo Sapiens
SIREAGGAF

SEQ ID NO: 138657 - protein, 9 aa, Homo Sapiens
SIVENIRIY

SEQ ID NO: 138658 - protein, 9 aa, Homo Sapiens
SIYATLAIH

SEQ ID NO: 138659 - protein, 9 aa, Homo Sapiens
SIYWTAVTY

SEQ ID NO: 138660 - protein, 9 aa, Homo Sapiens
SLIEQTTAL

SEQ ID NO: 138661 - protein, 9 aa, Homo Sapiens
SNYHFGVTY

SEQ ID NO: 138662 - protein, 9 aa, Homo Sapiens
SSFGDFVAL

SEQ ID NO: 138663 - protein, 9 aa, Homo Sapiens
SSVPGVRLL

SEQ ID NO: 138664 - protein, 9 aa, Homo Sapiens
STFFPFHEY

SEQ ID NO: 138665 - protein, 9 aa, Homo Sapiens
SVAGKLSVF

SEQ ID NO: 138666 - protein, 9 aa, Homo Sapiens
SVPAFASSL

SEQ ID NO: 138667 - protein, 9 aa, Homo Sapiens
SVVAVPLPL

SEQ ID NO: 138668 - protein, 9 aa, Homo Sapiens
TAAFLIPLL

SEQ ID NO: 138669 - protein, 9 aa, Homo Sapiens
TAAPTIGVL

SEQ ID NO: 138670 - protein, 9 aa, Homo Sapiens
TAAVFKETF

SEQ ID NO: 138671 - protein, 9 aa, Homo Sapiens
TAFFFAGYY

SEQ ID NO: 138672 - protein, 9 aa, Homo Sapiens
TAFGGFLKY

SEQ ID NO: 138673 - protein, 9 aa, Homo Sapiens
TAISLFYEL

SEQ ID NO: 138674 - protein, 9 aa, Homo Sapiens
TALPTRIAY

SEQ ID NO: 138675 - protein, 9 aa, Homo Sapiens
TAMPKLLSY

SEQ ID NO: 138676 - protein, 9 aa, Homo Sapiens
TARPPGYEF

SEQ ID NO: 138677 - protein, 9 aa, Homo Sapiens
TARYIYISY

SEQ ID NO: 138678 - protein, 9 aa, Homo Sapiens
TAYDNFVEL

SEQ ID NO: 138679 - protein, 9 aa, Homo Sapiens
TIIPKVLAM

SEQ ID NO: 138680 - protein, 9 aa, Homo Sapiens
TILGGLNEF

SEQ ID NO: 138681 - protein, 9 aa, Homo Sapiens
TSFKHFIFF

SEQ ID NO: 138682 - protein, 9 aa, Homo Sapiens
TSPEAFLAL

SEQ ID NO: 138683 - protein, 9 aa, Homo Sapiens
TSSPSILTL

SEQ ID NO: 138684 - protein, 9 aa, Homo Sapiens
TVPVRLSSL

SEQ ID NO: 138685 - protein, 9 aa, Homo Sapiens
TVQPHFLEF

SEQ ID NO: 138686 - protein, 9 aa, Homo Sapiens
VAAPLLSAY

SEQ ID NO: 138687 - protein, 9 aa, Homo Sapiens
VAAPQLPVL

SEQ ID NO: 138688 - protein, 9 aa, Homo Sapiens
VAFGSHMSF

SEQ ID NO: 138689 - protein, 9 aa, Homo Sapiens
VAFPSSSVY

SEQ ID NO: 138690 - protein, 9 aa, Homo Sapiens
VAGPNIAAI

SEQ ID NO: 138691 - protein, 9 aa, Homo Sapiens
VAIAGLMEV

SEQ ID NO: 138692 - protein, 9 aa, Homo Sapiens
VAINRLLSM

SEQ ID NO: 138693 - protein, 9 aa, Homo Sapiens
VAIPVSIFY

SEQ ID NO: 138694 - protein, 9 aa, Homo Sapiens
VAKWATVTF

SEQ ID NO: 138695 - protein, 9 aa, Homo Sapiens
VALDFEQEM

SEQ ID NO: 138696 - protein, 9 aa, Homo Sapiens
VALLRVTPF

SEQ ID NO: 138697 - protein, 9 aa, Homo Sapiens
VALPMVLVL

SEQ ID NO: 138698 - protein, 9 aa, Homo Sapiens
VALPPGLAV

SEQ ID NO: 138699 - protein, 9 aa, Homo Sapiens
VALPVFLVI

SEQ ID NO: 138700 - protein, 9 aa, Homo Sapiens
VAMIYPLEY

SEQ ID NO: 138701 - protein, 9 aa, Homo Sapiens
VANPAFLKY

SEQ ID NO: 138702 - protein, 9 aa, Homo Sapiens
VANPNSAIF

SEQ ID NO: 138703 - protein, 9 aa, Homo Sapiens
VANVFLEAY

SEQ ID NO: 138704 - protein, 9 aa, Homo Sapiens
VAPLPRSAL

SEQ ID NO: 138705 - protein, 9 aa, Homo Sapiens
VAPVAQVAL

SEQ ID NO: 138706 - protein, 9 aa, Homo Sapiens
VARPDVVEM

SEQ ID NO: 138707 - protein, 9 aa, Homo Sapiens
VARPLSTAL

SEQ ID NO: 138708 - protein, 9 aa, Homo Sapiens
VARPVFTEY

SEQ ID NO: 138709 - protein, 9 aa, Homo Sapiens
VAVDGLNQL

SEQ ID NO: 138710 - protein, 9 aa, Homo Sapiens
VAVHVFSEF

SEQ ID NO: 138711 - protein, 9 aa, Homo Sapiens
VAVPVAVTF

SEQ ID NO: 138712 - protein, 9 aa, Homo Sapiens
VAVSMLNVY

SEQ ID NO: 138713 - protein, 9 aa, Homo Sapiens
VAYMNPIAM

SEQ ID NO: 138714 - protein, 9 aa, Homo Sapiens
VAYPCAILY

SEQ ID NO: 138715 - protein, 9 aa, Homo Sapiens
VAYVSSVAL

SEQ ID NO: 138716 - protein, 9 aa, Homo Sapiens
VAYWRQAGL

SEQ ID NO: 138717 - protein, 9 aa, Homo Sapiens
VEKTAIFAF

SEQ ID NO: 138718 - protein, 9 aa, Homo Sapiens
VIFEGFFAH

SEQ ID NO: 138719 - protein, 9 aa, Homo Sapiens
VILPPLSPY

SEQ ID NO: 138720 - protein, 9 aa, Homo Sapiens
VIRDFAGPY

SEQ ID NO: 138721 - protein, 9 aa, Homo Sapiens
VNNPHFLIM

SEQ ID NO: 138722 - protein, 9 aa, Homo Sapiens
VSAGIQTSF

SEQ ID NO: 138723 - protein, 9 aa, Homo Sapiens
VSFHFSNYF

SEQ ID NO: 138724 - protein, 9 aa, Homo Sapiens
VSHFFSLPF

SEQ ID NO: 138725 - protein, 9 aa, Homo Sapiens
VSSFVFLRF

SEQ ID NO: 138726 - protein, 9 aa, Homo Sapiens
VSYEFKFPF

SEQ ID NO: 138727 - protein, 9 aa, Homo Sapiens
VTRPTGVSF

SEQ ID NO: 138728 - protein, 9 aa, Homo Sapiens
VTVPPGPSL

SEQ ID NO: 138729 - protein, 9 aa, Homo Sapiens
VTVRPGLAM

SEQ ID NO: 138730 - protein, 9 aa, Homo Sapiens
VTYSFRQSF

SEQ ID NO: 138731 - protein, 9 aa, Homo Sapiens
VTYVPVTTF

SEQ ID NO: 138732 - protein, 9 aa, Homo Sapiens
VVFFNKRVY

SEQ ID NO: 138733 - protein, 9 aa, Homo Sapiens
VVKMPSGEF

SEQ ID NO: 138734 - protein, 9 aa, Homo Sapiens
VVKPPGSSL

SEQ ID NO: 138735 - protein, 9 aa, Homo Sapiens
VVNGRVLEL

SEQ ID NO: 138736 - protein, 9 aa, Homo Sapiens
VVPDQLMAF

SEQ ID NO: 138737 - protein, 9 aa, Homo Sapiens
VVPTAILAF

SEQ ID NO: 138738 - protein, 9 aa, Homo Sapiens
VVVDPIQSV

SEQ ID NO: 138739 - protein, 9 aa, Homo Sapiens
VVYPWTQRF

SEQ ID NO: 138740 - protein, 9 aa, Homo Sapiens
WAMEQVLEF

SEQ ID NO: 138741 - protein, 9 aa, Homo Sapiens
WARPLSVSF

SEQ ID NO: 138742 - protein, 9 aa, Homo Sapiens
WGVPIEKIY

SEQ ID NO: 138743 - protein, 9 aa, Homo Sapiens
WQNPHMLFL

SEQ ID NO: 138744 - protein, 9 aa, Homo Sapiens
WSLPATATM

SEQ ID NO: 138745 - protein, 9 aa, Homo Sapiens
YAAGAKLVL

SEQ ID NO: 138746 - protein, 9 aa, Homo Sapiens
YAALHGEFY

SEQ ID NO: 138747 - protein, 9 aa, Homo Sapiens
YAALNLAAL

SEQ ID NO: 138748 - protein, 9 aa, Homo Sapiens
YAANPGQLF

SEQ ID NO: 138749 - protein, 9 aa, Homo Sapiens
YAAPHFFHL

SEQ ID NO: 138750 - protein, 9 aa, Homo Sapiens
YAAPPHVIH

SEQ ID NO: 138751 - protein, 9 aa, Homo Sapiens
YAAPQLRSI

SEQ ID NO: 138752 - protein, 9 aa, Homo Sapiens
YAAPWFLTL

SEQ ID NO: 138753 - protein, 9 aa, Homo Sapiens
YAAQNLLSH

SEQ ID NO: 138754 - protein, 9 aa, Homo Sapiens
YAAQQLPSL

SEQ ID NO: 138755 - protein, 9 aa, Homo Sapiens
YAAYPLTEV

SEQ ID NO: 138756 - protein, 9 aa, Homo Sapiens
YAFDFARQS

SEQ ID NO: 138757 - protein, 9 aa, Homo Sapiens
YAFGGGCEL

SEQ ID NO: 138758 - protein, 9 aa, Homo Sapiens
YAFIEFASF

SEQ ID NO: 138759 - protein, 9 aa, Homo Sapiens
YAFKFFDTY

SEQ ID NO: 138760 - protein, 9 aa, Homo Sapiens
YAFNMKATV

SEQ ID NO: 138761 - protein, 9 aa, Homo Sapiens
YAFPKAVSV

SEQ ID NO: 138762 - protein, 9 aa, Homo Sapiens
YAFPKSITV

SEQ ID NO: 138763 - protein, 9 aa, Homo Sapiens
YAFQFVGAY

SEQ ID NO: 138764 - protein, 9 aa, Homo Sapiens
YAFVRPVIL

SEQ ID NO: 138765 - protein, 9 aa, Homo Sapiens
YAGYIPQAF

SEQ ID NO: 138766 - protein, 9 aa, Homo Sapiens
YAHIYHQHF

SEQ ID NO: 138767 - protein, 9 aa, Homo Sapiens
YAIDNPLHY

SEQ ID NO: 138768 - protein, 9 aa, Homo Sapiens
YAIDSVLEV

SEQ ID NO: 138769 - protein, 9 aa, Homo Sapiens
YAIESQLQL

SEQ ID NO: 138770 - protein, 9 aa, Homo Sapiens
YAIEVDPVL

SEQ ID NO: 138771 - protein, 9 aa, Homo Sapiens
YAIFRILLY

SEQ ID NO: 138772 - protein, 9 aa, Homo Sapiens
YAIGLVMRL

SEQ ID NO: 138773 - protein, 9 aa, Homo Sapiens
YAIGVSHPL

SEQ ID NO: 138774 - protein, 9 aa, Homo Sapiens
YAISAGVSL

SEQ ID NO: 138775 - protein, 9 aa, Homo Sapiens
YAISKPDIL

SEQ ID NO: 138776 - protein, 9 aa, Homo Sapiens
YAISKPEVL

SEQ ID NO: 138777 - protein, 9 aa, Homo Sapiens
YAISPGLDI

SEQ ID NO: 138778 - protein, 9 aa, Homo Sapiens
YAITTLHNL

SEQ ID NO: 138779 - protein, 9 aa, Homo Sapiens
YAIVRFNQY

SEQ ID NO: 138780 - protein, 9 aa, Homo Sapiens
YAKDDPLEF

SEQ ID NO: 138781 - protein, 9 aa, Homo Sapiens
YAKIVEIPF

SEQ ID NO: 138782 - protein, 9 aa, Homo Sapiens
YAKRPGIGL

SEQ ID NO: 138783 - protein, 9 aa, Homo Sapiens
YALELLTVY

SEQ ID NO: 138784 - protein, 9 aa, Homo Sapiens
YALNHTLSV

SEQ ID NO: 138785 - protein, 9 aa, Homo Sapiens
YALTAIMKL

SEQ ID NO: 138786 - protein, 9 aa, Homo Sapiens
YAMDELRSL

SEQ ID NO: 138787 - protein, 9 aa, Homo Sapiens
YAMPSSTPL

SEQ ID NO: 138788 - protein, 9 aa, Homo Sapiens
YANDVTRVL

SEQ ID NO: 138789 - protein, 9 aa, Homo Sapiens
YANEVGEAF

SEQ ID NO: 138790 - protein, 9 aa, Homo Sapiens
YAQIRTIAI

SEQ ID NO: 138791 - protein, 9 aa, Homo Sapiens
YAQLHSFTL

SEQ ID NO: 138792 - protein, 9 aa, Homo Sapiens
YAQLHSLTL

SEQ ID NO: 138793 - protein, 9 aa, Homo Sapiens
YARAKFLDY

SEQ ID NO: 138794 - protein, 9 aa, Homo Sapiens
YARDETEFY

SEQ ID NO: 138795 - protein, 9 aa, Homo Sapiens
YARLHPRAV

SEQ ID NO: 138796 - protein, 9 aa, Homo Sapiens
YASSPGMSL

SEQ ID NO: 138797 - protein, 9 aa, Homo Sapiens
YAVNSQFTM

SEQ ID NO: 138798 - protein, 9 aa, Homo Sapiens
YAVPALEAH

SEQ ID NO: 138799 - protein, 9 aa, Homo Sapiens
YAVSELAGH

SEQ ID NO: 138800 - protein, 9 aa, Homo Sapiens
YAYATVLTF

SEQ ID NO: 138801 - protein, 9 aa, Homo Sapiens
YAYFNFPEL

SEQ ID NO: 138802 - protein, 9 aa, Homo Sapiens
YAYKDFLWF

SEQ ID NO: 138803 - protein, 9 aa, Homo Sapiens
YAYPGVLLI

SEQ ID NO: 138804 - protein, 9 aa, Homo Sapiens
YAYPYSYYY

SEQ ID NO: 138805 - protein, 9 aa, Homo Sapiens
YAYTGRLEL

SEQ ID NO: 138806 - protein, 9 aa, Homo Sapiens
YFFTWDTEY

SEQ ID NO: 138807 - protein, 9 aa, Homo Sapiens
YFWPRTVPM

SEQ ID NO: 138808 - protein, 9 aa, Homo Sapiens
YFYVIGSSY

SEQ ID NO: 138809 - protein, 9 aa, Homo Sapiens
YGIEHALAL

SEQ ID NO: 138810 - protein, 9 aa, Homo Sapiens
YGIPFYLQY

SEQ ID NO: 138811 - protein, 9 aa, Homo Sapiens
YGSPGILEF

SEQ ID NO: 138812 - protein, 9 aa, Homo Sapiens
YGSPNALVL

SEQ ID NO: 138813 - protein, 9 aa, Homo Sapiens
YIIGVFRKF

SEQ ID NO: 138814 - protein, 9 aa, Homo Sapiens
YIISGLTGF

SEQ ID NO: 138815 - protein, 9 aa, Homo Sapiens
YILDQTNVY

SEQ ID NO: 138816 - protein, 9 aa, Homo Sapiens
YILGKFFAL

SEQ ID NO: 138817 - protein, 9 aa, Homo Sapiens
YIMAPGLLH

SEQ ID NO: 138818 - protein, 9 aa, Homo Sapiens
YIMDWMDEM

SEQ ID NO: 138819 - protein, 9 aa, Homo Sapiens
YIPHGYMEL

SEQ ID NO: 138820 - protein, 9 aa, Homo Sapiens
YIQEHLLQI

SEQ ID NO: 138821 - protein, 9 aa, Homo Sapiens
YIRDLALEY

SEQ ID NO: 138822 - protein, 9 aa, Homo Sapiens
YIYPKHLKY

SEQ ID NO: 138823 - protein, 9 aa, Homo Sapiens
YLLDHFLSM

SEQ ID NO: 138824 - protein, 9 aa, Homo Sapiens
YLLPDTKAY

SEQ ID NO: 138825 - protein, 9 aa, Homo Sapiens
YLLPHILVY

SEQ ID NO: 138826 - protein, 9 aa, Homo Sapiens
YLNDAFLEF

SEQ ID NO: 138827 - protein, 9 aa, Homo Sapiens
YLRPPNTSL

SEQ ID NO: 138828 - protein, 9 aa, Homo Sapiens
YNMPYPPVY

SEQ ID NO: 138829 - protein, 9 aa, Homo Sapiens
YQIAVTKVL

SEQ ID NO: 138830 - protein, 9 aa, Homo Sapiens
YQQELEREL

SEQ ID NO: 138831 - protein, 9 aa, Homo Sapiens
YSAPVIHVL

SEQ ID NO: 138832 - protein, 9 aa, Homo Sapiens
YSFDYPSDM

SEQ ID NO: 138833 - protein, 9 aa, Homo Sapiens
YSFHKFHYL

SEQ ID NO: 138834 - protein, 9 aa, Homo Sapiens
YSGSPTSYF

SEQ ID NO: 138835 - protein, 9 aa, Homo Sapiens
YSIVGLSSL

SEQ ID NO: 138836 - protein, 9 aa, Homo Sapiens
YSKLPGVSL

SEQ ID NO: 138837 - protein, 9 aa, Homo Sapiens
YSLDHISSL

SEQ ID NO: 138838 - protein, 9 aa, Homo Sapiens
YSLPNAPTL

SEQ ID NO: 138839 - protein, 9 aa, Homo Sapiens
YSMDENLEF

SEQ ID NO: 138840 - protein, 9 aa, Homo Sapiens
YSMPISIEF

SEQ ID NO: 138841 - protein, 9 aa, Homo Sapiens
YSMPSTHAM

SEQ ID NO: 138842 - protein, 9 aa, Homo Sapiens
YSSSRTLLF

SEQ ID NO: 138843 - protein, 9 aa, Homo Sapiens
YSVDRLYEL

SEQ ID NO: 138844 - protein, 9 aa, Homo Sapiens
YSVYVYKVL

SEQ ID NO: 138845 - protein, 9 aa, Homo Sapiens
YSYFHFVFF

SEQ ID NO: 138846 - protein, 9 aa, Homo Sapiens
YSYFSPRTM

SEQ ID NO: 138847 - protein, 9 aa, Homo Sapiens
YTFEDRINF

SEQ ID NO: 138848 - protein, 9 aa, Homo Sapiens
YTLINHRVL

SEQ ID NO: 138849 - protein, 9 aa, Homo Sapiens
YTMPNFRQY

SEQ ID NO: 138850 - protein, 9 aa, Homo Sapiens
YTTDFIYQL

SEQ ID NO: 138851 - protein, 9 aa, Homo Sapiens
YTVTDLVEY

SEQ ID NO: 138852 - protein, 9 aa, Homo Sapiens
YTYLRINFY

SEQ ID NO: 138853 - protein, 9 aa, Homo Sapiens
YVIQHVLEH

SEQ ID NO: 138854 - protein, 9 aa, Homo Sapiens
YVIQKFFEF

SEQ ID NO: 138855 - protein, 9 aa, Homo Sapiens
YVNLPTIAL

SEQ ID NO: 138856 - protein, 9 aa, Homo Sapiens
YVTTSTRTY

SEQ ID NO: 138857 - protein, 9 aa, Homo Sapiens
YVYPKYLKY

SEQ ID NO: 138858 - protein, 9 aa, Homo Sapiens
YVYSHFLQF

SEQ ID NO: 138859 - protein, 10 aa, Homo Sapiens
AAINPELLQL

SEQ ID NO: 138860 - protein, 10 aa, Homo Sapiens
ALIEFIRSEY

SEQ ID NO: 138861 - protein, 10 aa, Homo Sapiens
ALPEDDFLSL

SEQ ID NO: 138862 - protein, 10 aa, Homo Sapiens
FAANFGAIGF

SEQ ID NO: 138863 - protein, 10 aa, Homo Sapiens
FADPHGKRVF

SEQ ID NO: 138864 - protein, 10 aa, Homo Sapiens
FADPHSKRVF

SEQ ID NO: 138865 - protein, 10 aa, Homo Sapiens
FAESGWRSAL

SEQ ID NO: 138866 - protein, 10 aa, Homo Sapiens
FAFESDLHSL

SEQ ID NO: 138867 - protein, 10 aa, Homo Sapiens
FAIGGIARTY

SEQ ID NO: 138868 - protein, 10 aa, Homo Sapiens
FAKTFVGTPY

SEQ ID NO: 138869 - protein, 10 aa, Homo Sapiens
FALDGLKQVM

SEQ ID NO: 138870 - protein, 10 aa, Homo Sapiens
FALGLPFLVL

SEQ ID NO: 138871 - protein, 10 aa, Homo Sapiens
FALTIHTQVF

SEQ ID NO: 138872 - protein, 10 aa, Homo Sapiens
FALTNGIYPH

SEQ ID NO: 138873 - protein, 10 aa, Homo Sapiens
FAMMHGGTGF

SEQ ID NO: 138874 - protein, 10 aa, Homo Sapiens
FAMTGERVDL

SEQ ID NO: 138875 - protein, 10 aa, Homo Sapiens
FAVDLEHHSY

SEQ ID NO: 138876 - protein, 10 aa, Homo Sapiens
FAVDPQITSL

SEQ ID NO: 138877 - protein, 10 aa, Homo Sapiens
FAVDPRFLAY

SEQ ID NO: 138878 - protein, 10 aa, Homo Sapiens
FAVNPLLRVI

SEQ ID NO: 138879 - protein, 10 aa, Homo Sapiens
FAYDPSNYEY

SEQ ID NO: 138880 - protein, 10 aa, Homo Sapiens
FAYGGHPYPF

SEQ ID NO: 138881 - protein, 10 aa, Homo Sapiens
FAYGQNKTAF

SEQ ID NO: 138882 - protein, 10 aa, Homo Sapiens
FAYGTYRSNF

SEQ ID NO: 138883 - protein, 10 aa, Homo Sapiens
FFIPSGLAVF

SEQ ID NO: 138884 - protein, 10 aa, Homo Sapiens
FIMEGGAMVL

SEQ ID NO: 138885 - protein, 10 aa, Homo Sapiens
FLLPTGLSSL

SEQ ID NO: 138886 - protein, 10 aa, Homo Sapiens
FLPARFYQAL

SEQ ID NO: 138887 - protein, 10 aa, Homo Sapiens
FLPEEAWCDL

SEQ ID NO: 138888 - protein, 10 aa, Homo Sapiens
FLPEVPLGQL

SEQ ID NO: 138889 - protein, 10 aa, Homo Sapiens
FLPTRALAAL

SEQ ID NO: 138890 - protein, 10 aa, Homo Sapiens
FLVNHDFSPL

SEQ ID NO: 138891 - protein, 10 aa, Homo Sapiens
FLYPFPLALF

SEQ ID NO: 138892 - protein, 10 aa, Homo Sapiens
FQLPGGHLEF

SEQ ID NO: 138893 - protein, 10 aa, Homo Sapiens
FSFGGKLVTF

SEQ ID NO: 138894 - protein, 10 aa, Homo Sapiens
FSKDWDVTEY

SEQ ID NO: 138895 - protein, 10 aa, Homo Sapiens
FSYPFTFEAF

SEQ ID NO: 138896 - protein, 10 aa, Homo Sapiens
FTMGGPAISM

SEQ ID NO: 138897 - protein, 10 aa, Homo Sapiens
FTPFVDPRVY

SEQ ID NO: 138898 - protein, 10 aa, Homo Sapiens
FVAPVDLQAY

SEQ ID NO: 138899 - protein, 10 aa, Homo Sapiens
FVNDTLRSEF

SEQ ID NO: 138900 - protein, 10 aa, Homo Sapiens
FVSAGIQTSF

SEQ ID NO: 138901 - protein, 10 aa, Homo Sapiens
GAIGGTPPAF

SEQ ID NO: 138902 - protein, 10 aa, Homo Sapiens
GAYVHMVTHF

SEQ ID NO: 138903 - protein, 10 aa, Homo Sapiens
GGYDGYRPSF

SEQ ID NO: 138904 - protein, 10 aa, Homo Sapiens
HIPDHLRPEY

SEQ ID NO: 138905 - protein, 10 aa, Homo Sapiens
IAYIHLVADY

SEQ ID NO: 138906 - protein, 10 aa, Homo Sapiens
ISIEGNKMPL

SEQ ID NO: 138907 - protein, 10 aa, Homo Sapiens
KLPNFGFVVF

SEQ ID NO: 138908 - protein, 10 aa, Homo Sapiens
LAADLSLHSF

SEQ ID NO: 138909 - protein, 10 aa, Homo Sapiens
LAINGSNLPR

SEQ ID NO: 138910 - protein, 10 aa, Homo Sapiens
LASPVPTTPF

SEQ ID NO: 138911 - protein, 10 aa, Homo Sapiens
LAVHPSGVAL

SEQ ID NO: 138912 - protein, 10 aa, Homo Sapiens
LQPPKPLSSL

SEQ ID NO: 138913 - protein, 10 aa, Homo Sapiens
LTMPDTPRLF

SEQ ID NO: 138914 - protein, 10 aa, Homo Sapiens
LVKNWVPTAY

SEQ ID NO: 138915 - protein, 10 aa, Homo Sapiens
MAYGASFLSF

SEQ ID NO: 138916 - protein, 10 aa, Homo Sapiens
PEVKFNWYVD

SEQ ID NO: 138917 - protein, 10 aa, Homo Sapiens
RIPEFNMAAF

SEQ ID NO: 138918 - protein, 10 aa, Homo Sapiens
RLPDTALPTL

SEQ ID NO: 138919 - protein, 10 aa, Homo Sapiens
SLPALPLAEL

SEQ ID NO: 138920 - protein, 10 aa, Homo Sapiens
TPIVGQPSIP

SEQ ID NO: 138921 - protein, 10 aa, Homo Sapiens
TQKSLSLSPG

SEQ ID NO: 138922 - protein, 10 aa, Homo Sapiens
VAFLAMLLVL

SEQ ID NO: 138923 - protein, 10 aa, Homo Sapiens
VALPFQLTPF

SEQ ID NO: 138924 - protein, 10 aa, Homo Sapiens
VAMNPTNTVF

SEQ ID NO: 138925 - protein, 10 aa, Homo Sapiens
VARNPPGFAF

SEQ ID NO: 138926 - protein, 10 aa, Homo Sapiens
VAYHQLFQEY

SEQ ID NO: 138927 - protein, 10 aa, Homo Sapiens
VLPHQPLATY

SEQ ID NO: 138928 - protein, 10 aa, Homo Sapiens
VVYPWTQRFF

SEQ ID NO: 138929 - protein, 10 aa, Homo Sapiens
YAAELAGLSY

SEQ ID NO: 138930 - protein, 10 aa, Homo Sapiens
YAAPHPLQSY

SEQ ID NO: 138931 - protein, 10 aa, Homo Sapiens
YAAPPHVIHH

SEQ ID NO: 138932 - protein, 10 aa, Homo Sapiens
YADPNFVRTF

SEQ ID NO: 138933 - protein, 10 aa, Homo Sapiens
YADPTKRLEL

SEQ ID NO: 138934 - protein, 10 aa, Homo Sapiens
YAFPKAVSVF

SEQ ID NO: 138935 - protein, 10 aa, Homo Sapiens
YALCGFGGVL

SEQ ID NO: 138936 - protein, 10 aa, Homo Sapiens
YALDVRVNSL

SEQ ID NO: 138937 - protein, 10 aa, Homo Sapiens
YALNENVSSF

SEQ ID NO: 138938 - protein, 10 aa, Homo Sapiens
YAPPRDFAAY

SEQ ID NO: 138939 - protein, 10 aa, Homo Sapiens
YAVEGRDLTL

SEQ ID NO: 138940 - protein, 10 aa, Homo Sapiens
YINPAKLTPY

SEQ ID NO: 138941 - protein, 10 aa, Homo Sapiens
YLPIGGLAEF

SEQ ID NO: 138942 - protein, 10 aa, Homo Sapiens
YLPNQLFRTF

SEQ ID NO: 138943 - protein, 10 aa, Homo Sapiens
YLRPGQAAAF

SEQ ID NO: 138944 - protein, 10 aa, Homo Sapiens
YMIDPSGVSY

SEQ ID NO: 138945 - protein, 10 aa, Homo Sapiens
YMNPYQLNAY

SEQ ID NO: 138946 - protein, 10 aa, Homo Sapiens
YTNGSFGSNF

SEQ ID NO: 138947 - protein, 10 aa, Homo Sapiens
YVIEPHSMEF

SEQ ID NO: 138948 - protein, 10 aa, Homo Sapiens
YVIPHPVHAF

SEQ ID NO: 138949 - protein, 10 aa, Homo Sapiens
YVNGKTFLEK

SEQ ID NO: 138950 - protein, 11 aa, Homo Sapiens
AAYYPSDVSSL

SEQ ID NO: 138951 - protein, 11 aa, Homo Sapiens
AVAEALTNLVF

SEQ ID NO: 138952 - protein, 11 aa, Homo Sapiens
AVRDISEASVF

SEQ ID NO: 138953 - protein, 11 aa, Homo Sapiens
FAAAVLDGMIY

SEQ ID NO: 138954 - protein, 11 aa, Homo Sapiens
FAFEGIGDEDL

SEQ ID NO: 138955 - protein, 11 aa, Homo Sapiens
FAHFPGLASEL

SEQ ID NO: 138956 - protein, 11 aa, Homo Sapiens
FAKPVYPGQTL

SEQ ID NO: 138957 - protein, 11 aa, Homo Sapiens
FAKSVSFSDVF

SEQ ID NO: 138958 - protein, 11 aa, Homo Sapiens
FASKEIAENAL

SEQ ID NO: 138959 - protein, 11 aa, Homo Sapiens
FASQEIAEKAL

SEQ ID NO: 138960 - protein, 11 aa, Homo Sapiens
FAYDGKDYLTL

SEQ ID NO: 138961 - protein, 11 aa, Homo Sapiens
FAYDPSNYEYL

SEQ ID NO: 138962 - protein, 11 aa, Homo Sapiens
FLNPAAHLEPF

SEQ ID NO: 138963 - protein, 11 aa, Homo Sapiens
GIHETTFNSIM

SEQ ID NO: 138964 - protein, 11 aa, Homo Sapiens
HACGVIATIAF

SEQ ID NO: 138965 - protein, 11 aa, Homo Sapiens
LALDPSLVPTF

SEQ ID NO: 138966 - protein, 11 aa, Homo Sapiens
LAVDPNRAVPL

SEQ ID NO: 138967 - protein, 11 aa, Homo Sapiens
MAPSETQFSHL

SEQ ID NO: 138968 - protein, 11 aa, Homo Sapiens
PISLDLTFHLL

SEQ ID NO: 138969 - protein, 11 aa, Homo Sapiens
QQPNGAGFAAF

SEQ ID NO: 138970 - protein, 11 aa, Homo Sapiens
SAINEVVTREY

SEQ ID NO: 138971 - protein, 11 aa, Homo Sapiens
SAYDGKDYIAL

SEQ ID NO: 138972 - protein, 11 aa, Homo Sapiens
SLPVAPRYHLL

SEQ ID NO: 138973 - protein, 11 aa, Homo Sapiens
TTIDPRWLVEF

SEQ ID NO: 138974 - protein, 11 aa, Homo Sapiens
VAAAGVSSNPF

SEQ ID NO: 138975 - protein, 11 aa, Homo Sapiens
VAYWRQAGLSY

SEQ ID NO: 138976 - protein, 11 aa, Homo Sapiens
YAISPGLDITF

SEQ ID NO: 138977 - protein, 11 aa, Homo Sapiens
YAVDPAQLQAL

SEQ ID NO: 138978 - protein, 11 aa, Homo Sapiens
YAWESSAGGSF

SEQ ID NO: 138979 - protein, 11 aa, Homo Sapiens
YAYDGKDYIAL

SEQ ID NO: 138980 - protein, 11 aa, Homo Sapiens
YAYPATAAAPM

SEQ ID NO: 138981 - protein, 11 aa, Homo Sapiens
YGAEALERMFL

SEQ ID NO: 138982 - protein, 11 aa, Homo Sapiens
YSLDGRLLSTY

SEQ ID NO: 138983 - protein, 11 aa, Homo Sapiens
YSLPTSFSGSF

SEQ ID NO: 138984 - protein, 11 aa, Homo Sapiens
YSYPAAVPQAL

SEQ ID NO: 138985 - protein, 8 aa, Homo Sapiens
AAAPPLTL

SEQ ID NO: 138986 - protein, 8 aa, Homo Sapiens
AAAPSPVL

SEQ ID NO: 138987 - protein, 8 aa, Homo Sapiens
AAFPGASL

SEQ ID NO: 138988 - protein, 8 aa, Homo Sapiens
AAGPGFSL

SEQ ID NO: 138989 - protein, 8 aa, Homo Sapiens
AAGPPLVA

SEQ ID NO: 138990 - protein, 8 aa, Homo Sapiens
AAIKALEL

SEQ ID NO: 138991 - protein, 8 aa, Homo Sapiens
AALQFLTL

SEQ ID NO: 138992 - protein, 8 aa, Homo Sapiens
AASHPLLL

SEQ ID NO: 138993 - protein, 8 aa, Homo Sapiens
AFAEALLL

SEQ ID NO: 138994 - protein, 8 aa, Homo Sapiens
AIAQAESL

SEQ ID NO: 138995 - protein, 8 aa, Homo Sapiens
AVFLLDDK

SEQ ID NO: 138996 - protein, 8 aa, Homo Sapiens
AVGPASIL

SEQ ID NO: 138997 - protein, 8 aa, Homo Sapiens
DFFNGKEL

SEQ ID NO: 138998 - protein, 8 aa, Homo Sapiens
DGIVSHLK

SEQ ID NO: 138999 - protein, 8 aa, Homo Sapiens
EKSPSIDL

SEQ ID NO: 139000 - protein, 8 aa, Homo Sapiens
ELEDSTLR

SEQ ID NO: 139001 - protein, 8 aa, Homo Sapiens
ESLIACKA

SEQ ID NO: 139002 - protein, 8 aa, Homo Sapiens
FAAEAIAM

SEQ ID NO: 139003 - protein, 8 aa, Homo Sapiens
FAAETLVL

SEQ ID NO: 139004 - protein, 8 aa, Homo Sapiens
FAALCFVL

SEQ ID NO: 139005 - protein, 8 aa, Homo Sapiens
FAARPVLL

SEQ ID NO: 139006 - protein, 8 aa, Homo Sapiens
FAFSRQAL

SEQ ID NO: 139007 - protein, 8 aa, Homo Sapiens
FAFSSQEL

SEQ ID NO: 139008 - protein, 8 aa, Homo Sapiens
FAGALLEL

SEQ ID NO: 139009 - protein, 8 aa, Homo Sapiens
FAGDDAPR

SEQ ID NO: 139010 - protein, 8 aa, Homo Sapiens
FAGKVLRL

SEQ ID NO: 139011 - protein, 8 aa, Homo Sapiens
FAGMPITL

SEQ ID NO: 139012 - protein, 8 aa, Homo Sapiens
FAGPCKVI

SEQ ID NO: 139013 - protein, 8 aa, Homo Sapiens
FAGWGRAL

SEQ ID NO: 139014 - protein, 8 aa, Homo Sapiens
FAHSFIEL

SEQ ID NO: 139015 - protein, 8 aa, Homo Sapiens
FAHVAIAV

SEQ ID NO: 139016 - protein, 8 aa, Homo Sapiens
FAHWGQEL

SEQ ID NO: 139017 - protein, 8 aa, Homo Sapiens
FAIDPHLL

SEQ ID NO: 139018 - protein, 8 aa, Homo Sapiens
FAIRGVVL

SEQ ID NO: 139019 - protein, 8 aa, Homo Sapiens
FAIRPMYL

SEQ ID NO: 139020 - protein, 8 aa, Homo Sapiens
FAISTGSL

SEQ ID NO: 139021 - protein, 8 aa, Homo Sapiens
FALLFSEL

SEQ ID NO: 139022 - protein, 8 aa, Homo Sapiens
FANKQLEL

SEQ ID NO: 139023 - protein, 8 aa, Homo Sapiens
FAQSSIAL

SEQ ID NO: 139024 - protein, 8 aa, Homo Sapiens
FAVAGQEL

SEQ ID NO: 139025 - protein, 8 aa, Homo Sapiens
FAVEGPKL

SEQ ID NO: 139026 - protein, 8 aa, Homo Sapiens
FAWGHDEL

SEQ ID NO: 139027 - protein, 8 aa, Homo Sapiens
FFLIGPPL

SEQ ID NO: 139028 - protein, 8 aa, Homo Sapiens
FFQVGSDL

SEQ ID NO: 139029 - protein, 8 aa, Homo Sapiens
FGFRGEAL

SEQ ID NO: 139030 - protein, 8 aa, Homo Sapiens
FGHIGIAV

SEQ ID NO: 139031 - protein, 8 aa, Homo Sapiens
FIGPALLF

SEQ ID NO: 139032 - protein, 8 aa, Homo Sapiens
FIGYPITL

SEQ ID NO: 139033 - protein, 8 aa, Homo Sapiens
FITDPVVL

SEQ ID NO: 139034 - protein, 8 aa, Homo Sapiens
FLAPSLVL

SEQ ID NO: 139035 - protein, 8 aa, Homo Sapiens
FLQQPRPL

SEQ ID NO: 139036 - protein, 8 aa, Homo Sapiens
FLTDKKNR

SEQ ID NO: 139037 - protein, 8 aa, Homo Sapiens
FNFVGKIL

SEQ ID NO: 139038 - protein, 8 aa, Homo Sapiens
FNFVGRIL

SEQ ID NO: 139039 - protein, 8 aa, Homo Sapiens
FQHVGKAF

SEQ ID NO: 139040 - protein, 8 aa, Homo Sapiens
FSAIGLEL

SEQ ID NO: 139041 - protein, 8 aa, Homo Sapiens
FSANPKEL

SEQ ID NO: 139042 - protein, 8 aa, Homo Sapiens
FSFDGPEI

SEQ ID NO: 139043 - protein, 8 aa, Homo Sapiens
FSFEGPEI

SEQ ID NO: 139044 - protein, 8 aa, Homo Sapiens
FSFVMPSL

SEQ ID NO: 139045 - protein, 8 aa, Homo Sapiens
FSGPAITL

SEQ ID NO: 139046 - protein, 8 aa, Homo Sapiens
FSGRILGL

SEQ ID NO: 139047 - protein, 8 aa, Homo Sapiens
FSHQGVQL

SEQ ID NO: 139048 - protein, 8 aa, Homo Sapiens
FSHVAMIL

SEQ ID NO: 139049 - protein, 8 aa, Homo Sapiens
FSIIPREL

SEQ ID NO: 139050 - protein, 8 aa, Homo Sapiens
FSPVGSVL

SEQ ID NO: 139051 - protein, 8 aa, Homo Sapiens
FSRVSLRL

SEQ ID NO: 139052 - protein, 8 aa, Homo Sapiens
FSSNPISL

SEQ ID NO: 139053 - protein, 8 aa, Homo Sapiens
FSVTGRVL

SEQ ID NO: 139054 - protein, 8 aa, Homo Sapiens
FSVTGTSL

SEQ ID NO: 139055 - protein, 8 aa, Homo Sapiens
FSYAGFEM

SEQ ID NO: 139056 - protein, 8 aa, Homo Sapiens
FTADPLSL

SEQ ID NO: 139057 - protein, 8 aa, Homo Sapiens
FTHASPTL

SEQ ID NO: 139058 - protein, 8 aa, Homo Sapiens
FTHLGLDL

SEQ ID NO: 139059 - protein, 8 aa, Homo Sapiens
FTMGGPAI

SEQ ID NO: 139060 - protein, 8 aa, Homo Sapiens
FVGPSRYL

SEQ ID NO: 139061 - protein, 8 aa, Homo Sapiens
GAGPSLLL

SEQ ID NO: 139062 - protein, 8 aa, Homo Sapiens
GITFIAAK

SEQ ID NO: 139063 - protein, 8 aa, Homo Sapiens
HAAEALLL

SEQ ID NO: 139064 - protein, 8 aa, Homo Sapiens
HSHVGYTL

SEQ ID NO: 139065 - protein, 8 aa, Homo Sapiens
HTGPITCL

SEQ ID NO: 139066 - protein, 8 aa, Homo Sapiens
HVDPENFR

SEQ ID NO: 139067 - protein, 8 aa, Homo Sapiens
IADLAHLL

SEQ ID NO: 139068 - protein, 8 aa, Homo Sapiens
IAGPVVEI

SEQ ID NO: 139069 - protein, 8 aa, Homo Sapiens
ICGQGLKS

SEQ ID NO: 139070 - protein, 8 aa, Homo Sapiens
IGGPAILL

SEQ ID NO: 139071 - protein, 8 aa, Homo Sapiens
IIGPGIVL

SEQ ID NO: 139072 - protein, 8 aa, Homo Sapiens
ILGPTFTL

SEQ ID NO: 139073 - protein, 8 aa, Homo Sapiens
ISFSGMSL

SEQ ID NO: 139074 - protein, 8 aa, Homo Sapiens
ISILGKSL

SEQ ID NO: 139075 - protein, 8 aa, Homo Sapiens
ISIVGICL

SEQ ID NO: 139076 - protein, 8 aa, Homo Sapiens
ISLEGKPL

SEQ ID NO: 139077 - protein, 8 aa, Homo Sapiens
ITFVNKHL

SEQ ID NO: 139078 - protein, 8 aa, Homo Sapiens
ITRVGLAL

SEQ ID NO: 139079 - protein, 8 aa, Homo Sapiens
LAAIATEL

SEQ ID NO: 139080 - protein, 8 aa, Homo Sapiens
LAALPLAL

SEQ ID NO: 139081 - protein, 8 aa, Homo Sapiens
LADQPHLL

SEQ ID NO: 139082 - protein, 8 aa, Homo Sapiens
LAEVGRVL

SEQ ID NO: 139083 - protein, 8 aa, Homo Sapiens
LAFVSPSL

SEQ ID NO: 139084 - protein, 8 aa, Homo Sapiens
LAGKVLAL

SEQ ID NO: 139085 - protein, 8 aa, Homo Sapiens
LAGPALEL

SEQ ID NO: 139086 - protein, 8 aa, Homo Sapiens
LAGPPLEI

SEQ ID NO: 139087 - protein, 8 aa, Homo Sapiens
LAGPVLGL

SEQ ID NO: 139088 - protein, 8 aa, Homo Sapiens
LAHVGPRL

SEQ ID NO: 139089 - protein, 8 aa, Homo Sapiens
LALEIRSL

SEQ ID NO: 139090 - protein, 8 aa, Homo Sapiens
LALVSRAL

SEQ ID NO: 139091 - protein, 8 aa, Homo Sapiens
LASFLWIL

SEQ ID NO: 139092 - protein, 8 aa, Homo Sapiens
LAVSGVVI

SEQ ID NO: 139093 - protein, 8 aa, Homo Sapiens
LAVVGSVL

SEQ ID NO: 139094 - protein, 8 aa, Homo Sapiens
LEYVPSAK

SEQ ID NO: 139095 - protein, 8 aa, Homo Sapiens
LHTLFGDK

SEQ ID NO: 139096 - protein, 8 aa, Homo Sapiens
LIGPPLLI

SEQ ID NO: 139097 - protein, 8 aa, Homo Sapiens
LLGPTVML

SEQ ID NO: 139098 - protein, 8 aa, Homo Sapiens
LLPGELAK

SEQ ID NO: 139099 - protein, 8 aa, Homo Sapiens
LPSHPLEL

SEQ ID NO: 139100 - protein, 8 aa, Homo Sapiens
LRLPHQPL

SEQ ID NO: 139101 - protein, 8 aa, Homo Sapiens
LSVNPAAL

SEQ ID NO: 139102 - protein, 8 aa, Homo Sapiens
LSWPGLAV

SEQ ID NO: 139103 - protein, 8 aa, Homo Sapiens
LTFVDPVL

SEQ ID NO: 139104 - protein, 8 aa, Homo Sapiens
LTGPVLEL

SEQ ID NO: 139105 - protein, 8 aa, Homo Sapiens
LTGRVLAL

SEQ ID NO: 139106 - protein, 8 aa, Homo Sapiens
LTQVGSIL

SEQ ID NO: 139107 - protein, 8 aa, Homo Sapiens
LVGPGVEL

SEQ ID NO: 139108 - protein, 8 aa, Homo Sapiens
LVVVGGVL

SEQ ID NO: 139109 - protein, 8 aa, Homo Sapiens
MALLGHSL

SEQ ID NO: 139110 - protein, 8 aa, Homo Sapiens
MALLGQAL

SEQ ID NO: 139111 - protein, 8 aa, Homo Sapiens
MGGPAISM

SEQ ID NO: 139112 - protein, 8 aa, Homo Sapiens
MGHLGVVL

SEQ ID NO: 139113 - protein, 8 aa, Homo Sapiens
MSGPVTVL

SEQ ID NO: 139114 - protein, 8 aa, Homo Sapiens
MVGPILEM

SEQ ID NO: 139115 - protein, 8 aa, Homo Sapiens
NAGPAIVI

SEQ ID NO: 139116 - protein, 8 aa, Homo Sapiens
NAYTGIVL

SEQ ID NO: 139117 - protein, 8 aa, Homo Sapiens
QAAPPIEL

SEQ ID NO: 139118 - protein, 8 aa, Homo Sapiens
QILVGVNK

SEQ ID NO: 139119 - protein, 8 aa, Homo Sapiens
QTPPISSL

SEQ ID NO: 139120 - protein, 8 aa, Homo Sapiens
QYEDIANR

SEQ ID NO: 139121 - protein, 8 aa, Homo Sapiens
RAHIGPVL

SEQ ID NO: 139122 - protein, 8 aa, Homo Sapiens
RALLGPAL

SEQ ID NO: 139123 - protein, 8 aa, Homo Sapiens
RVDPVNFK

SEQ ID NO: 139124 - protein, 8 aa, Homo Sapiens
SAAPAIQL

SEQ ID NO: 139125 - protein, 8 aa, Homo Sapiens
SANIGPFL

SEQ ID NO: 139126 - protein, 8 aa, Homo Sapiens
SFTTTAER

SEQ ID NO: 139127 - protein, 8 aa, Homo Sapiens
SQSPEAIK

SEQ ID NO: 139128 - protein, 8 aa, Homo Sapiens
TAFIGPAL

SEQ ID NO: 139129 - protein, 8 aa, Homo Sapiens
TAGRVLEL

SEQ ID NO: 139130 - protein, 8 aa, Homo Sapiens
TAIVGMAL

SEQ ID NO: 139131 - protein, 8 aa, Homo Sapiens
TSDIPHML

SEQ ID NO: 139132 - protein, 8 aa, Homo Sapiens
TSYVGLVL

SEQ ID NO: 139133 - protein, 8 aa, Homo Sapiens
TYKEALEK

SEQ ID NO: 139134 - protein, 8 aa, Homo Sapiens
VADLAHVL

SEQ ID NO: 139135 - protein, 8 aa, Homo Sapiens
VAGPSVTL

SEQ ID NO: 139136 - protein, 8 aa, Homo Sapiens
VAKESIPL

SEQ ID NO: 139137 - protein, 8 aa, Homo Sapiens
VATTALEL

SEQ ID NO: 139138 - protein, 8 aa, Homo Sapiens
VAYEAPSL

SEQ ID NO: 139139 - protein, 8 aa, Homo Sapiens
VGAVGLVW

SEQ ID NO: 139140 - protein, 8 aa, Homo Sapiens
VGPETLGR

SEQ ID NO: 139141 - protein, 8 aa, Homo Sapiens
VIGPPVVL

SEQ ID NO: 139142 - protein, 8 aa, Homo Sapiens
VIIKPSEL

SEQ ID NO: 139143 - protein, 8 aa, Homo Sapiens
VSGPAMTL

SEQ ID NO: 139144 - protein, 8 aa, Homo Sapiens
VSQVGKEL

SEQ ID NO: 139145 - protein, 8 aa, Homo Sapiens
VVGPNITL

SEQ ID NO: 139146 - protein, 8 aa, Homo Sapiens
VVGPSSVL

SEQ ID NO: 139147 - protein, 8 aa, Homo Sapiens
YAARARLL

SEQ ID NO: 139148 - protein, 8 aa, Homo Sapiens
YAEGVRVL

SEQ ID NO: 139149 - protein, 8 aa, Homo Sapiens
YAFSARPL

SEQ ID NO: 139150 - protein, 8 aa, Homo Sapiens
YAGAILEV

SEQ ID NO: 139151 - protein, 8 aa, Homo Sapiens
YAGPGLSL

SEQ ID NO: 139152 - protein, 8 aa, Homo Sapiens
YAIEAIKL

SEQ ID NO: 139153 - protein, 8 aa, Homo Sapiens
YALPHAIL

SEQ ID NO: 139154 - protein, 8 aa, Homo Sapiens
YFKGAIPL

SEQ ID NO: 139155 - protein, 8 aa, Homo Sapiens
YGFDGRGL

SEQ ID NO: 139156 - protein, 8 aa, Homo Sapiens
YGFVNHAL

SEQ ID NO: 139157 - protein, 8 aa, Homo Sapiens
YIHVGAQL

SEQ ID NO: 139158 - protein, 8 aa, Homo Sapiens
YLGKVLEL

SEQ ID NO: 139159 - protein, 8 aa, Homo Sapiens
YSFDGPSL

SEQ ID NO: 139160 - protein, 8 aa, Homo Sapiens
YSHVGIAW

SEQ ID NO: 139161 - protein, 8 aa, Homo Sapiens
YSIVGQKL

SEQ ID NO: 139162 - protein, 8 aa, Homo Sapiens
YSLDMWRL

SEQ ID NO: 139163 - protein, 8 aa, Homo Sapiens
YSWLGETL

SEQ ID NO: 139164 - protein, 8 aa, Homo Sapiens
YTAEPVTL

SEQ ID NO: 139165 - protein, 8 aa, Homo Sapiens
YTNLGPRL

SEQ ID NO: 139166 - protein, 8 aa, Homo Sapiens
YTYTSKAL

SEQ ID NO: 139167 - protein, 8 aa, Homo Sapiens
YVGPAKVI

SEQ ID NO: 139168 - protein, 8 aa, Homo Sapiens
YVGPSLRM

SEQ ID NO: 139169 - protein, 8 aa, Homo Sapiens
YVSFPLEL

SEQ ID NO: 139170 - protein, 8 aa, Homo Sapiens
YWQNHPEL

SEQ ID NO: 139171 - protein, 8 aa, Homo Sapiens
YYAVAVVK

SEQ ID NO: 139172 - protein, 9 aa, Homo Sapiens
AAAAATMAL

SEQ ID NO: 139173 - protein, 9 aa, Homo Sapiens
AAAAPRAVA

SEQ ID NO: 139174 - protein, 9 aa, Homo Sapiens
AAAAPSPVL

SEQ ID NO: 139175 - protein, 9 aa, Homo Sapiens
AAAAVGGAL

SEQ ID NO: 139176 - protein, 9 aa, Homo Sapiens
AAAAVGLAL

SEQ ID NO: 139177 - protein, 9 aa, Homo Sapiens
AAADVLEAL

SEQ ID NO: 139178 - protein, 9 aa, Homo Sapiens
AAAGSPLSL

SEQ ID NO: 139179 - protein, 9 aa, Homo Sapiens
AAAGVFALL

SEQ ID NO: 139180 - protein, 9 aa, Homo Sapiens
AAAHFYFEL

SEQ ID NO: 139181 - protein, 9 aa, Homo Sapiens
AAAIKALEL

SEQ ID NO: 139182 - protein, 9 aa, Homo Sapiens
AAANPTLAF

SEQ ID NO: 139183 - protein, 9 aa, Homo Sapiens
AAAPAAPTL

SEQ ID NO: 139184 - protein, 9 aa, Homo Sapiens
AAAPAGTTF

SEQ ID NO: 139185 - protein, 9 aa, Homo Sapiens
AAAPHLLLL

SEQ ID NO: 139186 - protein, 9 aa, Homo Sapiens
AAAPPSPAW

SEQ ID NO: 139187 - protein, 9 aa, Homo Sapiens
AAAPSLLIL

SEQ ID NO: 139188 - protein, 9 aa, Homo Sapiens
AAASAFTSL

SEQ ID NO: 139189 - protein, 9 aa, Homo Sapiens
AAASHFFNL

SEQ ID NO: 139190 - protein, 9 aa, Homo Sapiens
AAAYPHTSL

SEQ ID NO: 139191 - protein, 9 aa, Homo Sapiens
AACDYIREL

SEQ ID NO: 139192 - protein, 9 aa, Homo Sapiens
AACETFLKL

SEQ ID NO: 139193 - protein, 9 aa, Homo Sapiens
AACPYFKSM

SEQ ID NO: 139194 - protein, 9 aa, Homo Sapiens
AADPQIRQF

SEQ ID NO: 139195 - protein, 9 aa, Homo Sapiens
AADPVSPLL

SEQ ID NO: 139196 - protein, 9 aa, Homo Sapiens
AADWHNLIL

SEQ ID NO: 139197 - protein, 9 aa, Homo Sapiens
AAEDAIRNL

SEQ ID NO: 139198 - protein, 9 aa, Homo Sapiens
AAEEGLREL

SEQ ID NO: 139199 - protein, 9 aa, Homo Sapiens
AAFAHFPEL

SEQ ID NO: 139200 - protein, 9 aa, Homo Sapiens
AAFQAALAL

SEQ ID NO: 139201 - protein, 9 aa, Homo Sapiens
AAFWGQMQM

SEQ ID NO: 139202 - protein, 9 aa, Homo Sapiens
AAHMPAAAL

SEQ ID NO: 139203 - protein, 9 aa, Homo Sapiens
AAIAAVNAL

SEQ ID NO: 139204 - protein, 9 aa, Homo Sapiens
AAIAPPTSL

SEQ ID NO: 139205 - protein, 9 aa, Homo Sapiens
AAIASLLYL

SEQ ID NO: 139206 - protein, 9 aa, Homo Sapiens
AAIASTPTL

SEQ ID NO: 139207 - protein, 9 aa, Homo Sapiens
AAIEGNLQL

SEQ ID NO: 139208 - protein, 9 aa, Homo Sapiens
AAIFHYLII

SEQ ID NO: 139209 - protein, 9 aa, Homo Sapiens
AAIHPSLEI

SEQ ID NO: 139210 - protein, 9 aa, Homo Sapiens
AAIKAFIAV

SEQ ID NO: 139211 - protein, 9 aa, Homo Sapiens
AAIKPGTPL

SEQ ID NO: 139212 - protein, 9 aa, Homo Sapiens
AAILPDMAL

SEQ ID NO: 139213 - protein, 9 aa, Homo Sapiens
AAINPNHPL

SEQ ID NO: 139214 - protein, 9 aa, Homo Sapiens
AAIPSAPVL

SEQ ID NO: 139215 - protein, 9 aa, Homo Sapiens
AAIPYWLLL

SEQ ID NO: 139216 - protein, 9 aa, Homo Sapiens
AAIQCLQAL

SEQ ID NO: 139217 - protein, 9 aa, Homo Sapiens
AAISHGRVF

SEQ ID NO: 139218 - protein, 9 aa, Homo Sapiens
AAISTSRVL

SEQ ID NO: 139219 - protein, 9 aa, Homo Sapiens
AAIVAKQVL

SEQ ID NO: 139220 - protein, 9 aa, Homo Sapiens
AAIVPGSQL

SEQ ID NO: 139221 - protein, 9 aa, Homo Sapiens
AAIWQYESL

SEQ ID NO: 139222 - protein, 9 aa, Homo Sapiens
AAIYHVLHF

SEQ ID NO: 139223 - protein, 9 aa, Homo Sapiens
AAIYLVTSL

SEQ ID NO: 139224 - protein, 9 aa, Homo Sapiens
AALDIYETL

SEQ ID NO: 139225 - protein, 9 aa, Homo Sapiens
AALDKATVL

SEQ ID NO: 139226 - protein, 9 aa, Homo Sapiens
AALFKAWAL

SEQ ID NO: 139227 - protein, 9 aa, Homo Sapiens
AALPCGHSL

SEQ ID NO: 139228 - protein, 9 aa, Homo Sapiens
AALPKATIL

SEQ ID NO: 139229 - protein, 9 aa, Homo Sapiens
AALPLALVL

SEQ ID NO: 139230 - protein, 9 aa, Homo Sapiens
AALPPVSPL

SEQ ID NO: 139231 - protein, 9 aa, Homo Sapiens
AALPVYQEL

SEQ ID NO: 139232 - protein, 9 aa, Homo Sapiens
AALVPRQAL

SEQ ID NO: 139233 - protein, 9 aa, Homo Sapiens
AALWRFAEL

SEQ ID NO: 139234 - protein, 9 aa, Homo Sapiens
AAMASLGAL

SEQ ID NO: 139235 - protein, 9 aa, Homo Sapiens
AAMEFLQEL

SEQ ID NO: 139236 - protein, 9 aa, Homo Sapiens
AAMKALQAL

SEQ ID NO: 139237 - protein, 9 aa, Homo Sapiens
AAMPRIYEL

SEQ ID NO: 139238 - protein, 9 aa, Homo Sapiens
AAMPVAQHL

SEQ ID NO: 139239 - protein, 9 aa, Homo Sapiens
AAMSHLLEM

SEQ ID NO: 139240 - protein, 9 aa, Homo Sapiens
AAMYKSLEL

SEQ ID NO: 139241 - protein, 9 aa, Homo Sapiens
AANKTIIYL

SEQ ID NO: 139242 - protein, 9 aa, Homo Sapiens
AANKVVLQL

SEQ ID NO: 139243 - protein, 9 aa, Homo Sapiens
AANPHSFVF

SEQ ID NO: 139244 - protein, 9 aa, Homo Sapiens
AANPIQFTL

SEQ ID NO: 139245 - protein, 9 aa, Homo Sapiens
AAQIPTAAL

SEQ ID NO: 139246 - protein, 9 aa, Homo Sapiens
AASGHFICV

SEQ ID NO: 139247 - protein, 9 aa, Homo Sapiens
AASPAGLDL

SEQ ID NO: 139248 - protein, 9 aa, Homo Sapiens
AASPQAPTL

SEQ ID NO: 139249 - protein, 9 aa, Homo Sapiens
AATAATLAL

SEQ ID NO: 139250 - protein, 9 aa, Homo Sapiens
AATDIFSYL

SEQ ID NO: 139251 - protein, 9 aa, Homo Sapiens
AATLLHLEL

SEQ ID NO: 139252 - protein, 9 aa, Homo Sapiens
AATTVLQEL

SEQ ID NO: 139253 - protein, 9 aa, Homo Sapiens
AAVALAHAL

SEQ ID NO: 139254 - protein, 9 aa, Homo Sapiens
AAVAPGHPL

SEQ ID NO: 139255 - protein, 9 aa, Homo Sapiens
AAVDAGMAM

SEQ ID NO: 139256 - protein, 9 aa, Homo Sapiens
AAVDAILSL

SEQ ID NO: 139257 - protein, 9 aa, Homo Sapiens
AAVDTNLTL

SEQ ID NO: 139258 - protein, 9 aa, Homo Sapiens
AAVGEPAFL

SEQ ID NO: 139259 - protein, 9 aa, Homo Sapiens
AAVGFLSSL

SEQ ID NO: 139260 - protein, 9 aa, Homo Sapiens
AAVHIILVI

SEQ ID NO: 139261 - protein, 9 aa, Homo Sapiens
AAVNHISQL

SEQ ID NO: 139262 - protein, 9 aa, Homo Sapiens
AAVNVICEL

SEQ ID NO: 139263 - protein, 9 aa, Homo Sapiens
AAVPDSVAL

SEQ ID NO: 139264 - protein, 9 aa, Homo Sapiens
AAVPKSLQL

SEQ ID NO: 139265 - protein, 9 aa, Homo Sapiens
AAVPKTFQL

SEQ ID NO: 139266 - protein, 9 aa, Homo Sapiens
AAVPPGSLL

SEQ ID NO: 139267 - protein, 9 aa, Homo Sapiens
AAVPRAAFL

SEQ ID NO: 139268 - protein, 9 aa, Homo Sapiens
AAVPVGYGL

SEQ ID NO: 139269 - protein, 9 aa, Homo Sapiens
AAVTGVLSL

SEQ ID NO: 139270 - protein, 9 aa, Homo Sapiens
AAVVSSPSL

SEQ ID NO: 139271 - protein, 9 aa, Homo Sapiens
AAYAGGLVL

SEQ ID NO: 139272 - protein, 9 aa, Homo Sapiens
AAYDRYLKL

SEQ ID NO: 139273 - protein, 9 aa, Homo Sapiens
AAYLRALSL

SEQ ID NO: 139274 - protein, 9 aa, Homo Sapiens
AAYYHPSYL

SEQ ID NO: 139275 - protein, 9 aa, Homo Sapiens
AFQTAYLSL

SEQ ID NO: 139276 - protein, 9 aa, Homo Sapiens
AGIAHPSAL

SEQ ID NO: 139277 - protein, 9 aa, Homo Sapiens
AGVPLFLLE

SEQ ID NO: 139278 - protein, 9 aa, Homo Sapiens
AIFIKPKSI

SEQ ID NO: 139279 - protein, 9 aa, Homo Sapiens
AIGSRLAVI

SEQ ID NO: 139280 - protein, 9 aa, Homo Sapiens
AIIPYFITL

SEQ ID NO: 139281 - protein, 9 aa, Homo Sapiens
AILMVLVAL

SEQ ID NO: 139282 - protein, 9 aa, Homo Sapiens
AIMDLLLRL

SEQ ID NO: 139283 - protein, 9 aa, Homo Sapiens
AININELFI

SEQ ID NO: 139284 - protein, 9 aa, Homo Sapiens
AIVKPGVPM

SEQ ID NO: 139285 - protein, 9 aa, Homo Sapiens
ALAGPAAAL

SEQ ID NO: 139286 - protein, 9 aa, Homo Sapiens
ALDVFALWL

SEQ ID NO: 139287 - protein, 9 aa, Homo Sapiens
ALVLLRPVI

SEQ ID NO: 139288 - protein, 9 aa, Homo Sapiens
AQYDASELK

SEQ ID NO: 139289 - protein, 9 aa, Homo Sapiens
ASIPYFHAM

SEQ ID NO: 139290 - protein, 9 aa, Homo Sapiens
ASLHVMMTL

SEQ ID NO: 139291 - protein, 9 aa, Homo Sapiens
ASLPSGLPI

SEQ ID NO: 139292 - protein, 9 aa, Homo Sapiens
ASLPVQEYL

SEQ ID NO: 139293 - protein, 9 aa, Homo Sapiens
ASSPEHPEL

SEQ ID NO: 139294 - protein, 9 aa, Homo Sapiens
ASVDKVLEL

SEQ ID NO: 139295 - protein, 9 aa, Homo Sapiens
ASVGKTSIL

SEQ ID NO: 139296 - protein, 9 aa, Homo Sapiens
ATAQPPAPL

SEQ ID NO: 139297 - protein, 9 aa, Homo Sapiens
ATGPEGVLP

SEQ ID NO: 139298 - protein, 9 aa, Homo Sapiens
ATIPPISSL

SEQ ID NO: 139299 - protein, 9 aa, Homo Sapiens
ATTHLSPEL

SEQ ID NO: 139300 - protein, 9 aa, Homo Sapiens
ATVHPGLEL

SEQ ID NO: 139301 - protein, 9 aa, Homo Sapiens
AVADAVVTA

SEQ ID NO: 139302 - protein, 9 aa, Homo Sapiens
AVAPVASAL

SEQ ID NO: 139303 - protein, 9 aa, Homo Sapiens
AVFGHPFSL

SEQ ID NO: 139304 - protein, 9 aa, Homo Sapiens
AVHPSGVAL

SEQ ID NO: 139305 - protein, 9 aa, Homo Sapiens
AVNPKFVAL

SEQ ID NO: 139306 - protein, 9 aa, Homo Sapiens
AVVDVRIGM

SEQ ID NO: 139307 - protein, 9 aa, Homo Sapiens
AVVLPHQPL

SEQ ID NO: 139308 - protein, 9 aa, Homo Sapiens
AVVPLVGKL

SEQ ID NO: 139309 - protein, 9 aa, Homo Sapiens
CAEAVSRVL

SEQ ID NO: 139310 - protein, 9 aa, Homo Sapiens
CAIAQAESL

SEQ ID NO: 139311 - protein, 9 aa, Homo Sapiens
CAYDRIVVA

SEQ ID NO: 139312 - protein, 9 aa, Homo Sapiens
CQDIGAKSL

SEQ ID NO: 139313 - protein, 9 aa, Homo Sapiens
EALTEAELL

SEQ ID NO: 139314 - protein, 9 aa, Homo Sapiens
ETARVPAPV

SEQ ID NO: 139315 - protein, 9 aa, Homo Sapiens
EVGVAIQEK

SEQ ID NO: 139316 - protein, 9 aa, Homo Sapiens
FAAAKLLAL

SEQ ID NO: 139317 - protein, 9 aa, Homo Sapiens
FAAASREVL

SEQ ID NO: 139318 - protein, 9 aa, Homo Sapiens
FAADIISVL

SEQ ID NO: 139319 - protein, 9 aa, Homo Sapiens
FAADLAEEL

SEQ ID NO: 139320 - protein, 9 aa, Homo Sapiens
FAADVLMAI

SEQ ID NO: 139321 - protein, 9 aa, Homo Sapiens
FAADVRLMF

SEQ ID NO: 139322 - protein, 9 aa, Homo Sapiens
FAAESFTFL

SEQ ID NO: 139323 - protein, 9 aa, Homo Sapiens
FAAGLGRSL

SEQ ID NO: 139324 - protein, 9 aa, Homo Sapiens
FAAISGMIL

SEQ ID NO: 139325 - protein, 9 aa, Homo Sapiens
FAALHGPAL

SEQ ID NO: 139326 - protein, 9 aa, Homo Sapiens
FAANVYEAF

SEQ ID NO: 139327 - protein, 9 aa, Homo Sapiens
FAAQRGLAV

SEQ ID NO: 139328 - protein, 9 aa, Homo Sapiens
FAATHSLEF

SEQ ID NO: 139329 - protein, 9 aa, Homo Sapiens
FAAVEGIFF

SEQ ID NO: 139330 - protein, 9 aa, Homo Sapiens
FACEKNENL

SEQ ID NO: 139331 - protein, 9 aa, Homo Sapiens
FACLMFKHL

SEQ ID NO: 139332 - protein, 9 aa, Homo Sapiens
FADAASLLL

SEQ ID NO: 139333 - protein, 9 aa, Homo Sapiens
FADALCIGI

SEQ ID NO: 139334 - protein, 9 aa, Homo Sapiens
FADDGVKYL

SEQ ID NO: 139335 - protein, 9 aa, Homo Sapiens
FADELSHLL

SEQ ID NO: 139336 - protein, 9 aa, Homo Sapiens
FADFERHFL

SEQ ID NO: 139337 - protein, 9 aa, Homo Sapiens
FADGFVKAL

SEQ ID NO: 139338 - protein, 9 aa, Homo Sapiens
FADGHVLEL

SEQ ID NO: 139339 - protein, 9 aa, Homo Sapiens
FADGVILLL

SEQ ID NO: 139340 - protein, 9 aa, Homo Sapiens
FADGVYLVL

SEQ ID NO: 139341 - protein, 9 aa, Homo Sapiens
FADHPRAPF

SEQ ID NO: 139342 - protein, 9 aa, Homo Sapiens
FADHVSSSL

SEQ ID NO: 139343 - protein, 9 aa, Homo Sapiens
FADKHIQVL

SEQ ID NO: 139344 - protein, 9 aa, Homo Sapiens
FADLGYKQM

SEQ ID NO: 139345 - protein, 9 aa, Homo Sapiens
FADLSLKSL

SEQ ID NO: 139346 - protein, 9 aa, Homo Sapiens
FADPHGKVF

SEQ ID NO: 139347 - protein, 9 aa, Homo Sapiens
FADPIAANL

SEQ ID NO: 139348 - protein, 9 aa, Homo Sapiens
FADQEVRSL

SEQ ID NO: 139349 - protein, 9 aa, Homo Sapiens
FADSTVRVW

SEQ ID NO: 139350 - protein, 9 aa, Homo Sapiens
FADVAPLQL

SEQ ID NO: 139351 - protein, 9 aa, Homo Sapiens
FADVLVHRL

SEQ ID NO: 139352 - protein, 9 aa, Homo Sapiens
FADVNGWHL

SEQ ID NO: 139353 - protein, 9 aa, Homo Sapiens
FAEARARAW

SEQ ID NO: 139354 - protein, 9 aa, Homo Sapiens
FAEDPPTSL

SEQ ID NO: 139355 - protein, 9 aa, Homo Sapiens
FAEDSLRVI

SEQ ID NO: 139356 - protein, 9 aa, Homo Sapiens
FAEEQTLVL

SEQ ID NO: 139357 - protein, 9 aa, Homo Sapiens
FAEEVGAAL

SEQ ID NO: 139358 - protein, 9 aa, Homo Sapiens
FAEGFVKAL

SEQ ID NO: 139359 - protein, 9 aa, Homo Sapiens
FAEGFVRAL

SEQ ID NO: 139360 - protein, 9 aa, Homo Sapiens
FAEGKPLAL

SEQ ID NO: 139361 - protein, 9 aa, Homo Sapiens
FAEGKPLEL

SEQ ID NO: 139362 - protein, 9 aa, Homo Sapiens
FAENNFTEL

SEQ ID NO: 139363 - protein, 9 aa, Homo Sapiens
FAEPGRVPF

SEQ ID NO: 139364 - protein, 9 aa, Homo Sapiens
FAEQKFRKL

SEQ ID NO: 139365 - protein, 9 aa, Homo Sapiens
FAESLRTSL

SEQ ID NO: 139366 - protein, 9 aa, Homo Sapiens
FAETGRTFL

SEQ ID NO: 139367 - protein, 9 aa, Homo Sapiens
FAFDEIVAL

SEQ ID NO: 139368 - protein, 9 aa, Homo Sapiens
FAFLTGVGL

SEQ ID NO: 139369 - protein, 9 aa, Homo Sapiens
FAFRNFLYL

SEQ ID NO: 139370 - protein, 9 aa, Homo Sapiens
FAFSCLLTL

SEQ ID NO: 139371 - protein, 9 aa, Homo Sapiens
FAGDIANQL

SEQ ID NO: 139372 - protein, 9 aa, Homo Sapiens
FAGFQRKAV

SEQ ID NO: 139373 - protein, 9 aa, Homo Sapiens
FAGGHPAQL

SEQ ID NO: 139374 - protein, 9 aa, Homo Sapiens
FAGLVFLHL

SEQ ID NO: 139375 - protein, 9 aa, Homo Sapiens
FAGNTPLHL

SEQ ID NO: 139376 - protein, 9 aa, Homo Sapiens
FAGVERLAL

SEQ ID NO: 139377 - protein, 9 aa, Homo Sapiens
FAHEVGHNF

SEQ ID NO: 139378 - protein, 9 aa, Homo Sapiens
FAHLNSPQL

SEQ ID NO: 139379 - protein, 9 aa, Homo Sapiens
FAHLRLEVL

SEQ ID NO: 139380 - protein, 9 aa, Homo Sapiens
FAHPPLLVL

SEQ ID NO: 139381 - protein, 9 aa, Homo Sapiens
FAHPYQYEL

SEQ ID NO: 139382 - protein, 9 aa, Homo Sapiens
FAHQTISAL

SEQ ID NO: 139383 - protein, 9 aa, Homo Sapiens
FAHTNVESL

SEQ ID NO: 139384 - protein, 9 aa, Homo Sapiens
FAIDPHLLL

SEQ ID NO: 139385 - protein, 9 aa, Homo Sapiens
FAIDSSHPW

SEQ ID NO: 139386 - protein, 9 aa, Homo Sapiens
FAIETVKNL

SEQ ID NO: 139387 - protein, 9 aa, Homo Sapiens
FAIGGLCNL

SEQ ID NO: 139388 - protein, 9 aa, Homo Sapiens
FAIGILCSL

SEQ ID NO: 139389 - protein, 9 aa, Homo Sapiens
FAIGLTPML

SEQ ID NO: 139390 - protein, 9 aa, Homo Sapiens
FAIKSLRKL

SEQ ID NO: 139391 - protein, 9 aa, Homo Sapiens
FAILIHDVL

SEQ ID NO: 139392 - protein, 9 aa, Homo Sapiens
FAILRQAEL

SEQ ID NO: 139393 - protein, 9 aa, Homo Sapiens
FAINNSKSF

SEQ ID NO: 139394 - protein, 9 aa, Homo Sapiens
FAIPGSIFL

SEQ ID NO: 139395 - protein, 9 aa, Homo Sapiens
FAIPGSSFL

SEQ ID NO: 139396 - protein, 9 aa, Homo Sapiens
FAIPLIEKL

SEQ ID NO: 139397 - protein, 9 aa, Homo Sapiens
FAIPMIHAV

SEQ ID NO: 139398 - protein, 9 aa, Homo Sapiens
FAIPVGSGL

SEQ ID NO: 139399 - protein, 9 aa, Homo Sapiens
FAIQKGLQA

SEQ ID NO: 139400 - protein, 9 aa, Homo Sapiens
FAISILQQI

SEQ ID NO: 139401 - protein, 9 aa, Homo Sapiens
FAISKNIQL

SEQ ID NO: 139402 - protein, 9 aa, Homo Sapiens
FAKPENIDL

SEQ ID NO: 139403 - protein, 9 aa, Homo Sapiens
FALAKGECM

SEQ ID NO: 139404 - protein, 9 aa, Homo Sapiens
FALDMKYAL

SEQ ID NO: 139405 - protein, 9 aa, Homo Sapiens
FALDSGLEI

SEQ ID NO: 139406 - protein, 9 aa, Homo Sapiens
FALGAALQL

SEQ ID NO: 139407 - protein, 9 aa, Homo Sapiens
FALGAGTAL

SEQ ID NO: 139408 - protein, 9 aa, Homo Sapiens
FALGKILSV

SEQ ID NO: 139409 - protein, 9 aa, Homo Sapiens
FALGPVASV

SEQ ID NO: 139410 - protein, 9 aa, Homo Sapiens
FALGVYRTL

SEQ ID NO: 139411 - protein, 9 aa, Homo Sapiens
FALLAGTAV

SEQ ID NO: 139412 - protein, 9 aa, Homo Sapiens
FALNLFKHL

SEQ ID NO: 139413 - protein, 9 aa, Homo Sapiens
FALPFGRTA

SEQ ID NO: 139414 - protein, 9 aa, Homo Sapiens
FALPGNSQL

SEQ ID NO: 139415 - protein, 9 aa, Homo Sapiens
FALPILNAL

SEQ ID NO: 139416 - protein, 9 aa, Homo Sapiens
FALPVGLIV

SEQ ID NO: 139417 - protein, 9 aa, Homo Sapiens
FALPYIRDV

SEQ ID NO: 139418 - protein, 9 aa, Homo Sapiens
FALPYVIVL

SEQ ID NO: 139419 - protein, 9 aa, Homo Sapiens
FALSEAMGL

SEQ ID NO: 139420 - protein, 9 aa, Homo Sapiens
FALSGPLFL

SEQ ID NO: 139421 - protein, 9 aa, Homo Sapiens
FALSQPRAM

SEQ ID NO: 139422 - protein, 9 aa, Homo Sapiens
FAMDVYKNL

SEQ ID NO: 139423 - protein, 9 aa, Homo Sapiens
FAMEIDPSL

SEQ ID NO: 139424 - protein, 9 aa, Homo Sapiens
FAMIPAKEA

SEQ ID NO: 139425 - protein, 9 aa, Homo Sapiens
FAMIVSSAL

SEQ ID NO: 139426 - protein, 9 aa, Homo Sapiens
FAMKEFIAT

SEQ ID NO: 139427 - protein, 9 aa, Homo Sapiens
FAMPPPHGM

SEQ ID NO: 139428 - protein, 9 aa, Homo Sapiens
FAMPYFIQV

SEQ ID NO: 139429 - protein, 9 aa, Homo Sapiens
FAMQLVKIL

SEQ ID NO: 139430 - protein, 9 aa, Homo Sapiens
FAMYPPSMI

SEQ ID NO: 139431 - protein, 9 aa, Homo Sapiens
FANAHTYHI

SEQ ID NO: 139432 - protein, 9 aa, Homo Sapiens
FANEPFADF

SEQ ID NO: 139433 - protein, 9 aa, Homo Sapiens
FANERCLQL

SEQ ID NO: 139434 - protein, 9 aa, Homo Sapiens
FANKQMNQI

SEQ ID NO: 139435 - protein, 9 aa, Homo Sapiens
FANLKYVSL

SEQ ID NO: 139436 - protein, 9 aa, Homo Sapiens
FANLPNQVH

SEQ ID NO: 139437 - protein, 9 aa, Homo Sapiens
FANLPNQVY

SEQ ID NO: 139438 - protein, 9 aa, Homo Sapiens
FANNVQLSL

SEQ ID NO: 139439 - protein, 9 aa, Homo Sapiens
FAQAPQLSV

SEQ ID NO: 139440 - protein, 9 aa, Homo Sapiens
FAQDVGRMF

SEQ ID NO: 139441 - protein, 9 aa, Homo Sapiens
FAQEAISVL

SEQ ID NO: 139442 - protein, 9 aa, Homo Sapiens
FAQEALTVL

SEQ ID NO: 139443 - protein, 9 aa, Homo Sapiens
FAQKSGYFL

SEQ ID NO: 139444 - protein, 9 aa, Homo Sapiens
FAQMYQKTL

SEQ ID NO: 139445 - protein, 9 aa, Homo Sapiens
FAQPSGLSL

SEQ ID NO: 139446 - protein, 9 aa, Homo Sapiens
FAQTLHPSL

SEQ ID NO: 139447 - protein, 9 aa, Homo Sapiens
FAQYLISEL

SEQ ID NO: 139448 - protein, 9 aa, Homo Sapiens
FARPASPSL

SEQ ID NO: 139449 - protein, 9 aa, Homo Sapiens
FASDVQFVL

SEQ ID NO: 139450 - protein, 9 aa, Homo Sapiens
FASELSRSL

SEQ ID NO: 139451 - protein, 9 aa, Homo Sapiens
FASETNLDF

SEQ ID NO: 139452 - protein, 9 aa, Homo Sapiens
FASEVSNVL

SEQ ID NO: 139453 - protein, 9 aa, Homo Sapiens
FASEYPLIL

SEQ ID NO: 139454 - protein, 9 aa, Homo Sapiens
FASFPHMVL

SEQ ID NO: 139455 - protein, 9 aa, Homo Sapiens
FASGAFLHI

SEQ ID NO: 139456 - protein, 9 aa, Homo Sapiens
FASHVSPEV

SEQ ID NO: 139457 - protein, 9 aa, Homo Sapiens
FASIAGLEF

SEQ ID NO: 139458 - protein, 9 aa, Homo Sapiens
FASIPGLEF

SEQ ID NO: 139459 - protein, 9 aa, Homo Sapiens
FASLPDPVL

SEQ ID NO: 139460 - protein, 9 aa, Homo Sapiens
FASPNGEQF

SEQ ID NO: 139461 - protein, 9 aa, Homo Sapiens
FASQSMPTI

SEQ ID NO: 139462 - protein, 9 aa, Homo Sapiens
FASSPLRVL

SEQ ID NO: 139463 - protein, 9 aa, Homo Sapiens
FASTYLLLL

SEQ ID NO: 139464 - protein, 9 aa, Homo Sapiens
FATDAILAT

SEQ ID NO: 139465 - protein, 9 aa, Homo Sapiens
FATDSGLEF

SEQ ID NO: 139466 - protein, 9 aa, Homo Sapiens
FATEGLRTL

SEQ ID NO: 139467 - protein, 9 aa, Homo Sapiens
FATEVRAVI

SEQ ID NO: 139468 - protein, 9 aa, Homo Sapiens
FATFPSSAF

SEQ ID NO: 139469 - protein, 9 aa, Homo Sapiens
FATGVWHQM

SEQ ID NO: 139470 - protein, 9 aa, Homo Sapiens
FATIKSASL

SEQ ID NO: 139471 - protein, 9 aa, Homo Sapiens
FATSTEPVL

SEQ ID NO: 139472 - protein, 9 aa, Homo Sapiens
FATTNQISL

SEQ ID NO: 139473 - protein, 9 aa, Homo Sapiens
FATTSPLVL

SEQ ID NO: 139474 - protein, 9 aa, Homo Sapiens
FAVALPQLL

SEQ ID NO: 139475 - protein, 9 aa, Homo Sapiens
FAVATPEEL

SEQ ID NO: 139476 - protein, 9 aa, Homo Sapiens
FAVDREARL

SEQ ID NO: 139477 - protein, 9 aa, Homo Sapiens
FAVEYFTRL

SEQ ID NO: 139478 - protein, 9 aa, Homo Sapiens
FAVGPGHGI

SEQ ID NO: 139479 - protein, 9 aa, Homo Sapiens
FAVGSFHTL

SEQ ID NO: 139480 - protein, 9 aa, Homo Sapiens
FAVGVQQVL

SEQ ID NO: 139481 - protein, 9 aa, Homo Sapiens
FAVIAHVGM

SEQ ID NO: 139482 - protein, 9 aa, Homo Sapiens
FAVISRHSL

SEQ ID NO: 139483 - protein, 9 aa, Homo Sapiens
FAVLEDHTL

SEQ ID NO: 139484 - protein, 9 aa, Homo Sapiens
FAVNKWHNL

SEQ ID NO: 139485 - protein, 9 aa, Homo Sapiens
FAVNMFRTL

SEQ ID NO: 139486 - protein, 9 aa, Homo Sapiens
FAVPENSSV

SEQ ID NO: 139487 - protein, 9 aa, Homo Sapiens
FAVPESDHL

SEQ ID NO: 139488 - protein, 9 aa, Homo Sapiens
FAVPKNYKL

SEQ ID NO: 139489 - protein, 9 aa, Homo Sapiens
FAVSDGLEL

SEQ ID NO: 139490 - protein, 9 aa, Homo Sapiens
FAVTLETVL

SEQ ID NO: 139491 - protein, 9 aa, Homo Sapiens
FAVVPSTAT

SEQ ID NO: 139492 - protein, 9 aa, Homo Sapiens
FAVYIHALL

SEQ ID NO: 139493 - protein, 9 aa, Homo Sapiens
FAWPQPASL

SEQ ID NO: 139494 - protein, 9 aa, Homo Sapiens
FAYEDIKTL

SEQ ID NO: 139495 - protein, 9 aa, Homo Sapiens
FAYEGPMYL

SEQ ID NO: 139496 - protein, 9 aa, Homo Sapiens
FAYGLLMEL

SEQ ID NO: 139497 - protein, 9 aa, Homo Sapiens
FAYLRDLLI

SEQ ID NO: 139498 - protein, 9 aa, Homo Sapiens
FAYMPNNSL

SEQ ID NO: 139499 - protein, 9 aa, Homo Sapiens
FAYPAIRYL

SEQ ID NO: 139500 - protein, 9 aa, Homo Sapiens
FAYRGFKYL

SEQ ID NO: 139501 - protein, 9 aa, Homo Sapiens
FAYTARISV

SEQ ID NO: 139502 - protein, 9 aa, Homo Sapiens
FAYTSRHEI

SEQ ID NO: 139503 - protein, 9 aa, Homo Sapiens
FAYVEGESL

SEQ ID NO: 139504 - protein, 9 aa, Homo Sapiens
FCIEVGKNL

SEQ ID NO: 139505 - protein, 9 aa, Homo Sapiens
FFMPGFAPL

SEQ ID NO: 139506 - protein, 9 aa, Homo Sapiens
FGCPNPRQL

SEQ ID NO: 139507 - protein, 9 aa, Homo Sapiens
FGDVTAHLL

SEQ ID NO: 139508 - protein, 9 aa, Homo Sapiens
FGEMGGKFM

SEQ ID NO: 139509 - protein, 9 aa, Homo Sapiens
FGGPEVLKL

SEQ ID NO: 139510 - protein, 9 aa, Homo Sapiens
FGHYQQAEL

SEQ ID NO: 139511 - protein, 9 aa, Homo Sapiens
FGIDPIWSL

SEQ ID NO: 139512 - protein, 9 aa, Homo Sapiens
FGIDRPAEL

SEQ ID NO: 139513 - protein, 9 aa, Homo Sapiens
FGINHGIEL

SEQ ID NO: 139514 - protein, 9 aa, Homo Sapiens
FGINKVSKL

SEQ ID NO: 139515 - protein, 9 aa, Homo Sapiens
FGIPVLMAL

SEQ ID NO: 139516 - protein, 9 aa, Homo Sapiens
FGKAAGPSL

SEQ ID NO: 139517 - protein, 9 aa, Homo Sapiens
FGLARAFSL

SEQ ID NO: 139518 - protein, 9 aa, Homo Sapiens
FGLPRWVTL

SEQ ID NO: 139519 - protein, 9 aa, Homo Sapiens
FGMIVSSAL

SEQ ID NO: 139520 - protein, 9 aa, Homo Sapiens
FGMQARYSL

SEQ ID NO: 139521 - protein, 9 aa, Homo Sapiens
FGNGWIPTL

SEQ ID NO: 139522 - protein, 9 aa, Homo Sapiens
FGNNKLTTF

SEQ ID NO: 139523 - protein, 9 aa, Homo Sapiens
FGNPRGTFL

SEQ ID NO: 139524 - protein, 9 aa, Homo Sapiens
FGNPRKPVL

SEQ ID NO: 139525 - protein, 9 aa, Homo Sapiens
FGVDPYNVL

SEQ ID NO: 139526 - protein, 9 aa, Homo Sapiens
FGVIPSTPL

SEQ ID NO: 139527 - protein, 9 aa, Homo Sapiens
FGVPVVVAL

SEQ ID NO: 139528 - protein, 9 aa, Homo Sapiens
FGWSHLEAL

SEQ ID NO: 139529 - protein, 9 aa, Homo Sapiens
FGYDKPHVL

SEQ ID NO: 139530 - protein, 9 aa, Homo Sapiens
FGYDYPSVL

SEQ ID NO: 139531 - protein, 9 aa, Homo Sapiens
FGYPDPTYL

SEQ ID NO: 139532 - protein, 9 aa, Homo Sapiens
FGYSDALEL

SEQ ID NO: 139533 - protein, 9 aa, Homo Sapiens
FIADHCPTL

SEQ ID NO: 139534 - protein, 9 aa, Homo Sapiens
FIADPLCSL

SEQ ID NO: 139535 - protein, 9 aa, Homo Sapiens
FIAEHYMFL

SEQ ID NO: 139536 - protein, 9 aa, Homo Sapiens
FIAPSGHGL

SEQ ID NO: 139537 - protein, 9 aa, Homo Sapiens
FIAPTGHSL

SEQ ID NO: 139538 - protein, 9 aa, Homo Sapiens
FICDHPQIM

SEQ ID NO: 139539 - protein, 9 aa, Homo Sapiens
FICPITREL

SEQ ID NO: 139540 - protein, 9 aa, Homo Sapiens
FIDGGGSVL

SEQ ID NO: 139541 - protein, 9 aa, Homo Sapiens
FIDGHFVEM

SEQ ID NO: 139542 - protein, 9 aa, Homo Sapiens
FIDTAQHML

SEQ ID NO: 139543 - protein, 9 aa, Homo Sapiens
FIEDAVHVL

SEQ ID NO: 139544 - protein, 9 aa, Homo Sapiens
FIEPNVRFW

SEQ ID NO: 139545 - protein, 9 aa, Homo Sapiens
FIFLPGNTL

SEQ ID NO: 139546 - protein, 9 aa, Homo Sapiens
FIFSDTHEL

SEQ ID NO: 139547 - protein, 9 aa, Homo Sapiens
FIGDSGIPL

SEQ ID NO: 139548 - protein, 9 aa, Homo Sapiens
FIIDGKGVL

SEQ ID NO: 139549 - protein, 9 aa, Homo Sapiens
FIIISSQHL

SEQ ID NO: 139550 - protein, 9 aa, Homo Sapiens
FIIKPGSGA

SEQ ID NO: 139551 - protein, 9 aa, Homo Sapiens
FIIPSCIAI

SEQ ID NO: 139552 - protein, 9 aa, Homo Sapiens
FIIQGLRSV

SEQ ID NO: 139553 - protein, 9 aa, Homo Sapiens
FIISRTQAL

SEQ ID NO: 139554 - protein, 9 aa, Homo Sapiens
FIITPGGCL

SEQ ID NO: 139555 - protein, 9 aa, Homo Sapiens
FIIYDTHSL

SEQ ID NO: 139556 - protein, 9 aa, Homo Sapiens
FILEHIMVI

SEQ ID NO: 139557 - protein, 9 aa, Homo Sapiens
FILEHIMVV

SEQ ID NO: 139558 - protein, 9 aa, Homo Sapiens
FILEPRSFL

SEQ ID NO: 139559 - protein, 9 aa, Homo Sapiens
FILGHLRTL

SEQ ID NO: 139560 - protein, 9 aa, Homo Sapiens
FIMDRAQAL

SEQ ID NO: 139561 - protein, 9 aa, Homo Sapiens
FIMSATPTM

SEQ ID NO: 139562 - protein, 9 aa, Homo Sapiens
FINGDISSL

SEQ ID NO: 139563 - protein, 9 aa, Homo Sapiens
FIPATGHSL

SEQ ID NO: 139564 - protein, 9 aa, Homo Sapiens
FIQAVRQTL

SEQ ID NO: 139565 - protein, 9 aa, Homo Sapiens
FIQQCIRQL

SEQ ID NO: 139566 - protein, 9 aa, Homo Sapiens
FIRVSGSEL

SEQ ID NO: 139567 - protein, 9 aa, Homo Sapiens
FISGHTSEL

SEQ ID NO: 139568 - protein, 9 aa, Homo Sapiens
FISHLFMQL

SEQ ID NO: 139569 - protein, 9 aa, Homo Sapiens
FISPTGHSL

SEQ ID NO: 139570 - protein, 9 aa, Homo Sapiens
FITDHVNSL

SEQ ID NO: 139571 - protein, 9 aa, Homo Sapiens
FITESYQTL

SEQ ID NO: 139572 - protein, 9 aa, Homo Sapiens
FITPTGHSL

SEQ ID NO: 139573 - protein, 9 aa, Homo Sapiens
FIVDARPAM

SEQ ID NO: 139574 - protein, 9 aa, Homo Sapiens
FIVEETLPL

SEQ ID NO: 139575 - protein, 9 aa, Homo Sapiens
FLADPVSNM

SEQ ID NO: 139576 - protein, 9 aa, Homo Sapiens
FLAEAARSL

SEQ ID NO: 139577 - protein, 9 aa, Homo Sapiens
FLAHIYTEL

SEQ ID NO: 139578 - protein, 9 aa, Homo Sapiens
FLANVSTVL

SEQ ID NO: 139579 - protein, 9 aa, Homo Sapiens
FLCPFHLSV

SEQ ID NO: 139580 - protein, 9 aa, Homo Sapiens
FLCVVSKEL

SEQ ID NO: 139581 - protein, 9 aa, Homo Sapiens
FLDEKTHEL

SEQ ID NO: 139582 - protein, 9 aa, Homo Sapiens
FLEGRHAEL

SEQ ID NO: 139583 - protein, 9 aa, Homo Sapiens
FLENHVRHL

SEQ ID NO: 139584 - protein, 9 aa, Homo Sapiens
FLFDHLLTL

SEQ ID NO: 139585 - protein, 9 aa, Homo Sapiens
FLFPPAESL

SEQ ID NO: 139586 - protein, 9 aa, Homo Sapiens
FLFSKFIEL

SEQ ID NO: 139587 - protein, 9 aa, Homo Sapiens
FLHPHLLVL

SEQ ID NO: 139588 - protein, 9 aa, Homo Sapiens
FLIAKVKYL

SEQ ID NO: 139589 - protein, 9 aa, Homo Sapiens
FLIIPLHSL

SEQ ID NO: 139590 - protein, 9 aa, Homo Sapiens
FLINFIHTL

SEQ ID NO: 139591 - protein, 9 aa, Homo Sapiens
FLIPFVITV

SEQ ID NO: 139592 - protein, 9 aa, Homo Sapiens
FLIPKFFEL

SEQ ID NO: 139593 - protein, 9 aa, Homo Sapiens
FLIRESETL

SEQ ID NO: 139594 - protein, 9 aa, Homo Sapiens
FLLEKPFSV

SEQ ID NO: 139595 - protein, 9 aa, Homo Sapiens
FLLPLIIVL

SEQ ID NO: 139596 - protein, 9 aa, Homo Sapiens
FLLPVINEM

SEQ ID NO: 139597 - protein, 9 aa, Homo Sapiens
FLLQHVQEL

SEQ ID NO: 139598 - protein, 9 aa, Homo Sapiens
FLMDAGSVL

SEQ ID NO: 139599 - protein, 9 aa, Homo Sapiens
FLNQPHMVL

SEQ ID NO: 139600 - protein, 9 aa, Homo Sapiens
FLPDHPIVL

SEQ ID NO: 139601 - protein, 9 aa, Homo Sapiens
FLQDTRLAL

SEQ ID NO: 139602 - protein, 9 aa, Homo Sapiens
FLQEHNTTL

SEQ ID NO: 139603 - protein, 9 aa, Homo Sapiens
FLQQPRPLM

SEQ ID NO: 139604 - protein, 9 aa, Homo Sapiens
FLQTPLTEL

SEQ ID NO: 139605 - protein, 9 aa, Homo Sapiens
FLSHIPITL

SEQ ID NO: 139606 - protein, 9 aa, Homo Sapiens
FLSSSNLSL

SEQ ID NO: 139607 - protein, 9 aa, Homo Sapiens
FLVEHNLVL

SEQ ID NO: 139608 - protein, 9 aa, Homo Sapiens
FLVEHVLTL

SEQ ID NO: 139609 - protein, 9 aa, Homo Sapiens
FLVHNVKEL

SEQ ID NO: 139610 - protein, 9 aa, Homo Sapiens
FLYAGHIFL

SEQ ID NO: 139611 - protein, 9 aa, Homo Sapiens
FLYPFFGVL

SEQ ID NO: 139612 - protein, 9 aa, Homo Sapiens
FLYPFPLAL

SEQ ID NO: 139613 - protein, 9 aa, Homo Sapiens
FLYSGHLAL

SEQ ID NO: 139614 - protein, 9 aa, Homo Sapiens
FMSDLMKAL

SEQ ID NO: 139615 - protein, 9 aa, Homo Sapiens
FNDPNAKEM

SEQ ID NO: 139616 - protein, 9 aa, Homo Sapiens
FNDPVAMVL

SEQ ID NO: 139617 - protein, 9 aa, Homo Sapiens
FNYPGGVAM

SEQ ID NO: 139618 - protein, 9 aa, Homo Sapiens
FQAPTAKEM

SEQ ID NO: 139619 - protein, 9 aa, Homo Sapiens
FQEADSPTL

SEQ ID NO: 139620 - protein, 9 aa, Homo Sapiens
FQFGVPQAL

SEQ ID NO: 139621 - protein, 9 aa, Homo Sapiens
FQIAQYKCL

SEQ ID NO: 139622 - protein, 9 aa, Homo Sapiens
FQIQTSTSL

SEQ ID NO: 139623 - protein, 9 aa, Homo Sapiens
FQLEHIMDL

SEQ ID NO: 139624 - protein, 9 aa, Homo Sapiens
FQNEVARQL

SEQ ID NO: 139625 - protein, 9 aa, Homo Sapiens
FQNPFRSEL

SEQ ID NO: 139626 - protein, 9 aa, Homo Sapiens
FQNPSTVTL

SEQ ID NO: 139627 - protein, 9 aa, Homo Sapiens
FQSSAVMAL

SEQ ID NO: 139628 - protein, 9 aa, Homo Sapiens
FQTEVGKQL

SEQ ID NO: 139629 - protein, 9 aa, Homo Sapiens
FQTHTTPVL

SEQ ID NO: 139630 - protein, 9 aa, Homo Sapiens
FQTIARNAL

SEQ ID NO: 139631 - protein, 9 aa, Homo Sapiens
FQVNHTVAL

SEQ ID NO: 139632 - protein, 9 aa, Homo Sapiens
FQYDHEAFL

SEQ ID NO: 139633 - protein, 9 aa, Homo Sapiens
FQYPDTRYL

SEQ ID NO: 139634 - protein, 9 aa, Homo Sapiens
FQYSKSPSL

SEQ ID NO: 139635 - protein, 9 aa, Homo Sapiens
FSAGEPRVL

SEQ ID NO: 139636 - protein, 9 aa, Homo Sapiens
FSAPPGSEL

SEQ ID NO: 139637 - protein, 9 aa, Homo Sapiens
FSAPSGTGL

SEQ ID NO: 139638 - protein, 9 aa, Homo Sapiens
FSDDSDLQL

SEQ ID NO: 139639 - protein, 9 aa, Homo Sapiens
FSDFEARQL

SEQ ID NO: 139640 - protein, 9 aa, Homo Sapiens
FSDLTMHEL

SEQ ID NO: 139641 - protein, 9 aa, Homo Sapiens
FSDPFLKYL

SEQ ID NO: 139642 - protein, 9 aa, Homo Sapiens
FSDPIHPQL

SEQ ID NO: 139643 - protein, 9 aa, Homo Sapiens
FSDPVYKEI

SEQ ID NO: 139644 - protein, 9 aa, Homo Sapiens
FSEDGYRTV

SEQ ID NO: 139645 - protein, 9 aa, Homo Sapiens
FSEGGERLL

SEQ ID NO: 139646 - protein, 9 aa, Homo Sapiens
FSEPFHLIV

SEQ ID NO: 139647 - protein, 9 aa, Homo Sapiens
FSESHLVII

SEQ ID NO: 139648 - protein, 9 aa, Homo Sapiens
FSFEAQGGL

SEQ ID NO: 139649 - protein, 9 aa, Homo Sapiens
FSFHHVLSL

SEQ ID NO: 139650 - protein, 9 aa, Homo Sapiens
FSFPEPEAL

SEQ ID NO: 139651 - protein, 9 aa, Homo Sapiens
FSFVRITAL

SEQ ID NO: 139652 - protein, 9 aa, Homo Sapiens
FSFVRVISL

SEQ ID NO: 139653 - protein, 9 aa, Homo Sapiens
FSHAQTVVL

SEQ ID NO: 139654 - protein, 9 aa, Homo Sapiens
FSHEVGSEL

SEQ ID NO: 139655 - protein, 9 aa, Homo Sapiens
FSHPREPAL

SEQ ID NO: 139656 - protein, 9 aa, Homo Sapiens
FSIADSIEL

SEQ ID NO: 139657 - protein, 9 aa, Homo Sapiens
FSIDPARTL

SEQ ID NO: 139658 - protein, 9 aa, Homo Sapiens
FSIDRALNV

SEQ ID NO: 139659 - protein, 9 aa, Homo Sapiens
FSIDSPDSL

SEQ ID NO: 139660 - protein, 9 aa, Homo Sapiens
FSIEPWLKV

SEQ ID NO: 139661 - protein, 9 aa, Homo Sapiens
FSIGADTAL

SEQ ID NO: 139662 - protein, 9 aa, Homo Sapiens
FSIPFAPHI

SEQ ID NO: 139663 - protein, 9 aa, Homo Sapiens
FSIPILMQL

SEQ ID NO: 139664 - protein, 9 aa, Homo Sapiens
FSIPVVSDV

SEQ ID NO: 139665 - protein, 9 aa, Homo Sapiens
FSIPVVWTL

SEQ ID NO: 139666 - protein, 9 aa, Homo Sapiens
FSITPLSEL

SEQ ID NO: 139667 - protein, 9 aa, Homo Sapiens
FSLDLVHTL

SEQ ID NO: 139668 - protein, 9 aa, Homo Sapiens
FSLETHTAL

SEQ ID NO: 139669 - protein, 9 aa, Homo Sapiens
FSLLPLSHL

SEQ ID NO: 139670 - protein, 9 aa, Homo Sapiens
FSLPGATCL

SEQ ID NO: 139671 - protein, 9 aa, Homo Sapiens
FSLPHPEAL

SEQ ID NO: 139672 - protein, 9 aa, Homo Sapiens
FSLPPGHAV

SEQ ID NO: 139673 - protein, 9 aa, Homo Sapiens
FSMDIIDSL

SEQ ID NO: 139674 - protein, 9 aa, Homo Sapiens
FSMLESPAL

SEQ ID NO: 139675 - protein, 9 aa, Homo Sapiens
FSNAHINEL

SEQ ID NO: 139676 - protein, 9 aa, Homo Sapiens
FSNGHIKVL

SEQ ID NO: 139677 - protein, 9 aa, Homo Sapiens
FSNLGTTHL

SEQ ID NO: 139678 - protein, 9 aa, Homo Sapiens
FSNPRALYL

SEQ ID NO: 139679 - protein, 9 aa, Homo Sapiens
FSPFHASVL

SEQ ID NO: 139680 - protein, 9 aa, Homo Sapiens
FSQPGLRSL

SEQ ID NO: 139681 - protein, 9 aa, Homo Sapiens
FSQPKVTEL

SEQ ID NO: 139682 - protein, 9 aa, Homo Sapiens
FSQPRHISV

SEQ ID NO: 139683 - protein, 9 aa, Homo Sapiens
FSSANSPFL

SEQ ID NO: 139684 - protein, 9 aa, Homo Sapiens
FSSDNIAVL

SEQ ID NO: 139685 - protein, 9 aa, Homo Sapiens
FSSDVTHEM

SEQ ID NO: 139686 - protein, 9 aa, Homo Sapiens
FSSEVTAAL

SEQ ID NO: 139687 - protein, 9 aa, Homo Sapiens
FSSPHLQML

SEQ ID NO: 139688 - protein, 9 aa, Homo Sapiens
FSSPSFQTL

SEQ ID NO: 139689 - protein, 9 aa, Homo Sapiens
FSSSSHLII

SEQ ID NO: 139690 - protein, 9 aa, Homo Sapiens
FSTDSPRLL

SEQ ID NO: 139691 - protein, 9 aa, Homo Sapiens
FSTGNFNVL

SEQ ID NO: 139692 - protein, 9 aa, Homo Sapiens
FSTLYGRVL

SEQ ID NO: 139693 - protein, 9 aa, Homo Sapiens
FSTPLNPLL

SEQ ID NO: 139694 - protein, 9 aa, Homo Sapiens
FSTSVVRPF

SEQ ID NO: 139695 - protein, 9 aa, Homo Sapiens
FSVEGQLEF

SEQ ID NO: 139696 - protein, 9 aa, Homo Sapiens
FSVENKWSL

SEQ ID NO: 139697 - protein, 9 aa, Homo Sapiens
FSVEQITAM

SEQ ID NO: 139698 - protein, 9 aa, Homo Sapiens
FSVKAGEAL

SEQ ID NO: 139699 - protein, 9 aa, Homo Sapiens
FSVNLFRTL

SEQ ID NO: 139700 - protein, 9 aa, Homo Sapiens
FSVPGGHNL

SEQ ID NO: 139701 - protein, 9 aa, Homo Sapiens
FSVPGSMKL

SEQ ID NO: 139702 - protein, 9 aa, Homo Sapiens
FSVPHTKSL

SEQ ID NO: 139703 - protein, 9 aa, Homo Sapiens
FSVPVAWTL

SEQ ID NO: 139704 - protein, 9 aa, Homo Sapiens
FSYAFPKAV

SEQ ID NO: 139705 - protein, 9 aa, Homo Sapiens
FSYAFPKEF

SEQ ID NO: 139706 - protein, 9 aa, Homo Sapiens
FSYEHFYVI

SEQ ID NO: 139707 - protein, 9 aa, Homo Sapiens
FSYEVSRSL

SEQ ID NO: 139708 - protein, 9 aa, Homo Sapiens
FSYGSGLAA

SEQ ID NO: 139709 - protein, 9 aa, Homo Sapiens
FSYHQFIHL

SEQ ID NO: 139710 - protein, 9 aa, Homo Sapiens
FSYITAVTL

SEQ ID NO: 139711 - protein, 9 aa, Homo Sapiens
FSYLNPQEL

SEQ ID NO: 139712 - protein, 9 aa, Homo Sapiens
FSYPAGTEL

SEQ ID NO: 139713 - protein, 9 aa, Homo Sapiens
FSYSCPKFL

SEQ ID NO: 139714 - protein, 9 aa, Homo Sapiens
FSYTGRVAV

SEQ ID NO: 139715 - protein, 9 aa, Homo Sapiens
FSYVTPRAF

SEQ ID NO: 139716 - protein, 9 aa, Homo Sapiens
FTADPLSLL

SEQ ID NO: 139717 - protein, 9 aa, Homo Sapiens
FTADVRSVL

SEQ ID NO: 139718 - protein, 9 aa, Homo Sapiens
FTAPATVSL

SEQ ID NO: 139719 - protein, 9 aa, Homo Sapiens
FTDASFLTL

SEQ ID NO: 139720 - protein, 9 aa, Homo Sapiens
FTDSGIHII

SEQ ID NO: 139721 - protein, 9 aa, Homo Sapiens
FTDTERLIG

SEQ ID NO: 139722 - protein, 9 aa, Homo Sapiens
FTEAGLKEL

SEQ ID NO: 139723 - protein, 9 aa, Homo Sapiens
FTEGNFAIL

SEQ ID NO: 139724 - protein, 9 aa, Homo Sapiens
FTEKSGRLL

SEQ ID NO: 139725 - protein, 9 aa, Homo Sapiens
FTFPDPPPL

SEQ ID NO: 139726 - protein, 9 aa, Homo Sapiens
FTFPGCRAL

SEQ ID NO: 139727 - protein, 9 aa, Homo Sapiens
FTGSTEIGR

SEQ ID NO: 139728 - protein, 9 aa, Homo Sapiens
FTIDGPLCL

SEQ ID NO: 139729 - protein, 9 aa, Homo Sapiens
FTIDIKSFL

SEQ ID NO: 139730 - protein, 9 aa, Homo Sapiens
FTIFRTISV

SEQ ID NO: 139731 - protein, 9 aa, Homo Sapiens
FTIPHTQEA

SEQ ID NO: 139732 - protein, 9 aa, Homo Sapiens
FTIVSPLDI

SEQ ID NO: 139733 - protein, 9 aa, Homo Sapiens
FTLDVMKEL

SEQ ID NO: 139734 - protein, 9 aa, Homo Sapiens
FTLSHITQL

SEQ ID NO: 139735 - protein, 9 aa, Homo Sapiens
FTMDPKLSA

SEQ ID NO: 139736 - protein, 9 aa, Homo Sapiens
FTMGGPAIS

SEQ ID NO: 139737 - protein, 9 aa, Homo Sapiens
FTMKTVLML

SEQ ID NO: 139738 - protein, 9 aa, Homo Sapiens
FTNDKIINL

SEQ ID NO: 139739 - protein, 9 aa, Homo Sapiens
FTNGQTVNL

SEQ ID NO: 139740 - protein, 9 aa, Homo Sapiens
FTNPWTKEL

SEQ ID NO: 139741 - protein, 9 aa, Homo Sapiens
FTNRTVLEL

SEQ ID NO: 139742 - protein, 9 aa, Homo Sapiens
FTSAAFHEL

SEQ ID NO: 139743 - protein, 9 aa, Homo Sapiens
FTSEKFLVM

SEQ ID NO: 139744 - protein, 9 aa, Homo Sapiens
FTSLPGSTM

SEQ ID NO: 139745 - protein, 9 aa, Homo Sapiens
FTSPFCLQV

SEQ ID NO: 139746 - protein, 9 aa, Homo Sapiens
FTSPPISCV

SEQ ID NO: 139747 - protein, 9 aa, Homo Sapiens
FTVMPGQTL

SEQ ID NO: 139748 - protein, 9 aa, Homo Sapiens
FTVNPKGEL

SEQ ID NO: 139749 - protein, 9 aa, Homo Sapiens
FTVPHTHVF

SEQ ID NO: 139750 - protein, 9 aa, Homo Sapiens
FTVPKNRSL

SEQ ID NO: 139751 - protein, 9 aa, Homo Sapiens
FTVPQIIEM

SEQ ID NO: 139752 - protein, 9 aa, Homo Sapiens
FTVPRVVAV

SEQ ID NO: 139753 - protein, 9 aa, Homo Sapiens
FTVTVPKDL

SEQ ID NO: 139754 - protein, 9 aa, Homo Sapiens
FTVTVPKEL

SEQ ID NO: 139755 - protein, 9 aa, Homo Sapiens
FTYGLHMIL

SEQ ID NO: 139756 - protein, 9 aa, Homo Sapiens
FTYNIPTCL

SEQ ID NO: 139757 - protein, 9 aa, Homo Sapiens
FVADVRLIF

SEQ ID NO: 139758 - protein, 9 aa, Homo Sapiens
FVAEGGPEL

SEQ ID NO: 139759 - protein, 9 aa, Homo Sapiens
FVALPGVAV

SEQ ID NO: 139760 - protein, 9 aa, Homo Sapiens
FVAPPTAAV

SEQ ID NO: 139761 - protein, 9 aa, Homo Sapiens
FVDEGIKTL

SEQ ID NO: 139762 - protein, 9 aa, Homo Sapiens
FVEEEEHFL

SEQ ID NO: 139763 - protein, 9 aa, Homo Sapiens
FVFETPFTL

SEQ ID NO: 139764 - protein, 9 aa, Homo Sapiens
FVFPGELLL

SEQ ID NO: 139765 - protein, 9 aa, Homo Sapiens
FVHAQCLEL

SEQ ID NO: 139766 - protein, 9 aa, Homo Sapiens
FVHDLVLYL

SEQ ID NO: 139767 - protein, 9 aa, Homo Sapiens
FVHPKPVSL

SEQ ID NO: 139768 - protein, 9 aa, Homo Sapiens
FVIDLQTRL

SEQ ID NO: 139769 - protein, 9 aa, Homo Sapiens
FVIETARQL

SEQ ID NO: 139770 - protein, 9 aa, Homo Sapiens
FVIGNGKNL

SEQ ID NO: 139771 - protein, 9 aa, Homo Sapiens
FVIPVVQAL

SEQ ID NO: 139772 - protein, 9 aa, Homo Sapiens
FVIQPFSPL

SEQ ID NO: 139773 - protein, 9 aa, Homo Sapiens
FVMAPTSFL

SEQ ID NO: 139774 - protein, 9 aa, Homo Sapiens
FVMEGVKNL

SEQ ID NO: 139775 - protein, 9 aa, Homo Sapiens
FVMETFVHL

SEQ ID NO: 139776 - protein, 9 aa, Homo Sapiens
FVNPHVSSF

SEQ ID NO: 139777 - protein, 9 aa, Homo Sapiens
FVNPSLRVL

SEQ ID NO: 139778 - protein, 9 aa, Homo Sapiens
FVNPVQVVL

SEQ ID NO: 139779 - protein, 9 aa, Homo Sapiens
FVPGTTAVL

SEQ ID NO: 139780 - protein, 9 aa, Homo Sapiens
FVQFASQEI

SEQ ID NO: 139781 - protein, 9 aa, Homo Sapiens
FVSPLVKYL

SEQ ID NO: 139782 - protein, 9 aa, Homo Sapiens
FVSSFMSEL

SEQ ID NO: 139783 - protein, 9 aa, Homo Sapiens
FVTEEIIPL

SEQ ID NO: 139784 - protein, 9 aa, Homo Sapiens
FVTKPNSAL

SEQ ID NO: 139785 - protein, 9 aa, Homo Sapiens
FVTSSHLQL

SEQ ID NO: 139786 - protein, 9 aa, Homo Sapiens
FVVERQPCM

SEQ ID NO: 139787 - protein, 9 aa, Homo Sapiens
FVVETQPCM

SEQ ID NO: 139788 - protein, 9 aa, Homo Sapiens
FVVPNQKEL

SEQ ID NO: 139789 - protein, 9 aa, Homo Sapiens
FVVPNQKRL

SEQ ID NO: 139790 - protein, 9 aa, Homo Sapiens
FVVPYGTPL

SEQ ID NO: 139791 - protein, 9 aa, Homo Sapiens
FVYENPISL

SEQ ID NO: 139792 - protein, 9 aa, Homo Sapiens
FVYGESVEL

SEQ ID NO: 139793 - protein, 9 aa, Homo Sapiens
FVYPFGATL

SEQ ID NO: 139794 - protein, 9 aa, Homo Sapiens
FYILTSKEL

SEQ ID NO: 139795 - protein, 9 aa, Homo Sapiens
FYVPFAKAL

SEQ ID NO: 139796 - protein, 9 aa, Homo Sapiens
GAAAWARPL

SEQ ID NO: 139797 - protein, 9 aa, Homo Sapiens
GAAPCRLAL

SEQ ID NO: 139798 - protein, 9 aa, Homo Sapiens
GAAVPIYVI

SEQ ID NO: 139799 - protein, 9 aa, Homo Sapiens
GAFQPGRPL

SEQ ID NO: 139800 - protein, 9 aa, Homo Sapiens
GAGPVLEAF

SEQ ID NO: 139801 - protein, 9 aa, Homo Sapiens
GAHFSVSSL

SEQ ID NO: 139802 - protein, 9 aa, Homo Sapiens
GAIARPACL

SEQ ID NO: 139803 - protein, 9 aa, Homo Sapiens
GAIPAFISL

SEQ ID NO: 139804 - protein, 9 aa, Homo Sapiens
GALAVFPSL

SEQ ID NO: 139805 - protein, 9 aa, Homo Sapiens
GALFISPAL

SEQ ID NO: 139806 - protein, 9 aa, Homo Sapiens
GALPYFSEM

SEQ ID NO: 139807 - protein, 9 aa, Homo Sapiens
GASPIGPTL

SEQ ID NO: 139808 - protein, 9 aa, Homo Sapiens
GATPVFIPL

SEQ ID NO: 139809 - protein, 9 aa, Homo Sapiens
GATPVSLAL

SEQ ID NO: 139810 - protein, 9 aa, Homo Sapiens
GAVDPLLAL

SEQ ID NO: 139811 - protein, 9 aa, Homo Sapiens
GAVEKGVPL

SEQ ID NO: 139812 - protein, 9 aa, Homo Sapiens
GAVPIFIEL

SEQ ID NO: 139813 - protein, 9 aa, Homo Sapiens
GAVSPFGML

SEQ ID NO: 139814 - protein, 9 aa, Homo Sapiens
GAYKYIQEL

SEQ ID NO: 139815 - protein, 9 aa, Homo Sapiens
GAYVPSLAL

SEQ ID NO: 139816 - protein, 9 aa, Homo Sapiens
GDVFYLHSR

SEQ ID NO: 139817 - protein, 9 aa, Homo Sapiens
GFAGDDAPR

SEQ ID NO: 139818 - protein, 9 aa, Homo Sapiens
GIGTVPVGR

SEQ ID NO: 139819 - protein, 9 aa, Homo Sapiens
GIIDPGSTV

SEQ ID NO: 139820 - protein, 9 aa, Homo Sapiens
GIIHVISRP

SEQ ID NO: 139821 - protein, 9 aa, Homo Sapiens
GIIRPGTAF

SEQ ID NO: 139822 - protein, 9 aa, Homo Sapiens
GILAIFRAL

SEQ ID NO: 139823 - protein, 9 aa, Homo Sapiens
GPPPPGKPQ

SEQ ID NO: 139824 - protein, 9 aa, Homo Sapiens
GQLNADLRK

SEQ ID NO: 139825 - protein, 9 aa, Homo Sapiens
GSTTVFHSL

SEQ ID NO: 139826 - protein, 9 aa, Homo Sapiens
GTAPPTLAL

SEQ ID NO: 139827 - protein, 9 aa, Homo Sapiens
GTIPWFMEI

SEQ ID NO: 139828 - protein, 9 aa, Homo Sapiens
GVIKVFNDM

SEQ ID NO: 139829 - protein, 9 aa, Homo Sapiens
HAAHIISEL

SEQ ID NO: 139830 - protein, 9 aa, Homo Sapiens
HAASVFLTL

SEQ ID NO: 139831 - protein, 9 aa, Homo Sapiens
HACGVIATI

SEQ ID NO: 139832 - protein, 9 aa, Homo Sapiens
HADDSFLVL

SEQ ID NO: 139833 - protein, 9 aa, Homo Sapiens
HAFWGGSVV

SEQ ID NO: 139834 - protein, 9 aa, Homo Sapiens
HAIMRSPQM

SEQ ID NO: 139835 - protein, 9 aa, Homo Sapiens
HAIPPTLAM

SEQ ID NO: 139836 - protein, 9 aa, Homo Sapiens
HAMQFPAEL

SEQ ID NO: 139837 - protein, 9 aa, Homo Sapiens
HAMVILLTL

SEQ ID NO: 139838 - protein, 9 aa, Homo Sapiens
HASDRIIAL

SEQ ID NO: 139839 - protein, 9 aa, Homo Sapiens
HAVGPSTSL

SEQ ID NO: 139840 - protein, 9 aa, Homo Sapiens
HAVHVALVL

SEQ ID NO: 139841 - protein, 9 aa, Homo Sapiens
HAVSDPSIL

SEQ ID NO: 139842 - protein, 9 aa, Homo Sapiens
HAWSGALEM

SEQ ID NO: 139843 - protein, 9 aa, Homo Sapiens
HIIAGAGEL

SEQ ID NO: 139844 - protein, 9 aa, Homo Sapiens
HIIEDPCTL

SEQ ID NO: 139845 - protein, 9 aa, Homo Sapiens
HLDEAIHVL

SEQ ID NO: 139846 - protein, 9 aa, Homo Sapiens
HSALPNQSL

SEQ ID NO: 139847 - protein, 9 aa, Homo Sapiens
HSDEYIKFL

SEQ ID NO: 139848 - protein, 9 aa, Homo Sapiens
HSHLLKTPL

SEQ ID NO: 139849 - protein, 9 aa, Homo Sapiens
HSIGSYFTL

SEQ ID NO: 139850 - protein, 9 aa, Homo Sapiens
HSIIPRGSL

SEQ ID NO: 139851 - protein, 9 aa, Homo Sapiens
HSLLPASNL

SEQ ID NO: 139852 - protein, 9 aa, Homo Sapiens
HTIVPGQVL

SEQ ID NO: 139853 - protein, 9 aa, Homo Sapiens
HTSEHFSFL

SEQ ID NO: 139854 - protein, 9 aa, Homo Sapiens
HVFIGGTPL

SEQ ID NO: 139855 - protein, 9 aa, Homo Sapiens
HVLEPLSSL

SEQ ID NO: 139856 - protein, 9 aa, Homo Sapiens
HVMKAMQSL

SEQ ID NO: 139857 - protein, 9 aa, Homo Sapiens
IAAGIFNDL

SEQ ID NO: 139858 - protein, 9 aa, Homo Sapiens
IAAGLYLLL

SEQ ID NO: 139859 - protein, 9 aa, Homo Sapiens
IAAMPLISL

SEQ ID NO: 139860 - protein, 9 aa, Homo Sapiens
IAAPFTSKL

SEQ ID NO: 139861 - protein, 9 aa, Homo Sapiens
IAAPNMKAM

SEQ ID NO: 139862 - protein, 9 aa, Homo Sapiens
IAAPTSSAL

SEQ ID NO: 139863 - protein, 9 aa, Homo Sapiens
IAAVPATAM

SEQ ID NO: 139864 - protein, 9 aa, Homo Sapiens
IAAVTDIPL

SEQ ID NO: 139865 - protein, 9 aa, Homo Sapiens
IADGVFRFL

SEQ ID NO: 139866 - protein, 9 aa, Homo Sapiens
IADLVSKEL

SEQ ID NO: 139867 - protein, 9 aa, Homo Sapiens
IADNVFLFL

SEQ ID NO: 139868 - protein, 9 aa, Homo Sapiens
IADPFFRSA

SEQ ID NO: 139869 - protein, 9 aa, Homo Sapiens
IADPNIAKL

SEQ ID NO: 139870 - protein, 9 aa, Homo Sapiens
IADSGLKIL

SEQ ID NO: 139871 - protein, 9 aa, Homo Sapiens
IAEMVRHAL

SEQ ID NO: 139872 - protein, 9 aa, Homo Sapiens
IAFPKAEEL

SEQ ID NO: 139873 - protein, 9 aa, Homo Sapiens
IAFPTSISV

SEQ ID NO: 139874 - protein, 9 aa, Homo Sapiens
IAFQYSTVL

SEQ ID NO: 139875 - protein, 9 aa, Homo Sapiens
IAIAPNGAL

SEQ ID NO: 139876 - protein, 9 aa, Homo Sapiens
IAIDGGKVL

SEQ ID NO: 139877 - protein, 9 aa, Homo Sapiens
IAIEALTQL

SEQ ID NO: 139878 - protein, 9 aa, Homo Sapiens
IAIEIYLKL

SEQ ID NO: 139879 - protein, 9 aa, Homo Sapiens
IAIGSQPVL

SEQ ID NO: 139880 - protein, 9 aa, Homo Sapiens
IAIIPSKKL

SEQ ID NO: 139881 - protein, 9 aa, Homo Sapiens
IAIKFGSAL

SEQ ID NO: 139882 - protein, 9 aa, Homo Sapiens
IAIKYSRTL

SEQ ID NO: 139883 - protein, 9 aa, Homo Sapiens
IAINISRNL

SEQ ID NO: 139884 - protein, 9 aa, Homo Sapiens
IAIPFGTAL

SEQ ID NO: 139885 - protein, 9 aa, Homo Sapiens
IAIPFLIKL

SEQ ID NO: 139886 - protein, 9 aa, Homo Sapiens
IAIPVTQEL

SEQ ID NO: 139887 - protein, 9 aa, Homo Sapiens
IAIPVTVAF

SEQ ID NO: 139888 - protein, 9 aa, Homo Sapiens
IAISRMKFL

SEQ ID NO: 139889 - protein, 9 aa, Homo Sapiens
IAISRTPVL

SEQ ID NO: 139890 - protein, 9 aa, Homo Sapiens
IALGEFSTL

SEQ ID NO: 139891 - protein, 9 aa, Homo Sapiens
IALGLCNSI

SEQ ID NO: 139892 - protein, 9 aa, Homo Sapiens
IAMGMAQAL

SEQ ID NO: 139893 - protein, 9 aa, Homo Sapiens
IANAVVKEL

SEQ ID NO: 139894 - protein, 9 aa, Homo Sapiens
IAQDFKTDL

SEQ ID NO: 139895 - protein, 9 aa, Homo Sapiens
IAQGSYIAL

SEQ ID NO: 139896 - protein, 9 aa, Homo Sapiens
IAQPVRSFL

SEQ ID NO: 139897 - protein, 9 aa, Homo Sapiens
IASAIVNEL

SEQ ID NO: 139898 - protein, 9 aa, Homo Sapiens
IASIHSFEL

SEQ ID NO: 139899 - protein, 9 aa, Homo Sapiens
IASPPSLIL

SEQ ID NO: 139900 - protein, 9 aa, Homo Sapiens
IASPVIAAV

SEQ ID NO: 139901 - protein, 9 aa, Homo Sapiens
IASPVQPVL

SEQ ID NO: 139902 - protein, 9 aa, Homo Sapiens
IATEIILEI

SEQ ID NO: 139903 - protein, 9 aa, Homo Sapiens
IATLAITTL

SEQ ID NO: 139904 - protein, 9 aa, Homo Sapiens
IAVAITEAL

SEQ ID NO: 139905 - protein, 9 aa, Homo Sapiens
IAVANAQEL

SEQ ID NO: 139906 - protein, 9 aa, Homo Sapiens
IAVEPGNQW

SEQ ID NO: 139907 - protein, 9 aa, Homo Sapiens
IAVGVGAQL

SEQ ID NO: 139908 - protein, 9 aa, Homo Sapiens
IAVPDPSVL

SEQ ID NO: 139909 - protein, 9 aa, Homo Sapiens
IAVPEARFL

SEQ ID NO: 139910 - protein, 9 aa, Homo Sapiens
IAWPPPTEL

SEQ ID NO: 139911 - protein, 9 aa, Homo Sapiens
IAYDVTYSL

SEQ ID NO: 139912 - protein, 9 aa, Homo Sapiens
IAYIRDLAL

SEQ ID NO: 139913 - protein, 9 aa, Homo Sapiens
IAYPKAVTM

SEQ ID NO: 139914 - protein, 9 aa, Homo Sapiens
IGIDHIKEL

SEQ ID NO: 139915 - protein, 9 aa, Homo Sapiens
IGNPHHVSL

SEQ ID NO: 139916 - protein, 9 aa, Homo Sapiens
IGYSSPLTL

SEQ ID NO: 139917 - protein, 9 aa, Homo Sapiens
IIEPSLRQL

SEQ ID NO: 139918 - protein, 9 aa, Homo Sapiens
IIINPSSSL

SEQ ID NO: 139919 - protein, 9 aa, Homo Sapiens
IIIPNPAAL

SEQ ID NO: 139920 - protein, 9 aa, Homo Sapiens
IIITPTREL

SEQ ID NO: 139921 - protein, 9 aa, Homo Sapiens
IITPAFAEL

SEQ ID NO: 139922 - protein, 9 aa, Homo Sapiens
IITTVGPEL

SEQ ID NO: 139923 - protein, 9 aa, Homo Sapiens
IIVDPAREL

SEQ ID NO: 139924 - protein, 9 aa, Homo Sapiens
IIVGNPKAL

SEQ ID NO: 139925 - protein, 9 aa, Homo Sapiens
IIYTAKISL

SEQ ID NO: 139926 - protein, 9 aa, Homo Sapiens
IPVTELRYF

SEQ ID NO: 139927 - protein, 9 aa, Homo Sapiens
ISAETFTAL

SEQ ID NO: 139928 - protein, 9 aa, Homo Sapiens
ISDNAAKIL

SEQ ID NO: 139929 - protein, 9 aa, Homo Sapiens
ISEENFRVM

SEQ ID NO: 139930 - protein, 9 aa, Homo Sapiens
ISGGKPLEV

SEQ ID NO: 139931 - protein, 9 aa, Homo Sapiens
ISIDRFLAV

SEQ ID NO: 139932 - protein, 9 aa, Homo Sapiens
ISIHVGQAG

SEQ ID NO: 139933 - protein, 9 aa, Homo Sapiens
ISILQQIEL

SEQ ID NO: 139934 - protein, 9 aa, Homo Sapiens
ISMIPAKCL

SEQ ID NO: 139935 - protein, 9 aa, Homo Sapiens
ISNPNSIIL

SEQ ID NO: 139936 - protein, 9 aa, Homo Sapiens
ISSPVVTSL

SEQ ID NO: 139937 - protein, 9 aa, Homo Sapiens
ISTEVNPKL

SEQ ID NO: 139938 - protein, 9 aa, Homo Sapiens
ISTNSHPIL

SEQ ID NO: 139939 - protein, 9 aa, Homo Sapiens
ISVASFQEL

SEQ ID NO: 139940 - protein, 9 aa, Homo Sapiens
ISVQPSSSL

SEQ ID NO: 139941 - protein, 9 aa, Homo Sapiens
ITAPPGTAA

SEQ ID NO: 139942 - protein, 9 aa, Homo Sapiens
ITAPPSRVL

SEQ ID NO: 139943 - protein, 9 aa, Homo Sapiens
ITDPQQLQL

SEQ ID NO: 139944 - protein, 9 aa, Homo Sapiens
ITIKPVLSL

SEQ ID NO: 139945 - protein, 9 aa, Homo Sapiens
ITISPLQEL

SEQ ID NO: 139946 - protein, 9 aa, Homo Sapiens
ITLHVFWEL

SEQ ID NO: 139947 - protein, 9 aa, Homo Sapiens
ITSDPGLSL

SEQ ID NO: 139948 - protein, 9 aa, Homo Sapiens
IVAEPGAVL

SEQ ID NO: 139949 - protein, 9 aa, Homo Sapiens
IVIDGSGAL

SEQ ID NO: 139950 - protein, 9 aa, Homo Sapiens
IVIDPKNPL

SEQ ID NO: 139951 - protein, 9 aa, Homo Sapiens
IVMEHVVFL

SEQ ID NO: 139952 - protein, 9 aa, Homo Sapiens
IVMPNILVL

SEQ ID NO: 139953 - protein, 9 aa, Homo Sapiens
IVNGHTLLV

SEQ ID NO: 139954 - protein, 9 aa, Homo Sapiens
IVVAPSQTL

SEQ ID NO: 139955 - protein, 9 aa, Homo Sapiens
IVYGSFRSL

SEQ ID NO: 139956 - protein, 9 aa, Homo Sapiens
KAAHFFSTL

SEQ ID NO: 139957 - protein, 9 aa, Homo Sapiens
KAASVRPVL

SEQ ID NO: 139958 - protein, 9 aa, Homo Sapiens
KACDYIQEL

SEQ ID NO: 139959 - protein, 9 aa, Homo Sapiens
KADMNVHLL

SEQ ID NO: 139960 - protein, 9 aa, Homo Sapiens
KAFNWFSTL

SEQ ID NO: 139961 - protein, 9 aa, Homo Sapiens
KAIDFAASL

SEQ ID NO: 139962 - protein, 9 aa, Homo Sapiens
KAIDLMNAL

SEQ ID NO: 139963 - protein, 9 aa, Homo Sapiens
KAIEVLLTL

SEQ ID NO: 139964 - protein, 9 aa, Homo Sapiens
KAIGLFISF

SEQ ID NO: 139965 - protein, 9 aa, Homo Sapiens
KAIRPYHAL

SEQ ID NO: 139966 - protein, 9 aa, Homo Sapiens
KAISRWSSL

SEQ ID NO: 139967 - protein, 9 aa, Homo Sapiens
KALSIFNEL

SEQ ID NO: 139968 - protein, 9 aa, Homo Sapiens
KAMELIREL

SEQ ID NO: 139969 - protein, 9 aa, Homo Sapiens
KAMEYMFGW

SEQ ID NO: 139970 - protein, 9 aa, Homo Sapiens
KAMLRSLPI

SEQ ID NO: 139971 - protein, 9 aa, Homo Sapiens
KANPALYVL

SEQ ID NO: 139972 - protein, 9 aa, Homo Sapiens
KATPQVPVL

SEQ ID NO: 139973 - protein, 9 aa, Homo Sapiens
KAVPQSLEL

SEQ ID NO: 139974 - protein, 9 aa, Homo Sapiens
KAYERGISL

SEQ ID NO: 139975 - protein, 9 aa, Homo Sapiens
KINEAFIEM

SEQ ID NO: 139976 - protein, 9 aa, Homo Sapiens
KITEDFRAL

SEQ ID NO: 139977 - protein, 9 aa, Homo Sapiens
KSIPSFSSL

SEQ ID NO: 139978 - protein, 9 aa, Homo Sapiens
LAAARLAAA

SEQ ID NO: 139979 - protein, 9 aa, Homo Sapiens
LAADCAHEL

SEQ ID NO: 139980 - protein, 9 aa, Homo Sapiens
LAAFPTTCL

SEQ ID NO: 139981 - protein, 9 aa, Homo Sapiens
LAAGHLVQL

SEQ ID NO: 139982 - protein, 9 aa, Homo Sapiens
LAAGPVGSL

SEQ ID NO: 139983 - protein, 9 aa, Homo Sapiens
LAAGVVSAM

SEQ ID NO: 139984 - protein, 9 aa, Homo Sapiens
LAAHLGSAL

SEQ ID NO: 139985 - protein, 9 aa, Homo Sapiens
LAAPIMLDL

SEQ ID NO: 139986 - protein, 9 aa, Homo Sapiens
LAAPSNLSM

SEQ ID NO: 139987 - protein, 9 aa, Homo Sapiens
LAAPSPAAL

SEQ ID NO: 139988 - protein, 9 aa, Homo Sapiens
LAAPVISVL

SEQ ID NO: 139989 - protein, 9 aa, Homo Sapiens
LAARASLDL

SEQ ID NO: 139990 - protein, 9 aa, Homo Sapiens
LAASVFTCL

SEQ ID NO: 139991 - protein, 9 aa, Homo Sapiens
LAATFIRSL

SEQ ID NO: 139992 - protein, 9 aa, Homo Sapiens
LAAVAHSPL

SEQ ID NO: 139993 - protein, 9 aa, Homo Sapiens
LACGKARVL

SEQ ID NO: 139994 - protein, 9 aa, Homo Sapiens
LACGVAKVL

SEQ ID NO: 139995 - protein, 9 aa, Homo Sapiens
LACGYLRNL

SEQ ID NO: 139996 - protein, 9 aa, Homo Sapiens
LACLHIATL

SEQ ID NO: 139997 - protein, 9 aa, Homo Sapiens
LACPLLRQL

SEQ ID NO: 139998 - protein, 9 aa, Homo Sapiens
LADDSVRSL

SEQ ID NO: 139999 - protein, 9 aa, Homo Sapiens
LADHTVHVL

SEQ ID NO: 140000 - protein, 9 aa, Homo Sapiens
LADPVFRTL

SEQ ID NO: 140001 - protein, 9 aa, Homo Sapiens
LADQKVHML

SEQ ID NO: 140002 - protein, 9 aa, Homo Sapiens
LADTTFRTI

SEQ ID NO: 140003 - protein, 9 aa, Homo Sapiens
LADVKVHIL

SEQ ID NO: 140004 - protein, 9 aa, Homo Sapiens
LAEAGVRLL

SEQ ID NO: 140005 - protein, 9 aa, Homo Sapiens
LAFEGPILL

SEQ ID NO: 140006 - protein, 9 aa, Homo Sapiens
LAFGSGMGL

SEQ ID NO: 140007 - protein, 9 aa, Homo Sapiens
LAFLGSQSL

SEQ ID NO: 140008 - protein, 9 aa, Homo Sapiens
LAFPGEMLL

SEQ ID NO: 140009 - protein, 9 aa, Homo Sapiens
LAFPSPEKL

SEQ ID NO: 140010 - protein, 9 aa, Homo Sapiens
LAFPTGCSL

SEQ ID NO: 140011 - protein, 9 aa, Homo Sapiens
LAFSRALEL

SEQ ID NO: 140012 - protein, 9 aa, Homo Sapiens
LAFTKSISL

SEQ ID NO: 140013 - protein, 9 aa, Homo Sapiens
LAGPDHLSL

SEQ ID NO: 140014 - protein, 9 aa, Homo Sapiens
LAGPPGPEL

SEQ ID NO: 140015 - protein, 9 aa, Homo Sapiens
LAHPNIIAL

SEQ ID NO: 140016 - protein, 9 aa, Homo Sapiens
LAHPYFESL

SEQ ID NO: 140017 - protein, 9 aa, Homo Sapiens
LAHVVITQL

SEQ ID NO: 140018 - protein, 9 aa, Homo Sapiens
LAIASGIYL

SEQ ID NO: 140019 - protein, 9 aa, Homo Sapiens
LAIDAIHQL

SEQ ID NO: 140020 - protein, 9 aa, Homo Sapiens
LAIESANEL

SEQ ID NO: 140021 - protein, 9 aa, Homo Sapiens
LAIFVICQL

SEQ ID NO: 140022 - protein, 9 aa, Homo Sapiens
LAIGPCKSL

SEQ ID NO: 140023 - protein, 9 aa, Homo Sapiens
LAIGSAATL

SEQ ID NO: 140024 - protein, 9 aa, Homo Sapiens
LAIHGMETL

SEQ ID NO: 140025 - protein, 9 aa, Homo Sapiens
LAIIPHVTI

SEQ ID NO: 140026 - protein, 9 aa, Homo Sapiens
LAIKPGTSV

SEQ ID NO: 140027 - protein, 9 aa, Homo Sapiens
LAIPFAITI

SEQ ID NO: 140028 - protein, 9 aa, Homo Sapiens
LAIPVFLTL

SEQ ID NO: 140029 - protein, 9 aa, Homo Sapiens
LAIQIYQQL

SEQ ID NO: 140030 - protein, 9 aa, Homo Sapiens
LAITGGVTL

SEQ ID NO: 140031 - protein, 9 aa, Homo Sapiens
LAITTEHTL

SEQ ID NO: 140032 - protein, 9 aa, Homo Sapiens
LAIVPVNTL

SEQ ID NO: 140033 - protein, 9 aa, Homo Sapiens
LALAIAQEL

SEQ ID NO: 140034 - protein, 9 aa, Homo Sapiens
LALDHLHSL

SEQ ID NO: 140035 - protein, 9 aa, Homo Sapiens
LALELHQEL

SEQ ID NO: 140036 - protein, 9 aa, Homo Sapiens
LALETTNSL

SEQ ID NO: 140037 - protein, 9 aa, Homo Sapiens
LALFLKLHL

SEQ ID NO: 140038 - protein, 9 aa, Homo Sapiens
LALFPGVAL

SEQ ID NO: 140039 - protein, 9 aa, Homo Sapiens
LALIIMKIL

SEQ ID NO: 140040 - protein, 9 aa, Homo Sapiens
LALTRSSSL

SEQ ID NO: 140041 - protein, 9 aa, Homo Sapiens
LAMEPTPEL

SEQ ID NO: 140042 - protein, 9 aa, Homo Sapiens
LAMLRSLDL

SEQ ID NO: 140043 - protein, 9 aa, Homo Sapiens
LAMPGETVL

SEQ ID NO: 140044 - protein, 9 aa, Homo Sapiens
LAMRPLASL

SEQ ID NO: 140045 - protein, 9 aa, Homo Sapiens
LANALTSAL

SEQ ID NO: 140046 - protein, 9 aa, Homo Sapiens
LANEHNVAL

SEQ ID NO: 140047 - protein, 9 aa, Homo Sapiens
LANEPSVAL

SEQ ID NO: 140048 - protein, 9 aa, Homo Sapiens
LANERLMTL

SEQ ID NO: 140049 - protein, 9 aa, Homo Sapiens
LANGQTKVL

SEQ ID NO: 140050 - protein, 9 aa, Homo Sapiens
LANLHITAL

SEQ ID NO: 140051 - protein, 9 aa, Homo Sapiens
LANPHELSL

SEQ ID NO: 140052 - protein, 9 aa, Homo Sapiens
LANPTTSAL

SEQ ID NO: 140053 - protein, 9 aa, Homo Sapiens
LAQDIFKEL

SEQ ID NO: 140054 - protein, 9 aa, Homo Sapiens
LAQGDMKQL

SEQ ID NO: 140055 - protein, 9 aa, Homo Sapiens
LAQHTMLTL

SEQ ID NO: 140056 - protein, 9 aa, Homo Sapiens
LAQPQMMVV

SEQ ID NO: 140057 - protein, 9 aa, Homo Sapiens
LAQQAILSL

SEQ ID NO: 140058 - protein, 9 aa, Homo Sapiens
LAQVSGLEM

SEQ ID NO: 140059 - protein, 9 aa, Homo Sapiens
LARPASAAL

SEQ ID NO: 140060 - protein, 9 aa, Homo Sapiens
LASAVISVL

SEQ ID NO: 140061 - protein, 9 aa, Homo Sapiens
LASHILTAL

SEQ ID NO: 140062 - protein, 9 aa, Homo Sapiens
LASPESLEL

SEQ ID NO: 140063 - protein, 9 aa, Homo Sapiens
LASPPWRVL

SEQ ID NO: 140064 - protein, 9 aa, Homo Sapiens
LASPSTSIL

SEQ ID NO: 140065 - protein, 9 aa, Homo Sapiens
LASPVFARL

SEQ ID NO: 140066 - protein, 9 aa, Homo Sapiens
LASPVSPEL

SEQ ID NO: 140067 - protein, 9 aa, Homo Sapiens
LATAAALTY

SEQ ID NO: 140068 - protein, 9 aa, Homo Sapiens
LATASSPKF

SEQ ID NO: 140069 - protein, 9 aa, Homo Sapiens
LATDFIQSL

SEQ ID NO: 140070 - protein, 9 aa, Homo Sapiens
LATGAAMVL

SEQ ID NO: 140071 - protein, 9 aa, Homo Sapiens
LATGHFMSV

SEQ ID NO: 140072 - protein, 9 aa, Homo Sapiens
LATHPGISF

SEQ ID NO: 140073 - protein, 9 aa, Homo Sapiens
LATIHLPYL

SEQ ID NO: 140074 - protein, 9 aa, Homo Sapiens
LATLIHQVL

SEQ ID NO: 140075 - protein, 9 aa, Homo Sapiens
LATPVDLKL

SEQ ID NO: 140076 - protein, 9 aa, Homo Sapiens
LATRAIPEL

SEQ ID NO: 140077 - protein, 9 aa, Homo Sapiens
LATRSFPQL

SEQ ID NO: 140078 - protein, 9 aa, Homo Sapiens
LATSHMLEL

SEQ ID NO: 140079 - protein, 9 aa, Homo Sapiens
LATTVRPVF

SEQ ID NO: 140080 - protein, 9 aa, Homo Sapiens
LATYGSIAL

SEQ ID NO: 140081 - protein, 9 aa, Homo Sapiens
LAVAGATSL

SEQ ID NO: 140082 - protein, 9 aa, Homo Sapiens
LAVDKSASL

SEQ ID NO: 140083 - protein, 9 aa, Homo Sapiens
LAVEAVLRL

SEQ ID NO: 140084 - protein, 9 aa, Homo Sapiens
LAVEKAAEL

SEQ ID NO: 140085 - protein, 9 aa, Homo Sapiens
LAVEPGSNL

SEQ ID NO: 140086 - protein, 9 aa, Homo Sapiens
LAVGLTSCF

SEQ ID NO: 140087 - protein, 9 aa, Homo Sapiens
LAVHIAHSL

SEQ ID NO: 140088 - protein, 9 aa, Homo Sapiens
LAVPDMSSL

SEQ ID NO: 140089 - protein, 9 aa, Homo Sapiens
LAVPIFVAL

SEQ ID NO: 140090 - protein, 9 aa, Homo Sapiens
LAVTDTGAL

SEQ ID NO: 140091 - protein, 9 aa, Homo Sapiens
LAVVVTKEM

SEQ ID NO: 140092 - protein, 9 aa, Homo Sapiens
LAYEPFSTL

SEQ ID NO: 140093 - protein, 9 aa, Homo Sapiens
LAYHLAVVL

SEQ ID NO: 140094 - protein, 9 aa, Homo Sapiens
LAYIAHPKL

SEQ ID NO: 140095 - protein, 9 aa, Homo Sapiens
LAYLQRIAL

SEQ ID NO: 140096 - protein, 9 aa, Homo Sapiens
LAYMNHIMV

SEQ ID NO: 140097 - protein, 9 aa, Homo Sapiens
LAYPFQSLL

SEQ ID NO: 140098 - protein, 9 aa, Homo Sapiens
LAYPGSATI

SEQ ID NO: 140099 - protein, 9 aa, Homo Sapiens
LDNISFPKQ

SEQ ID NO: 140100 - protein, 9 aa, Homo Sapiens
LFMPRSTEF

SEQ ID NO: 140101 - protein, 9 aa, Homo Sapiens
LFVGKHHPL

SEQ ID NO: 140102 - protein, 9 aa, Homo Sapiens
LGAPPGPQL

SEQ ID NO: 140103 - protein, 9 aa, Homo Sapiens
LGIAGITGA

SEQ ID NO: 140104 - protein, 9 aa, Homo Sapiens
LGIPHSFAL

SEQ ID NO: 140105 - protein, 9 aa, Homo Sapiens
LGIPIITVL

SEQ ID NO: 140106 - protein, 9 aa, Homo Sapiens
LIAYMLLTI

SEQ ID NO: 140107 - protein, 9 aa, Homo Sapiens
LIDVARTSL

SEQ ID NO: 140108 - protein, 9 aa, Homo Sapiens
LIICPLSVL

SEQ ID NO: 140109 - protein, 9 aa, Homo Sapiens
LIISPTREL

SEQ ID NO: 140110 - protein, 9 aa, Homo Sapiens
LIIVPLSTL

SEQ ID NO: 140111 - protein, 9 aa, Homo Sapiens
LIMDAYNSL

SEQ ID NO: 140112 - protein, 9 aa, Homo Sapiens
LINANMMVL

SEQ ID NO: 140113 - protein, 9 aa, Homo Sapiens
LIQKPSHPL

SEQ ID NO: 140114 - protein, 9 aa, Homo Sapiens
LIVDLCADK

SEQ ID NO: 140115 - protein, 9 aa, Homo Sapiens
LIVEPSREL

SEQ ID NO: 140116 - protein, 9 aa, Homo Sapiens
LIYDGKVEM

SEQ ID NO: 140117 - protein, 9 aa, Homo Sapiens
LIYGTPRAA

SEQ ID NO: 140118 - protein, 9 aa, Homo Sapiens
LLAALWMIL

SEQ ID NO: 140119 - protein, 9 aa, Homo Sapiens
LLAMPVMVL

SEQ ID NO: 140120 - protein, 9 aa, Homo Sapiens
LLAQPGEAL

SEQ ID NO: 140121 - protein, 9 aa, Homo Sapiens
LLETGHRAL

SEQ ID NO: 140122 - protein, 9 aa, Homo Sapiens
LLFMLVLTV

SEQ ID NO: 140123 - protein, 9 aa, Homo Sapiens
LLLPAGIAL

SEQ ID NO: 140124 - protein, 9 aa, Homo Sapiens
LLPPPMKEL

SEQ ID NO: 140125 - protein, 9 aa, Homo Sapiens
LMMDPLTGL

SEQ ID NO: 140126 - protein, 9 aa, Homo Sapiens
LQSVQVFGR

SEQ ID NO: 140127 - protein, 9 aa, Homo Sapiens
LSAPIHTQM

SEQ ID NO: 140128 - protein, 9 aa, Homo Sapiens
LSAPSLHAL

SEQ ID NO: 140129 - protein, 9 aa, Homo Sapiens
LSDLHAHKL

SEQ ID NO: 140130 - protein, 9 aa, Homo Sapiens
LSDPFYRTL

SEQ ID NO: 140131 - protein, 9 aa, Homo Sapiens
LSDPQVHTV

SEQ ID NO: 140132 - protein, 9 aa, Homo Sapiens
LSDPTYREL

SEQ ID NO: 140133 - protein, 9 aa, Homo Sapiens
LSEENFKVL

SEQ ID NO: 140134 - protein, 9 aa, Homo Sapiens
LSEPMVHEL

SEQ ID NO: 140135 - protein, 9 aa, Homo Sapiens
LSFTHPTSF

SEQ ID NO: 140136 - protein, 9 aa, Homo Sapiens
LSHSLLVTL

SEQ ID NO: 140137 - protein, 9 aa, Homo Sapiens
LSIDLFHVL

SEQ ID NO: 140138 - protein, 9 aa, Homo Sapiens
LSIPSFQAL

SEQ ID NO: 140139 - protein, 9 aa, Homo Sapiens
LSIRHLMEL

SEQ ID NO: 140140 - protein, 9 aa, Homo Sapiens
LSISPRLTL

SEQ ID NO: 140141 - protein, 9 aa, Homo Sapiens
LSKGPGLEV

SEQ ID NO: 140142 - protein, 9 aa, Homo Sapiens
LSMVPITSL

SEQ ID NO: 140143 - protein, 9 aa, Homo Sapiens
LSNHVFNAL

SEQ ID NO: 140144 - protein, 9 aa, Homo Sapiens
LSQEDVKTL

SEQ ID NO: 140145 - protein, 9 aa, Homo Sapiens
LSQPTPATL

SEQ ID NO: 140146 - protein, 9 aa, Homo Sapiens
LSQQPFLSL

SEQ ID NO: 140147 - protein, 9 aa, Homo Sapiens
LSQVPMSAL

SEQ ID NO: 140148 - protein, 9 aa, Homo Sapiens
LSSSVIREL

SEQ ID NO: 140149 - protein, 9 aa, Homo Sapiens
LSTLPTSTL

SEQ ID NO: 140150 - protein, 9 aa, Homo Sapiens
LSTPFGQAL

SEQ ID NO: 140151 - protein, 9 aa, Homo Sapiens
LSTTVQPNL

SEQ ID NO: 140152 - protein, 9 aa, Homo Sapiens
LSVAPQQSL

SEQ ID NO: 140153 - protein, 9 aa, Homo Sapiens
LSVEIVHEL

SEQ ID NO: 140154 - protein, 9 aa, Homo Sapiens
LSYGPGPSL

SEQ ID NO: 140155 - protein, 9 aa, Homo Sapiens
LTDGHPLTL

SEQ ID NO: 140156 - protein, 9 aa, Homo Sapiens
LTDPDIHVL

SEQ ID NO: 140157 - protein, 9 aa, Homo Sapiens
LTHGINFAV

SEQ ID NO: 140158 - protein, 9 aa, Homo Sapiens
LTHTAVVPL

SEQ ID NO: 140159 - protein, 9 aa, Homo Sapiens
LTMAPGSTL

SEQ ID NO: 140160 - protein, 9 aa, Homo Sapiens
LTTASLPLL

SEQ ID NO: 140161 - protein, 9 aa, Homo Sapiens
LTTEVHPEL

SEQ ID NO: 140162 - protein, 9 aa, Homo Sapiens
LTVDPQGAL

SEQ ID NO: 140163 - protein, 9 aa, Homo Sapiens
LTVEPGASL

SEQ ID NO: 140164 - protein, 9 aa, Homo Sapiens
LTYMPSVSL

SEQ ID NO: 140165 - protein, 9 aa, Homo Sapiens
LVFPGFFEL

SEQ ID NO: 140166 - protein, 9 aa, Homo Sapiens
LVIGRVLEL

SEQ ID NO: 140167 - protein, 9 aa, Homo Sapiens
LVITASQSL

SEQ ID NO: 140168 - protein, 9 aa, Homo Sapiens
LVLAPTREL

SEQ ID NO: 140169 - protein, 9 aa, Homo Sapiens
LVLTPTREL

SEQ ID NO: 140170 - protein, 9 aa, Homo Sapiens
LVNGKSLEL

SEQ ID NO: 140171 - protein, 9 aa, Homo Sapiens
LVTDIQPVL

SEQ ID NO: 140172 - protein, 9 aa, Homo Sapiens
LVVYPWTQR

SEQ ID NO: 140173 - protein, 9 aa, Homo Sapiens
LYDASFETK

SEQ ID NO: 140174 - protein, 9 aa, Homo Sapiens
LYDATYETK

SEQ ID NO: 140175 - protein, 9 aa, Homo Sapiens
MAAMVLTSL

SEQ ID NO: 140176 - protein, 9 aa, Homo Sapiens
MAANVIPVL

SEQ ID NO: 140177 - protein, 9 aa, Homo Sapiens
MAAPLVLVL

SEQ ID NO: 140178 - protein, 9 aa, Homo Sapiens
MAARVGAFL

SEQ ID NO: 140179 - protein, 9 aa, Homo Sapiens
MADPNIRFL

SEQ ID NO: 140180 - protein, 9 aa, Homo Sapiens
MAFDPTSTL

SEQ ID NO: 140181 - protein, 9 aa, Homo Sapiens
MAIHAAAVL

SEQ ID NO: 140182 - protein, 9 aa, Homo Sapiens
MAISKPRNL

SEQ ID NO: 140183 - protein, 9 aa, Homo Sapiens
MAIVGGMAL

SEQ ID NO: 140184 - protein, 9 aa, Homo Sapiens
MAKRFAYPL

SEQ ID NO: 140185 - protein, 9 aa, Homo Sapiens
MALGHVIVL

SEQ ID NO: 140186 - protein, 9 aa, Homo Sapiens
MALPPCHAL

SEQ ID NO: 140187 - protein, 9 aa, Homo Sapiens
MAMAYGSSL

SEQ ID NO: 140188 - protein, 9 aa, Homo Sapiens
MANGAVIHL

SEQ ID NO: 140189 - protein, 9 aa, Homo Sapiens
MANPQMQQL

SEQ ID NO: 140190 - protein, 9 aa, Homo Sapiens
MANPTALLL

SEQ ID NO: 140191 - protein, 9 aa, Homo Sapiens
MAPLKMLAL

SEQ ID NO: 140192 - protein, 9 aa, Homo Sapiens
MASPMSIPT

SEQ ID NO: 140193 - protein, 9 aa, Homo Sapiens
MATAEAQSL

SEQ ID NO: 140194 - protein, 9 aa, Homo Sapiens
MATESILHF

SEQ ID NO: 140195 - protein, 9 aa, Homo Sapiens
MAVAFVLSL

SEQ ID NO: 140196 - protein, 9 aa, Homo Sapiens
MAVGGGLAV

SEQ ID NO: 140197 - protein, 9 aa, Homo Sapiens
MAYFPAISL

SEQ ID NO: 140198 - protein, 9 aa, Homo Sapiens
MAYPSLVAM

SEQ ID NO: 140199 - protein, 9 aa, Homo Sapiens
MIIENFEAL

SEQ ID NO: 140200 - protein, 9 aa, Homo Sapiens
MSDTTFKAL

SEQ ID NO: 140201 - protein, 9 aa, Homo Sapiens
MSLPSGSSL

SEQ ID NO: 140202 - protein, 9 aa, Homo Sapiens
MSMDASPEL

SEQ ID NO: 140203 - protein, 9 aa, Homo Sapiens
MSSPLSKEL

SEQ ID NO: 140204 - protein, 9 aa, Homo Sapiens
MSVEVRQTL

SEQ ID NO: 140205 - protein, 9 aa, Homo Sapiens
MSVHLSPCF

SEQ ID NO: 140206 - protein, 9 aa, Homo Sapiens
MSVQPTVSL

SEQ ID NO: 140207 - protein, 9 aa, Homo Sapiens
MTIEPFISL

SEQ ID NO: 140208 - protein, 9 aa, Homo Sapiens
MTTAFIHAL

SEQ ID NO: 140209 - protein, 9 aa, Homo Sapiens
MVIVPTREL

SEQ ID NO: 140210 - protein, 9 aa, Homo Sapiens
MVMEKPSPL

SEQ ID NO: 140211 - protein, 9 aa, Homo Sapiens
MVNPVIYAL

SEQ ID NO: 140212 - protein, 9 aa, Homo Sapiens
MVVGTGTSL

SEQ ID NO: 140213 - protein, 9 aa, Homo Sapiens
NAATSFQVL

SEQ ID NO: 140214 - protein, 9 aa, Homo Sapiens
NADPIAKYL

SEQ ID NO: 140215 - protein, 9 aa, Homo Sapiens
NADPNMKLF

SEQ ID NO: 140216 - protein, 9 aa, Homo Sapiens
NAFSGVMML

SEQ ID NO: 140217 - protein, 9 aa, Homo Sapiens
NAIEGGTQL

SEQ ID NO: 140218 - protein, 9 aa, Homo Sapiens
NAINITSAL

SEQ ID NO: 140219 - protein, 9 aa, Homo Sapiens
NAIREVLEL

SEQ ID NO: 140220 - protein, 9 aa, Homo Sapiens
NAISIHHAL

SEQ ID NO: 140221 - protein, 9 aa, Homo Sapiens
NALFHASTL

SEQ ID NO: 140222 - protein, 9 aa, Homo Sapiens
NAMECALHL

SEQ ID NO: 140223 - protein, 9 aa, Homo Sapiens
NASPVISSV

SEQ ID NO: 140224 - protein, 9 aa, Homo Sapiens
NAVPLFLRL

SEQ ID NO: 140225 - protein, 9 aa, Homo Sapiens
NAVWALSNL

SEQ ID NO: 140226 - protein, 9 aa, Homo Sapiens
NGIFPGTPL

SEQ ID NO: 140227 - protein, 9 aa, Homo Sapiens
NIYAANPVI

SEQ ID NO: 140228 - protein, 9 aa, Homo Sapiens
NRDVLELIK

SEQ ID NO: 140229 - protein, 9 aa, Homo Sapiens
NSNPVIAEL

SEQ ID NO: 140230 - protein, 9 aa, Homo Sapiens
NTIDPSHPM

SEQ ID NO: 140231 - protein, 9 aa, Homo Sapiens
NVLDHFSEL

SEQ ID NO: 140232 - protein, 9 aa, Homo Sapiens
QAIENAHVL

SEQ ID NO: 140233 - protein, 9 aa, Homo Sapiens
QAIPVTSEL

SEQ ID NO: 140234 - protein, 9 aa, Homo Sapiens
QAIRAGLEL

SEQ ID NO: 140235 - protein, 9 aa, Homo Sapiens
QAISVVGSL

SEQ ID NO: 140236 - protein, 9 aa, Homo Sapiens
QALPWISIL

SEQ ID NO: 140237 - protein, 9 aa, Homo Sapiens
QAMPTLIEL

SEQ ID NO: 140238 - protein, 9 aa, Homo Sapiens
QSISPGSRL

SEQ ID NO: 140239 - protein, 9 aa, Homo Sapiens
QSITPCLAL

SEQ ID NO: 140240 - protein, 9 aa, Homo Sapiens
QTLEDFKEL

SEQ ID NO: 140241 - protein, 9 aa, Homo Sapiens
QTQHPRMPL

SEQ ID NO: 140242 - protein, 9 aa, Homo Sapiens
RAHSEPLAL

SEQ ID NO: 140243 - protein, 9 aa, Homo Sapiens
RAIDFSPYL

SEQ ID NO: 140244 - protein, 9 aa, Homo Sapiens
RAIEIYTDM

SEQ ID NO: 140245 - protein, 9 aa, Homo Sapiens
RAIELATTL

SEQ ID NO: 140246 - protein, 9 aa, Homo Sapiens
RAIQFYLEF

SEQ ID NO: 140247 - protein, 9 aa, Homo Sapiens
RALDHYLTL

SEQ ID NO: 140248 - protein, 9 aa, Homo Sapiens
RALEHFTDL

SEQ ID NO: 140249 - protein, 9 aa, Homo Sapiens
RALNVFYYL

SEQ ID NO: 140250 - protein, 9 aa, Homo Sapiens
RATPHFSGL

SEQ ID NO: 140251 - protein, 9 aa, Homo Sapiens
RAVAPTMSL

SEQ ID NO: 140252 - protein, 9 aa, Homo Sapiens
RAVEVSAEL

SEQ ID NO: 140253 - protein, 9 aa, Homo Sapiens
RAVPVGSGL

SEQ ID NO: 140254 - protein, 9 aa, Homo Sapiens
RAYAKFYTL

SEQ ID NO: 140255 - protein, 9 aa, Homo Sapiens
RGTKVILHL

SEQ ID NO: 140256 - protein, 9 aa, Homo Sapiens
RIPSFVTEL

SEQ ID NO: 140257 - protein, 9 aa, Homo Sapiens
RTIGFFYTL

SEQ ID NO: 140258 - protein, 9 aa, Homo Sapiens
RTMEIFQLL

SEQ ID NO: 140259 - protein, 9 aa, Homo Sapiens
RTVDLFPVL

SEQ ID NO: 140260 - protein, 9 aa, Homo Sapiens
RVIDVGSEW

SEQ ID NO: 140261 - protein, 9 aa, Homo Sapiens
SAACPGLQL

SEQ ID NO: 140262 - protein, 9 aa, Homo Sapiens
SAAENFLVL

SEQ ID NO: 140263 - protein, 9 aa, Homo Sapiens
SAAFPGASL

SEQ ID NO: 140264 - protein, 9 aa, Homo Sapiens
SAAGPGFSL

SEQ ID NO: 140265 - protein, 9 aa, Homo Sapiens
SAAMPGASL

SEQ ID NO: 140266 - protein, 9 aa, Homo Sapiens
SAAMVFSAL

SEQ ID NO: 140267 - protein, 9 aa, Homo Sapiens
SAANIQPIF

SEQ ID NO: 140268 - protein, 9 aa, Homo Sapiens
SAAPEGVPL

SEQ ID NO: 140269 - protein, 9 aa, Homo Sapiens
SAAPPGLEA

SEQ ID NO: 140270 - protein, 9 aa, Homo Sapiens
SAAPRTVAL

SEQ ID NO: 140271 - protein, 9 aa, Homo Sapiens
SAAPTFLLL

SEQ ID NO: 140272 - protein, 9 aa, Homo Sapiens
SAAQPGVAF

SEQ ID NO: 140273 - protein, 9 aa, Homo Sapiens
SAASLYPVL

SEQ ID NO: 140274 - protein, 9 aa, Homo Sapiens
SACDALRTL

SEQ ID NO: 140275 - protein, 9 aa, Homo Sapiens
SADSLEHVL

SEQ ID NO: 140276 - protein, 9 aa, Homo Sapiens
SAFDHFASV

SEQ ID NO: 140277 - protein, 9 aa, Homo Sapiens
SAFDRCATL

SEQ ID NO: 140278 - protein, 9 aa, Homo Sapiens
SAFGYFITA

SEQ ID NO: 140279 - protein, 9 aa, Homo Sapiens
SAFPFPVTV

SEQ ID NO: 140280 - protein, 9 aa, Homo Sapiens
SAFPHLRVL

SEQ ID NO: 140281 - protein, 9 aa, Homo Sapiens
SAHSHFISL

SEQ ID NO: 140282 - protein, 9 aa, Homo Sapiens
SAIAEPSSL

SEQ ID NO: 140283 - protein, 9 aa, Homo Sapiens
SAIASTKVM

SEQ ID NO: 140284 - protein, 9 aa, Homo Sapiens
SAIDRIFTL

SEQ ID NO: 140285 - protein, 9 aa, Homo Sapiens
SAIFNFQSL

SEQ ID NO: 140286 - protein, 9 aa, Homo Sapiens
SAIFPDVAL

SEQ ID NO: 140287 - protein, 9 aa, Homo Sapiens
SAIGLPVCL

SEQ ID NO: 140288 - protein, 9 aa, Homo Sapiens
SAIGPFSGL

SEQ ID NO: 140289 - protein, 9 aa, Homo Sapiens
SAIGRAMEL

SEQ ID NO: 140290 - protein, 9 aa, Homo Sapiens
SAIGYIHSL

SEQ ID NO: 140291 - protein, 9 aa, Homo Sapiens
SAIHVLASL

SEQ ID NO: 140292 - protein, 9 aa, Homo Sapiens
SAIIFETPL

SEQ ID NO: 140293 - protein, 9 aa, Homo Sapiens
SAILRSPAF

SEQ ID NO: 140294 - protein, 9 aa, Homo Sapiens
SAINQVEAL

SEQ ID NO: 140295 - protein, 9 aa, Homo Sapiens
SAIPHPLIM

SEQ ID NO: 140296 - protein, 9 aa, Homo Sapiens
SAIPWGISA

SEQ ID NO: 140297 - protein, 9 aa, Homo Sapiens
SAIYGALTL

SEQ ID NO: 140298 - protein, 9 aa, Homo Sapiens
SALEKFVEL

SEQ ID NO: 140299 - protein, 9 aa, Homo Sapiens
SALEKSLAV

SEQ ID NO: 140300 - protein, 9 aa, Homo Sapiens
SALGKSPWL

SEQ ID NO: 140301 - protein, 9 aa, Homo Sapiens
SALGVGLAL

SEQ ID NO: 140302 - protein, 9 aa, Homo Sapiens
SALHYAVEL

SEQ ID NO: 140303 - protein, 9 aa, Homo Sapiens
SALNVRLFL

SEQ ID NO: 140304 - protein, 9 aa, Homo Sapiens
SAMEVVPAL

SEQ ID NO: 140305 - protein, 9 aa, Homo Sapiens
SAMKAVTEL

SEQ ID NO: 140306 - protein, 9 aa, Homo Sapiens
SAMKHMVIL

SEQ ID NO: 140307 - protein, 9 aa, Homo Sapiens
SANIRLTAM

SEQ ID NO: 140308 - protein, 9 aa, Homo Sapiens
SAQGKPLAL

SEQ ID NO: 140309 - protein, 9 aa, Homo Sapiens
SASPASLLL

SEQ ID NO: 140310 - protein, 9 aa, Homo Sapiens
SASPPGPTL

SEQ ID NO: 140311 - protein, 9 aa, Homo Sapiens
SATELMNIL

SEQ ID NO: 140312 - protein, 9 aa, Homo Sapiens
SATQVYTIL

SEQ ID NO: 140313 - protein, 9 aa, Homo Sapiens
SAVDFIRTL

SEQ ID NO: 140314 - protein, 9 aa, Homo Sapiens
SAVDLPVTL

SEQ ID NO: 140315 - protein, 9 aa, Homo Sapiens
SAVDVHINM

SEQ ID NO: 140316 - protein, 9 aa, Homo Sapiens
SAVEPKTAL

SEQ ID NO: 140317 - protein, 9 aa, Homo Sapiens
SAVGHVFSL

SEQ ID NO: 140318 - protein, 9 aa, Homo Sapiens
SAVGQFVSL

SEQ ID NO: 140319 - protein, 9 aa, Homo Sapiens
SAVHWVATL

SEQ ID NO: 140320 - protein, 9 aa, Homo Sapiens
SAVPCALLL

SEQ ID NO: 140321 - protein, 9 aa, Homo Sapiens
SAVQASLSL

SEQ ID NO: 140322 - protein, 9 aa, Homo Sapiens
SAVSHFFSL

SEQ ID NO: 140323 - protein, 9 aa, Homo Sapiens
SAVSIFHEL

SEQ ID NO: 140324 - protein, 9 aa, Homo Sapiens
SAVSSFVFL

SEQ ID NO: 140325 - protein, 9 aa, Homo Sapiens
SAVWNSPPL

SEQ ID NO: 140326 - protein, 9 aa, Homo Sapiens
SAYAGFLAL

SEQ ID NO: 140327 - protein, 9 aa, Homo Sapiens
SAYPLSVEW

SEQ ID NO: 140328 - protein, 9 aa, Homo Sapiens
SAYQRYYSL

SEQ ID NO: 140329 - protein, 9 aa, Homo Sapiens
SGIERMGPL

SEQ ID NO: 140330 - protein, 9 aa, Homo Sapiens
SIALPSKPA

SEQ ID NO: 140331 - protein, 9 aa, Homo Sapiens
SIIAMGNTL

SEQ ID NO: 140332 - protein, 9 aa, Homo Sapiens
SIIGSARSL

SEQ ID NO: 140333 - protein, 9 aa, Homo Sapiens
SIIPPLFTV

SEQ ID NO: 140334 - protein, 9 aa, Homo Sapiens
SILSHFQSL

SEQ ID NO: 140335 - protein, 9 aa, Homo Sapiens
SILTTHTTL

SEQ ID NO: 140336 - protein, 9 aa, Homo Sapiens
SIQVPGMQM

SEQ ID NO: 140337 - protein, 9 aa, Homo Sapiens
SIVAPGGAL

SEQ ID NO: 140338 - protein, 9 aa, Homo Sapiens
SIVKPYLTL

SEQ ID NO: 140339 - protein, 9 aa, Homo Sapiens
SIYSRFVQL

SEQ ID NO: 140340 - protein, 9 aa, Homo Sapiens
SLIEQTTAL

SEQ ID NO: 140341 - protein, 9 aa, Homo Sapiens
SLVPPGASL

SEQ ID NO: 140342 - protein, 9 aa, Homo Sapiens
SNVYPSKPL

SEQ ID NO: 140343 - protein, 9 aa, Homo Sapiens
SQYPFPVTL

SEQ ID NO: 140344 - protein, 9 aa, Homo Sapiens
SSAPPLSEL

SEQ ID NO: 140345 - protein, 9 aa, Homo Sapiens
SSAVPGTAL

SEQ ID NO: 140346 - protein, 9 aa, Homo Sapiens
SSCPLLRTL

SEQ ID NO: 140347 - protein, 9 aa, Homo Sapiens
SSIDPGLSI

SEQ ID NO: 140348 - protein, 9 aa, Homo Sapiens
SSIEHLTTL

SEQ ID NO: 140349 - protein, 9 aa, Homo Sapiens
SSMLPVMAL

SEQ ID NO: 140350 - protein, 9 aa, Homo Sapiens
SSMYPPHPL

SEQ ID NO: 140351 - protein, 9 aa, Homo Sapiens
SSSPAVLAL

SEQ ID NO: 140352 - protein, 9 aa, Homo Sapiens
SSTTVIPTL

SEQ ID NO: 140353 - protein, 9 aa, Homo Sapiens
STFSPSLAL

SEQ ID NO: 140354 - protein, 9 aa, Homo Sapiens
STLNRFSAL

SEQ ID NO: 140355 - protein, 9 aa, Homo Sapiens
STYHRFLTW

SEQ ID NO: 140356 - protein, 9 aa, Homo Sapiens
SVAKESIPL

SEQ ID NO: 140357 - protein, 9 aa, Homo Sapiens
SVIIPGMTL

SEQ ID NO: 140358 - protein, 9 aa, Homo Sapiens
SVIPPRTEL

SEQ ID NO: 140359 - protein, 9 aa, Homo Sapiens
SVIQHTNSL

SEQ ID NO: 140360 - protein, 9 aa, Homo Sapiens
SVISVVSYL

SEQ ID NO: 140361 - protein, 9 aa, Homo Sapiens
SVLDRPRAL

SEQ ID NO: 140362 - protein, 9 aa, Homo Sapiens
SVNGFISTL

SEQ ID NO: 140363 - protein, 9 aa, Homo Sapiens
SVVAVPLPL

SEQ ID NO: 140364 - protein, 9 aa, Homo Sapiens
SVVDVFAQL

SEQ ID NO: 140365 - protein, 9 aa, Homo Sapiens
SVVFHSTVI

SEQ ID NO: 140366 - protein, 9 aa, Homo Sapiens
TAAADFTAK

SEQ ID NO: 140367 - protein, 9 aa, Homo Sapiens
TAAAVGAVF

SEQ ID NO: 140368 - protein, 9 aa, Homo Sapiens
TAAFPFAAL

SEQ ID NO: 140369 - protein, 9 aa, Homo Sapiens
TAAPPAQPL

SEQ ID NO: 140370 - protein, 9 aa, Homo Sapiens
TAAPTIGVL

SEQ ID NO: 140371 - protein, 9 aa, Homo Sapiens
TAAPVPTTL

SEQ ID NO: 140372 - protein, 9 aa, Homo Sapiens
TAAPVVPEL

SEQ ID NO: 140373 - protein, 9 aa, Homo Sapiens
TAASPTIAL

SEQ ID NO: 140374 - protein, 9 aa, Homo Sapiens
TACAINKVL

SEQ ID NO: 140375 - protein, 9 aa, Homo Sapiens
TADGMVHLL

SEQ ID NO: 140376 - protein, 9 aa, Homo Sapiens
TAFHSSMAL

SEQ ID NO: 140377 - protein, 9 aa, Homo Sapiens
TAFPQRTEL

SEQ ID NO: 140378 - protein, 9 aa, Homo Sapiens
TAIAESPVI

SEQ ID NO: 140379 - protein, 9 aa, Homo Sapiens
TAIDRYLCL

SEQ ID NO: 140380 - protein, 9 aa, Homo Sapiens
TAIDWFHEW

SEQ ID NO: 140381 - protein, 9 aa, Homo Sapiens
TAIESTPTL

SEQ ID NO: 140382 - protein, 9 aa, Homo Sapiens
TAINHFFIW

SEQ ID NO: 140383 - protein, 9 aa, Homo Sapiens
TAIPCLLAL

SEQ ID NO: 140384 - protein, 9 aa, Homo Sapiens
TAIPISMVL

SEQ ID NO: 140385 - protein, 9 aa, Homo Sapiens
TAIPVTQEL

SEQ ID NO: 140386 - protein, 9 aa, Homo Sapiens
TAIRSGLEL

SEQ ID NO: 140387 - protein, 9 aa, Homo Sapiens
TAISLFYEL

SEQ ID NO: 140388 - protein, 9 aa, Homo Sapiens
TAISRYMEL

SEQ ID NO: 140389 - protein, 9 aa, Homo Sapiens
TAISTSPLL

SEQ ID NO: 140390 - protein, 9 aa, Homo Sapiens
TALNLFFKL

SEQ ID NO: 140391 - protein, 9 aa, Homo Sapiens
TALPRIFSL

SEQ ID NO: 140392 - protein, 9 aa, Homo Sapiens
TASPFFRAL

SEQ ID NO: 140393 - protein, 9 aa, Homo Sapiens
TASPVAVSL

SEQ ID NO: 140394 - protein, 9 aa, Homo Sapiens
TASPVIKAV

SEQ ID NO: 140395 - protein, 9 aa, Homo Sapiens
TAVAPNVAL

SEQ ID NO: 140396 - protein, 9 aa, Homo Sapiens
TAVENMPSL

SEQ ID NO: 140397 - protein, 9 aa, Homo Sapiens
TAVMPKVSL

SEQ ID NO: 140398 - protein, 9 aa, Homo Sapiens
TAVPYFSNL

SEQ ID NO: 140399 - protein, 9 aa, Homo Sapiens
TAVVPPMCL

SEQ ID NO: 140400 - protein, 9 aa, Homo Sapiens
TAYDNFVEL

SEQ ID NO: 140401 - protein, 9 aa, Homo Sapiens
TGIPGLEQL

SEQ ID NO: 140402 - protein, 9 aa, Homo Sapiens
TGIQPGTSL

SEQ ID NO: 140403 - protein, 9 aa, Homo Sapiens
TIDPIPHQL

SEQ ID NO: 140404 - protein, 9 aa, Homo Sapiens
TIDPNTRTL

SEQ ID NO: 140405 - protein, 9 aa, Homo Sapiens
TIIDKSKSV

SEQ ID NO: 140406 - protein, 9 aa, Homo Sapiens
TIIEATHVL

SEQ ID NO: 140407 - protein, 9 aa, Homo Sapiens
TIIPKVLAM

SEQ ID NO: 140408 - protein, 9 aa, Homo Sapiens
TIIRQNQAL

SEQ ID NO: 140409 - protein, 9 aa, Homo Sapiens
TIMPRGPTL

SEQ ID NO: 140410 - protein, 9 aa, Homo Sapiens
TITDIISAL

SEQ ID NO: 140411 - protein, 9 aa, Homo Sapiens
TIVDTGIGM

SEQ ID NO: 140412 - protein, 9 aa, Homo Sapiens
TIYDRFVHL

SEQ ID NO: 140413 - protein, 9 aa, Homo Sapiens
TIYHMFIAL

SEQ ID NO: 140414 - protein, 9 aa, Homo Sapiens
TMLSRENVG

SEQ ID NO: 140415 - protein, 9 aa, Homo Sapiens
TSSPSILTL

SEQ ID NO: 140416 - protein, 9 aa, Homo Sapiens
TSVPPGSAL

SEQ ID NO: 140417 - protein, 9 aa, Homo Sapiens
TTIKPGLAL

SEQ ID NO: 140418 - protein, 9 aa, Homo Sapiens
TTMVPTAAL

SEQ ID NO: 140419 - protein, 9 aa, Homo Sapiens
TVIPHLMAL

SEQ ID NO: 140420 - protein, 9 aa, Homo Sapiens
TVTTVILEV

SEQ ID NO: 140421 - protein, 9 aa, Homo Sapiens
VAAAHSVVL

SEQ ID NO: 140422 - protein, 9 aa, Homo Sapiens
VAADAVASL

SEQ ID NO: 140423 - protein, 9 aa, Homo Sapiens
VAAGVLCEL

SEQ ID NO: 140424 - protein, 9 aa, Homo Sapiens
VAAKKNVSI

SEQ ID NO: 140425 - protein, 9 aa, Homo Sapiens
VAALSGRPL

SEQ ID NO: 140426 - protein, 9 aa, Homo Sapiens
VAAPASLSL

SEQ ID NO: 140427 - protein, 9 aa, Homo Sapiens
VACGLNHTL

SEQ ID NO: 140428 - protein, 9 aa, Homo Sapiens
VADPVYRTF

SEQ ID NO: 140429 - protein, 9 aa, Homo Sapiens
VADPYVVIM

SEQ ID NO: 140430 - protein, 9 aa, Homo Sapiens
VAEAGLTIS

SEQ ID NO: 140431 - protein, 9 aa, Homo Sapiens
VAEENTRVL

SEQ ID NO: 140432 - protein, 9 aa, Homo Sapiens
VAFDKFWNM

SEQ ID NO: 140433 - protein, 9 aa, Homo Sapiens
VAFGPAFAL

SEQ ID NO: 140434 - protein, 9 aa, Homo Sapiens
VAFQHFQEL

SEQ ID NO: 140435 - protein, 9 aa, Homo Sapiens
VAFSPVTEL

SEQ ID NO: 140436 - protein, 9 aa, Homo Sapiens
VAGPALEAL

SEQ ID NO: 140437 - protein, 9 aa, Homo Sapiens
VAGPVGGSL

SEQ ID NO: 140438 - protein, 9 aa, Homo Sapiens
VAICRNLIL

SEQ ID NO: 140439 - protein, 9 aa, Homo Sapiens
VAIFPSPMM

SEQ ID NO: 140440 - protein, 9 aa, Homo Sapiens
VAIGPCRML

SEQ ID NO: 140441 - protein, 9 aa, Homo Sapiens
VAIIARTDL

SEQ ID NO: 140442 - protein, 9 aa, Homo Sapiens
VAIKAGTTL

SEQ ID NO: 140443 - protein, 9 aa, Homo Sapiens
VAILRHPTL

SEQ ID NO: 140444 - protein, 9 aa, Homo Sapiens
VAIPCYTTL

SEQ ID NO: 140445 - protein, 9 aa, Homo Sapiens
VAIQAVLSL

SEQ ID NO: 140446 - protein, 9 aa, Homo Sapiens
VAIQAVLTL

SEQ ID NO: 140447 - protein, 9 aa, Homo Sapiens
VALAWLHVL

SEQ ID NO: 140448 - protein, 9 aa, Homo Sapiens
VALCHLAEL

SEQ ID NO: 140449 - protein, 9 aa, Homo Sapiens
VALDFEQEM

SEQ ID NO: 140450 - protein, 9 aa, Homo Sapiens
VALGNMYEL

SEQ ID NO: 140451 - protein, 9 aa, Homo Sapiens
VALLRVTPF

SEQ ID NO: 140452 - protein, 9 aa, Homo Sapiens
VALLVTSGL

SEQ ID NO: 140453 - protein, 9 aa, Homo Sapiens
VALPASGWL

SEQ ID NO: 140454 - protein, 9 aa, Homo Sapiens
VALPMVLVL

SEQ ID NO: 140455 - protein, 9 aa, Homo Sapiens
VALPPGLAV

SEQ ID NO: 140456 - protein, 9 aa, Homo Sapiens
VALPVFLVI

SEQ ID NO: 140457 - protein, 9 aa, Homo Sapiens
VALPVVYSL

SEQ ID NO: 140458 - protein, 9 aa, Homo Sapiens
VALVVGHEL

SEQ ID NO: 140459 - protein, 9 aa, Homo Sapiens
VAMERVSVL

SEQ ID NO: 140460 - protein, 9 aa, Homo Sapiens
VAMYGGLVL

SEQ ID NO: 140461 - protein, 9 aa, Homo Sapiens
VANNRIITL

SEQ ID NO: 140462 - protein, 9 aa, Homo Sapiens
VANPEHMEM

SEQ ID NO: 140463 - protein, 9 aa, Homo Sapiens
VANPNSAIF

SEQ ID NO: 140464 - protein, 9 aa, Homo Sapiens
VANVPNTSL

SEQ ID NO: 140465 - protein, 9 aa, Homo Sapiens
VANVSLLAL

SEQ ID NO: 140466 - protein, 9 aa, Homo Sapiens
VAQELPTTL

SEQ ID NO: 140467 - protein, 9 aa, Homo Sapiens
VAQNSGLTL

SEQ ID NO: 140468 - protein, 9 aa, Homo Sapiens
VAQTWFRFL

SEQ ID NO: 140469 - protein, 9 aa, Homo Sapiens
VASAVCLRL

SEQ ID NO: 140470 - protein, 9 aa, Homo Sapiens
VASFPRTVL

SEQ ID NO: 140471 - protein, 9 aa, Homo Sapiens
VATAADLEL

SEQ ID NO: 140472 - protein, 9 aa, Homo Sapiens
VATDFFTVL

SEQ ID NO: 140473 - protein, 9 aa, Homo Sapiens
VATGVISTL

SEQ ID NO: 140474 - protein, 9 aa, Homo Sapiens
VATKIFQEL

SEQ ID NO: 140475 - protein, 9 aa, Homo Sapiens
VATQVGIEW

SEQ ID NO: 140476 - protein, 9 aa, Homo Sapiens
VAVDGINAL

SEQ ID NO: 140477 - protein, 9 aa, Homo Sapiens
VAVEPGAAV

SEQ ID NO: 140478 - protein, 9 aa, Homo Sapiens
VAVFPWHSL

SEQ ID NO: 140479 - protein, 9 aa, Homo Sapiens
VAVGSGLSW

SEQ ID NO: 140480 - protein, 9 aa, Homo Sapiens
VAVGVIKAV

SEQ ID NO: 140481 - protein, 9 aa, Homo Sapiens
VAVHVFSEF

SEQ ID NO: 140482 - protein, 9 aa, Homo Sapiens
VAVISGEAL

SEQ ID NO: 140483 - protein, 9 aa, Homo Sapiens
VAVPTLNAL

SEQ ID NO: 140484 - protein, 9 aa, Homo Sapiens
VAVPVAVTF

SEQ ID NO: 140485 - protein, 9 aa, Homo Sapiens
VAVQHFSLL

SEQ ID NO: 140486 - protein, 9 aa, Homo Sapiens
VAVQPGEQL

SEQ ID NO: 140487 - protein, 9 aa, Homo Sapiens
VAVSPSLDL

SEQ ID NO: 140488 - protein, 9 aa, Homo Sapiens
VAVSVLNAL

SEQ ID NO: 140489 - protein, 9 aa, Homo Sapiens
VAVVAGVAL

SEQ ID NO: 140490 - protein, 9 aa, Homo Sapiens
VAYLQAHAL

SEQ ID NO: 140491 - protein, 9 aa, Homo Sapiens
VAYMNPIAM

SEQ ID NO: 140492 - protein, 9 aa, Homo Sapiens
VAYPGIPKL

SEQ ID NO: 140493 - protein, 9 aa, Homo Sapiens
VAYVSSVAL

SEQ ID NO: 140494 - protein, 9 aa, Homo Sapiens
VAYWRQAGL

SEQ ID NO: 140495 - protein, 9 aa, Homo Sapiens
VEPEVAIHR

SEQ ID NO: 140496 - protein, 9 aa, Homo Sapiens
VFNTLQGGK

SEQ ID NO: 140497 - protein, 9 aa, Homo Sapiens
VGAPVGIAL

SEQ ID NO: 140498 - protein, 9 aa, Homo Sapiens
VGDPSVHLL

SEQ ID NO: 140499 - protein, 9 aa, Homo Sapiens
VGGVALSLS

SEQ ID NO: 140500 - protein, 9 aa, Homo Sapiens
VGVPVGSAL

SEQ ID NO: 140501 - protein, 9 aa, Homo Sapiens
VIAPNPAQL

SEQ ID NO: 140502 - protein, 9 aa, Homo Sapiens
VIDGEFKEL

SEQ ID NO: 140503 - protein, 9 aa, Homo Sapiens
VIHVPSPAL

SEQ ID NO: 140504 - protein, 9 aa, Homo Sapiens
VIIEKTYSL

SEQ ID NO: 140505 - protein, 9 aa, Homo Sapiens
VIIGSTHVL

SEQ ID NO: 140506 - protein, 9 aa, Homo Sapiens
VIIWARLAL

SEQ ID NO: 140507 - protein, 9 aa, Homo Sapiens
VIMGLSPIL

SEQ ID NO: 140508 - protein, 9 aa, Homo Sapiens
VIMPHNMYL

SEQ ID NO: 140509 - protein, 9 aa, Homo Sapiens
VINGHTLCL

SEQ ID NO: 140510 - protein, 9 aa, Homo Sapiens
VIPTNVPEL

SEQ ID NO: 140511 - protein, 9 aa, Homo Sapiens
VISLEGKPL

SEQ ID NO: 140512 - protein, 9 aa, Homo Sapiens
VIVTPLTEL

SEQ ID NO: 140513 - protein, 9 aa, Homo Sapiens
VIYPARISL

SEQ ID NO: 140514 - protein, 9 aa, Homo Sapiens
VNCFVNNNR

SEQ ID NO: 140515 - protein, 9 aa, Homo Sapiens
VNFTVDQIR

SEQ ID NO: 140516 - protein, 9 aa, Homo Sapiens
VSAGIQTSF

SEQ ID NO: 140517 - protein, 9 aa, Homo Sapiens
VSCPYVKTV

SEQ ID NO: 140518 - protein, 9 aa, Homo Sapiens
VSDFGGRSL

SEQ ID NO: 140519 - protein, 9 aa, Homo Sapiens
VSFPYVIAL

SEQ ID NO: 140520 - protein, 9 aa, Homo Sapiens
VSHPRYLEL

SEQ ID NO: 140521 - protein, 9 aa, Homo Sapiens
VSIDTVTVL

SEQ ID NO: 140522 - protein, 9 aa, Homo Sapiens
VSIGDSHCL

SEQ ID NO: 140523 - protein, 9 aa, Homo Sapiens
VSMPVFQSL

SEQ ID NO: 140524 - protein, 9 aa, Homo Sapiens
VTDHNLHEL

SEQ ID NO: 140525 - protein, 9 aa, Homo Sapiens
VTEECVHIL

SEQ ID NO: 140526 - protein, 9 aa, Homo Sapiens
VTIARAIEL

SEQ ID NO: 140527 - protein, 9 aa, Homo Sapiens
VTIPSGSTL

SEQ ID NO: 140528 - protein, 9 aa, Homo Sapiens
VTVPPGPSL

SEQ ID NO: 140529 - protein, 9 aa, Homo Sapiens
VTVQPSPYL

SEQ ID NO: 140530 - protein, 9 aa, Homo Sapiens
VTVRPGLAM

SEQ ID NO: 140531 - protein, 9 aa, Homo Sapiens
VVAPAGITL

SEQ ID NO: 140532 - protein, 9 aa, Homo Sapiens
VVEHPEFLK

SEQ ID NO: 140533 - protein, 9 aa, Homo Sapiens
VVIEPISEL

SEQ ID NO: 140534 - protein, 9 aa, Homo Sapiens
VVIGKMLIL

SEQ ID NO: 140535 - protein, 9 aa, Homo Sapiens
VVKPPGSSL

SEQ ID NO: 140536 - protein, 9 aa, Homo Sapiens
VVNGRVLEL

SEQ ID NO: 140537 - protein, 9 aa, Homo Sapiens
VVVAVGRAL

SEQ ID NO: 140538 - protein, 9 aa, Homo Sapiens
VVVDPIQSV

SEQ ID NO: 140539 - protein, 9 aa, Homo Sapiens
VVVQAISAL

SEQ ID NO: 140540 - protein, 9 aa, Homo Sapiens
VVVQPYNSL

SEQ ID NO: 140541 - protein, 9 aa, Homo Sapiens
WAEWGHREL

SEQ ID NO: 140542 - protein, 9 aa, Homo Sapiens
WAICPRDSL

SEQ ID NO: 140543 - protein, 9 aa, Homo Sapiens
WAMDLRPEL

SEQ ID NO: 140544 - protein, 9 aa, Homo Sapiens
WAQPGGAAF

SEQ ID NO: 140545 - protein, 9 aa, Homo Sapiens
WAVTGVSSL

SEQ ID NO: 140546 - protein, 9 aa, Homo Sapiens
WAYPRQVFI

SEQ ID NO: 140547 - protein, 9 aa, Homo Sapiens
WQNPHMLFL

SEQ ID NO: 140548 - protein, 9 aa, Homo Sapiens
YAAGAGLCV

SEQ ID NO: 140549 - protein, 9 aa, Homo Sapiens
YAAGAKLVL

SEQ ID NO: 140550 - protein, 9 aa, Homo Sapiens
YAAGVHSVL

SEQ ID NO: 140551 - protein, 9 aa, Homo Sapiens
YAALCGISL

SEQ ID NO: 140552 - protein, 9 aa, Homo Sapiens
YAANPGQLF

SEQ ID NO: 140553 - protein, 9 aa, Homo Sapiens
YAAPHFFHL

SEQ ID NO: 140554 - protein, 9 aa, Homo Sapiens
YAAPWFLTL

SEQ ID NO: 140555 - protein, 9 aa, Homo Sapiens
YAAQAHLKL

SEQ ID NO: 140556 - protein, 9 aa, Homo Sapiens
YAAYPLTEV

SEQ ID NO: 140557 - protein, 9 aa, Homo Sapiens
YACEKEVFL

SEQ ID NO: 140558 - protein, 9 aa, Homo Sapiens
YACPLPREA

SEQ ID NO: 140559 - protein, 9 aa, Homo Sapiens
YADGYSPPL

SEQ ID NO: 140560 - protein, 9 aa, Homo Sapiens
YADVGGKQF

SEQ ID NO: 140561 - protein, 9 aa, Homo Sapiens
YADVIVHRL

SEQ ID NO: 140562 - protein, 9 aa, Homo Sapiens
YAEMGTRTF

SEQ ID NO: 140563 - protein, 9 aa, Homo Sapiens
YAETIAHIL

SEQ ID NO: 140564 - protein, 9 aa, Homo Sapiens
YAEVGRVLL

SEQ ID NO: 140565 - protein, 9 aa, Homo Sapiens
YAFGGGCEL

SEQ ID NO: 140566 - protein, 9 aa, Homo Sapiens
YAFPKAVSV

SEQ ID NO: 140567 - protein, 9 aa, Homo Sapiens
YAFPKAVTV

SEQ ID NO: 140568 - protein, 9 aa, Homo Sapiens
YAFPKSITV

SEQ ID NO: 140569 - protein, 9 aa, Homo Sapiens
YAFPLAHSL

SEQ ID NO: 140570 - protein, 9 aa, Homo Sapiens
YAFSPRNSL

SEQ ID NO: 140571 - protein, 9 aa, Homo Sapiens
YAFVRPVIL

SEQ ID NO: 140572 - protein, 9 aa, Homo Sapiens
YAHLTPREL

SEQ ID NO: 140573 - protein, 9 aa, Homo Sapiens
YAHLTYVTL

SEQ ID NO: 140574 - protein, 9 aa, Homo Sapiens
YAIARFKFL

SEQ ID NO: 140575 - protein, 9 aa, Homo Sapiens
YAIDNPLHY

SEQ ID NO: 140576 - protein, 9 aa, Homo Sapiens
YAIESQLQL

SEQ ID NO: 140577 - protein, 9 aa, Homo Sapiens
YAIEVDPVL

SEQ ID NO: 140578 - protein, 9 aa, Homo Sapiens
YAIGLVMRL

SEQ ID NO: 140579 - protein, 9 aa, Homo Sapiens
YAIGNAPEL

SEQ ID NO: 140580 - protein, 9 aa, Homo Sapiens
YAIGVSHPL

SEQ ID NO: 140581 - protein, 9 aa, Homo Sapiens
YAIHGVLEV

SEQ ID NO: 140582 - protein, 9 aa, Homo Sapiens
YAINQPDVL

SEQ ID NO: 140583 - protein, 9 aa, Homo Sapiens
YAIPKFKHL

SEQ ID NO: 140584 - protein, 9 aa, Homo Sapiens
YAISKPEVL

SEQ ID NO: 140585 - protein, 9 aa, Homo Sapiens
YAISPGLDI

SEQ ID NO: 140586 - protein, 9 aa, Homo Sapiens
YAITRVLRL

SEQ ID NO: 140587 - protein, 9 aa, Homo Sapiens
YAITTLHNL

SEQ ID NO: 140588 - protein, 9 aa, Homo Sapiens
YAIVNFITF

SEQ ID NO: 140589 - protein, 9 aa, Homo Sapiens
YAKDDPLEF

SEQ ID NO: 140590 - protein, 9 aa, Homo Sapiens
YAKRPGIGL

SEQ ID NO: 140591 - protein, 9 aa, Homo Sapiens
YALDLSTFL

SEQ ID NO: 140592 - protein, 9 aa, Homo Sapiens
YALERLKVM

SEQ ID NO: 140593 - protein, 9 aa, Homo Sapiens
YALGALNHL

SEQ ID NO: 140594 - protein, 9 aa, Homo Sapiens
YALNHTLSV

SEQ ID NO: 140595 - protein, 9 aa, Homo Sapiens
YALPAGLSA

SEQ ID NO: 140596 - protein, 9 aa, Homo Sapiens
YALPKSLSV

SEQ ID NO: 140597 - protein, 9 aa, Homo Sapiens
YALTAIMKL

SEQ ID NO: 140598 - protein, 9 aa, Homo Sapiens
YALYVRDTL

SEQ ID NO: 140599 - protein, 9 aa, Homo Sapiens
YAMDELRSL

SEQ ID NO: 140600 - protein, 9 aa, Homo Sapiens
YAMDIVKGL

SEQ ID NO: 140601 - protein, 9 aa, Homo Sapiens
YANAKIYKL

SEQ ID NO: 140602 - protein, 9 aa, Homo Sapiens
YANAVLQAL

SEQ ID NO: 140603 - protein, 9 aa, Homo Sapiens
YANEVGEAF

SEQ ID NO: 140604 - protein, 9 aa, Homo Sapiens
YANSKAVTL

SEQ ID NO: 140605 - protein, 9 aa, Homo Sapiens
YANYYTREV

SEQ ID NO: 140606 - protein, 9 aa, Homo Sapiens
YAQIRTIAI

SEQ ID NO: 140607 - protein, 9 aa, Homo Sapiens
YAQLHSFTL

SEQ ID NO: 140608 - protein, 9 aa, Homo Sapiens
YAQLHSLTL

SEQ ID NO: 140609 - protein, 9 aa, Homo Sapiens
YASDFHNVL

SEQ ID NO: 140610 - protein, 9 aa, Homo Sapiens
YASNITSVL

SEQ ID NO: 140611 - protein, 9 aa, Homo Sapiens
YASSPGMSL

SEQ ID NO: 140612 - protein, 9 aa, Homo Sapiens
YATLFAQAL

SEQ ID NO: 140613 - protein, 9 aa, Homo Sapiens
YAVELFEGL

SEQ ID NO: 140614 - protein, 9 aa, Homo Sapiens
YAVGDVKCL

SEQ ID NO: 140615 - protein, 9 aa, Homo Sapiens
YAVGGYTRL

SEQ ID NO: 140616 - protein, 9 aa, Homo Sapiens
YAVHEGLGL

SEQ ID NO: 140617 - protein, 9 aa, Homo Sapiens
YAVMRAAEM

SEQ ID NO: 140618 - protein, 9 aa, Homo Sapiens
YAVNSQFTM

SEQ ID NO: 140619 - protein, 9 aa, Homo Sapiens
YAVTGDVKM

SEQ ID NO: 140620 - protein, 9 aa, Homo Sapiens
YAYEKPHVV

SEQ ID NO: 140621 - protein, 9 aa, Homo Sapiens
YAYETKDAL

SEQ ID NO: 140622 - protein, 9 aa, Homo Sapiens
YAYEWQRCL

SEQ ID NO: 140623 - protein, 9 aa, Homo Sapiens
YAYGQYNMP

SEQ ID NO: 140624 - protein, 9 aa, Homo Sapiens
YAYLKAIVL

SEQ ID NO: 140625 - protein, 9 aa, Homo Sapiens
YAYLYIRML

SEQ ID NO: 140626 - protein, 9 aa, Homo Sapiens
YAYPGVLLI

SEQ ID NO: 140627 - protein, 9 aa, Homo Sapiens
YAYTGRLEL

SEQ ID NO: 140628 - protein, 9 aa, Homo Sapiens
YAYTSRVIL

SEQ ID NO: 140629 - protein, 9 aa, Homo Sapiens
YGIEHALAL

SEQ ID NO: 140630 - protein, 9 aa, Homo Sapiens
YGINNIREL

SEQ ID NO: 140631 - protein, 9 aa, Homo Sapiens
YGITSPISL

SEQ ID NO: 140632 - protein, 9 aa, Homo Sapiens
YGLEPAHPL

SEQ ID NO: 140633 - protein, 9 aa, Homo Sapiens
YGNPNTLRL

SEQ ID NO: 140634 - protein, 9 aa, Homo Sapiens
YGSFVTRAL

SEQ ID NO: 140635 - protein, 9 aa, Homo Sapiens
YGSPNALVL

SEQ ID NO: 140636 - protein, 9 aa, Homo Sapiens
YGSPQSPQL

SEQ ID NO: 140637 - protein, 9 aa, Homo Sapiens
YGVTVFKAL

SEQ ID NO: 140638 - protein, 9 aa, Homo Sapiens
YGYEHILTL

SEQ ID NO: 140639 - protein, 9 aa, Homo Sapiens
YGYSNPKIL

SEQ ID NO: 140640 - protein, 9 aa, Homo Sapiens
YIDDVFHAL

SEQ ID NO: 140641 - protein, 9 aa, Homo Sapiens
YIDEGRLVL

SEQ ID NO: 140642 - protein, 9 aa, Homo Sapiens
YIFDNCHEL

SEQ ID NO: 140643 - protein, 9 aa, Homo Sapiens
YIIIPKSSL

SEQ ID NO: 140644 - protein, 9 aa, Homo Sapiens
YIIPVVLFL

SEQ ID NO: 140645 - protein, 9 aa, Homo Sapiens
YIIVPPLTL

SEQ ID NO: 140646 - protein, 9 aa, Homo Sapiens
YILDPKQAL

SEQ ID NO: 140647 - protein, 9 aa, Homo Sapiens
YILGKFFAL

SEQ ID NO: 140648 - protein, 9 aa, Homo Sapiens
YILPFSEVL

SEQ ID NO: 140649 - protein, 9 aa, Homo Sapiens
YIMDWMDEM

SEQ ID NO: 140650 - protein, 9 aa, Homo Sapiens
YINPRAVQL

SEQ ID NO: 140651 - protein, 9 aa, Homo Sapiens
YIPNKVLIL

SEQ ID NO: 140652 - protein, 9 aa, Homo Sapiens
YIQQKVRVL

SEQ ID NO: 140653 - protein, 9 aa, Homo Sapiens
YISAKPLEM

SEQ ID NO: 140654 - protein, 9 aa, Homo Sapiens
YITDFLARL

SEQ ID NO: 140655 - protein, 9 aa, Homo Sapiens
YITDLFQVL

SEQ ID NO: 140656 - protein, 9 aa, Homo Sapiens
YIVAVYHCM

SEQ ID NO: 140657 - protein, 9 aa, Homo Sapiens
YIVDHTIIM

SEQ ID NO: 140658 - protein, 9 aa, Homo Sapiens
YIVKWPLSL

SEQ ID NO: 140659 - protein, 9 aa, Homo Sapiens
YLAPHVRTL

SEQ ID NO: 140660 - protein, 9 aa, Homo Sapiens
YLFERIKEL

SEQ ID NO: 140661 - protein, 9 aa, Homo Sapiens
YLIARVMLL

SEQ ID NO: 140662 - protein, 9 aa, Homo Sapiens
YLIGVHASL

SEQ ID NO: 140663 - protein, 9 aa, Homo Sapiens
YLIPFSSKL

SEQ ID NO: 140664 - protein, 9 aa, Homo Sapiens
YLLDHFLSM

SEQ ID NO: 140665 - protein, 9 aa, Homo Sapiens
YLLDLHSYL

SEQ ID NO: 140666 - protein, 9 aa, Homo Sapiens
YLLEKSRIV

SEQ ID NO: 140667 - protein, 9 aa, Homo Sapiens
YLLEKSRVI

SEQ ID NO: 140668 - protein, 9 aa, Homo Sapiens
YLNGYIYIL

SEQ ID NO: 140669 - protein, 9 aa, Homo Sapiens
YLQIHPQEL

SEQ ID NO: 140670 - protein, 9 aa, Homo Sapiens
YLTAEILEL

SEQ ID NO: 140671 - protein, 9 aa, Homo Sapiens
YLTPLILTL

SEQ ID NO: 140672 - protein, 9 aa, Homo Sapiens
YLVPQARAL

SEQ ID NO: 140673 - protein, 9 aa, Homo Sapiens
YMIAHITGL

SEQ ID NO: 140674 - protein, 9 aa, Homo Sapiens
YNIQKESTL

SEQ ID NO: 140675 - protein, 9 aa, Homo Sapiens
YQEKGVRVL

SEQ ID NO: 140676 - protein, 9 aa, Homo Sapiens
YQEVGAKVL

SEQ ID NO: 140677 - protein, 9 aa, Homo Sapiens
YQIAVTKVL

SEQ ID NO: 140678 - protein, 9 aa, Homo Sapiens
YQIDTVINL

SEQ ID NO: 140679 - protein, 9 aa, Homo Sapiens
YQIPTENSM

SEQ ID NO: 140680 - protein, 9 aa, Homo Sapiens
YQNPQITQL

SEQ ID NO: 140681 - protein, 9 aa, Homo Sapiens
YQQELEREL

SEQ ID NO: 140682 - protein, 9 aa, Homo Sapiens
YSAPCTYEL

SEQ ID NO: 140683 - protein, 9 aa, Homo Sapiens
YSAPVIHVL

SEQ ID NO: 140684 - protein, 9 aa, Homo Sapiens
YSDDIPHAL

SEQ ID NO: 140685 - protein, 9 aa, Homo Sapiens
YSFDYPSDM

SEQ ID NO: 140686 - protein, 9 aa, Homo Sapiens
YSFHKFHYL

SEQ ID NO: 140687 - protein, 9 aa, Homo Sapiens
YSIAQFKYL

SEQ ID NO: 140688 - protein, 9 aa, Homo Sapiens
YSIGPNSKL

SEQ ID NO: 140689 - protein, 9 aa, Homo Sapiens
YSINMNVFL

SEQ ID NO: 140690 - protein, 9 aa, Homo Sapiens
YSIVGLSSL

SEQ ID NO: 140691 - protein, 9 aa, Homo Sapiens
YSIYVYKVL

SEQ ID NO: 140692 - protein, 9 aa, Homo Sapiens
YSKLPGVSL

SEQ ID NO: 140693 - protein, 9 aa, Homo Sapiens
YSLCPGREL

SEQ ID NO: 140694 - protein, 9 aa, Homo Sapiens
YSLDHISSL

SEQ ID NO: 140695 - protein, 9 aa, Homo Sapiens
YSLPNAPTL

SEQ ID NO: 140696 - protein, 9 aa, Homo Sapiens
YSMPSTHAM

SEQ ID NO: 140697 - protein, 9 aa, Homo Sapiens
YSMPVHAAV

SEQ ID NO: 140698 - protein, 9 aa, Homo Sapiens
YSSMFFITL

SEQ ID NO: 140699 - protein, 9 aa, Homo Sapiens
YSSPFDPVL

SEQ ID NO: 140700 - protein, 9 aa, Homo Sapiens
YSTPHAFTF

SEQ ID NO: 140701 - protein, 9 aa, Homo Sapiens
YSVPSSQEL

SEQ ID NO: 140702 - protein, 9 aa, Homo Sapiens
YSVRVSPQM

SEQ ID NO: 140703 - protein, 9 aa, Homo Sapiens
YSVYVYKVL

SEQ ID NO: 140704 - protein, 9 aa, Homo Sapiens
YSWVGRPLL

SEQ ID NO: 140705 - protein, 9 aa, Homo Sapiens
YSYDLSHSL

SEQ ID NO: 140706 - protein, 9 aa, Homo Sapiens
YSYFSPRTM

SEQ ID NO: 140707 - protein, 9 aa, Homo Sapiens
YTIENPRHF

SEQ ID NO: 140708 - protein, 9 aa, Homo Sapiens
YTIPAHQNL

SEQ ID NO: 140709 - protein, 9 aa, Homo Sapiens
YTIPLAIKL

SEQ ID NO: 140710 - protein, 9 aa, Homo Sapiens
YTIPLSPVL

SEQ ID NO: 140711 - protein, 9 aa, Homo Sapiens
YTIPPGHQV

SEQ ID NO: 140712 - protein, 9 aa, Homo Sapiens
YTLINHRVL

SEQ ID NO: 140713 - protein, 9 aa, Homo Sapiens
YTMVYWHAL

SEQ ID NO: 140714 - protein, 9 aa, Homo Sapiens
YTNGKCVIL

SEQ ID NO: 140715 - protein, 9 aa, Homo Sapiens
YTSEVQAIL

SEQ ID NO: 140716 - protein, 9 aa, Homo Sapiens
YTSGTFRTV

SEQ ID NO: 140717 - protein, 9 aa, Homo Sapiens
YTSPVNPAV

SEQ ID NO: 140718 - protein, 9 aa, Homo Sapiens
YTTDFIYQL

SEQ ID NO: 140719 - protein, 9 aa, Homo Sapiens
YTTDRVMTV

SEQ ID NO: 140720 - protein, 9 aa, Homo Sapiens
YTVKAILIL

SEQ ID NO: 140721 - protein, 9 aa, Homo Sapiens
YTVLTRIGL

SEQ ID NO: 140722 - protein, 9 aa, Homo Sapiens
YTVVYFPVR

SEQ ID NO: 140723 - protein, 9 aa, Homo Sapiens
YVADPGGSL

SEQ ID NO: 140724 - protein, 9 aa, Homo Sapiens
YVAQAGLEL

SEQ ID NO: 140725 - protein, 9 aa, Homo Sapiens
YVDPVNKVL

SEQ ID NO: 140726 - protein, 9 aa, Homo Sapiens
YVFPGVTRL

SEQ ID NO: 140727 - protein, 9 aa, Homo Sapiens
YVHPFIFAL

SEQ ID NO: 140728 - protein, 9 aa, Homo Sapiens
YVIAYIRDL

SEQ ID NO: 140729 - protein, 9 aa, Homo Sapiens
YVIDPIKGL

SEQ ID NO: 140730 - protein, 9 aa, Homo Sapiens
YVINVTTHL

SEQ ID NO: 140731 - protein, 9 aa, Homo Sapiens
YVIQKFFEF

SEQ ID NO: 140732 - protein, 9 aa, Homo Sapiens
YVNLPTIAL

SEQ ID NO: 140733 - protein, 9 aa, Homo Sapiens
YVSPRILTA

SEQ ID NO: 140734 - protein, 9 aa, Homo Sapiens
YVTESQPDL

SEQ ID NO: 140735 - protein, 9 aa, Homo Sapiens
YVVPYMIHL

SEQ ID NO: 140736 - protein, 9 aa, Homo Sapiens
YVVPYTIHL

SEQ ID NO: 140737 - protein, 9 aa, Homo Sapiens
YYVDFFKTL

SEQ ID NO: 140738 - protein, 10 aa, Homo Sapiens
AAAPVPTTTL

SEQ ID NO: 140739 - protein, 10 aa, Homo Sapiens
AAFEALGTAL

SEQ ID NO: 140740 - protein, 10 aa, Homo Sapiens
AAFGGHPQCL

SEQ ID NO: 140741 - protein, 10 aa, Homo Sapiens
AAFPGASLYL

SEQ ID NO: 140742 - protein, 10 aa, Homo Sapiens
AAIDPRVQYL

SEQ ID NO: 140743 - protein, 10 aa, Homo Sapiens
AAIDPSMVSA

SEQ ID NO: 140744 - protein, 10 aa, Homo Sapiens
AAIKPGTPLY

SEQ ID NO: 140745 - protein, 10 aa, Homo Sapiens
AAINPELLQL

SEQ ID NO: 140746 - protein, 10 aa, Homo Sapiens
AAWEPSKNTL

SEQ ID NO: 140747 - protein, 10 aa, Homo Sapiens
AAYIGSMRPL

SEQ ID NO: 140748 - protein, 10 aa, Homo Sapiens
ACASEEVPTL

SEQ ID NO: 140749 - protein, 10 aa, Homo Sapiens
AINVNDSVTK

SEQ ID NO: 140750 - protein, 10 aa, Homo Sapiens
ATPEQPVLDL

SEQ ID NO: 140751 - protein, 10 aa, Homo Sapiens
AVISLEGKPL

SEQ ID NO: 140752 - protein, 10 aa, Homo Sapiens
CAYDRIVVAG

SEQ ID NO: 140753 - protein, 10 aa, Homo Sapiens
DINTDGAVNF

SEQ ID NO: 140754 - protein, 10 aa, Homo Sapiens
FAAPTTGNQI

SEQ ID NO: 140755 - protein, 10 aa, Homo Sapiens
FAATADPAAL

SEQ ID NO: 140756 - protein, 10 aa, Homo Sapiens
FADPEVLRRL

SEQ ID NO: 140757 - protein, 10 aa, Homo Sapiens
FADPHGKRVF

SEQ ID NO: 140758 - protein, 10 aa, Homo Sapiens
FADPHSKRVF

SEQ ID NO: 140759 - protein, 10 aa, Homo Sapiens
FADSFDRGTL

SEQ ID NO: 140760 - protein, 10 aa, Homo Sapiens
FADSHELSEL

SEQ ID NO: 140761 - protein, 10 aa, Homo Sapiens
FAEALATHIL

SEQ ID NO: 140762 - protein, 10 aa, Homo Sapiens
FAESGWRSAL

SEQ ID NO: 140763 - protein, 10 aa, Homo Sapiens
FAFESDLHSL

SEQ ID NO: 140764 - protein, 10 aa, Homo Sapiens
FAFSPDGKFL

SEQ ID NO: 140765 - protein, 10 aa, Homo Sapiens
FAFSPDGRHL

SEQ ID NO: 140766 - protein, 10 aa, Homo Sapiens
FAHVGQLTGM

SEQ ID NO: 140767 - protein, 10 aa, Homo Sapiens
FAIDSSHPWL

SEQ ID NO: 140768 - protein, 10 aa, Homo Sapiens
FAINIDNKDL

SEQ ID NO: 140769 - protein, 10 aa, Homo Sapiens
FAIPMIHAVL

SEQ ID NO: 140770 - protein, 10 aa, Homo Sapiens
FAIRGLAEAL

SEQ ID NO: 140771 - protein, 10 aa, Homo Sapiens
FAIRWGFIPL

SEQ ID NO: 140772 - protein, 10 aa, Homo Sapiens
FAITEPLVTF

SEQ ID NO: 140773 - protein, 10 aa, Homo Sapiens
FAIVASDTRL

SEQ ID NO: 140774 - protein, 10 aa, Homo Sapiens
FALEAGALVL

SEQ ID NO: 140775 - protein, 10 aa, Homo Sapiens
FALGGNKQAL

SEQ ID NO: 140776 - protein, 10 aa, Homo Sapiens
FALGLPFLVL

SEQ ID NO: 140777 - protein, 10 aa, Homo Sapiens
FALPYVDHFL

SEQ ID NO: 140778 - protein, 10 aa, Homo Sapiens
FAMTGERVDL

SEQ ID NO: 140779 - protein, 10 aa, Homo Sapiens
FAQDGQHQVL

SEQ ID NO: 140780 - protein, 10 aa, Homo Sapiens
FAQQNSGHFL

SEQ ID NO: 140781 - protein, 10 aa, Homo Sapiens
FASPTSPPVL

SEQ ID NO: 140782 - protein, 10 aa, Homo Sapiens
FASTILHLVV

SEQ ID NO: 140783 - protein, 10 aa, Homo Sapiens
FATFPSSAFL

SEQ ID NO: 140784 - protein, 10 aa, Homo Sapiens
FATLTRPLAL

SEQ ID NO: 140785 - protein, 10 aa, Homo Sapiens
FAVDPQITSL

SEQ ID NO: 140786 - protein, 10 aa, Homo Sapiens
FAVEPQGPAL

SEQ ID NO: 140787 - protein, 10 aa, Homo Sapiens
FAVSSKVTSM

SEQ ID NO: 140788 - protein, 10 aa, Homo Sapiens
FAYGGHPYPF

SEQ ID NO: 140789 - protein, 10 aa, Homo Sapiens
FAYGQNKTAF

SEQ ID NO: 140790 - protein, 10 aa, Homo Sapiens
FAYPNRPDVL

SEQ ID NO: 140791 - protein, 10 aa, Homo Sapiens
FAYSDSRVGF

SEQ ID NO: 140792 - protein, 10 aa, Homo Sapiens
FIMEGGAMVL

SEQ ID NO: 140793 - protein, 10 aa, Homo Sapiens
FINVPPQIAL

SEQ ID NO: 140794 - protein, 10 aa, Homo Sapiens
FIPEHTNLSL

SEQ ID NO: 140795 - protein, 10 aa, Homo Sapiens
FIVPTGKTGL

SEQ ID NO: 140796 - protein, 10 aa, Homo Sapiens
FIYPSNMQTM

SEQ ID NO: 140797 - protein, 10 aa, Homo Sapiens
FLESGGFRSL

SEQ ID NO: 140798 - protein, 10 aa, Homo Sapiens
FLFDKPVSPL

SEQ ID NO: 140799 - protein, 10 aa, Homo Sapiens
FLIENPKTSL

SEQ ID NO: 140800 - protein, 10 aa, Homo Sapiens
FLPEFPSCSL

SEQ ID NO: 140801 - protein, 10 aa, Homo Sapiens
FLPTSLPPEL

SEQ ID NO: 140802 - protein, 10 aa, Homo Sapiens
FLSEHPNVTL

SEQ ID NO: 140803 - protein, 10 aa, Homo Sapiens
FLVNHDFSPL

SEQ ID NO: 140804 - protein, 10 aa, Homo Sapiens
FSAPTPIQAL

SEQ ID NO: 140805 - protein, 10 aa, Homo Sapiens
FSDIQTGRVL

SEQ ID NO: 140806 - protein, 10 aa, Homo Sapiens
FSFGGKLVTF

SEQ ID NO: 140807 - protein, 10 aa, Homo Sapiens
FSINAQRNAL

SEQ ID NO: 140808 - protein, 10 aa, Homo Sapiens
FSLEYPTISL

SEQ ID NO: 140809 - protein, 10 aa, Homo Sapiens
FSVPDVPKSM

SEQ ID NO: 140810 - protein, 10 aa, Homo Sapiens
FSVPPTEETL

SEQ ID NO: 140811 - protein, 10 aa, Homo Sapiens
FSYQGRASSL

SEQ ID NO: 140812 - protein, 10 aa, Homo Sapiens
FTQPSRLLSL

SEQ ID NO: 140813 - protein, 10 aa, Homo Sapiens
FTSSLPKYPL

SEQ ID NO: 140814 - protein, 10 aa, Homo Sapiens
FVAPPGNISL

SEQ ID NO: 140815 - protein, 10 aa, Homo Sapiens
FVAPWNSLSL

SEQ ID NO: 140816 - protein, 10 aa, Homo Sapiens
FVDPNGKISL

SEQ ID NO: 140817 - protein, 10 aa, Homo Sapiens
FVEDTECRTL

SEQ ID NO: 140818 - protein, 10 aa, Homo Sapiens
FVLPATPPQL

SEQ ID NO: 140819 - protein, 10 aa, Homo Sapiens
FVMEGEPPKL

SEQ ID NO: 140820 - protein, 10 aa, Homo Sapiens
FVPPQGSPTM

SEQ ID NO: 140821 - protein, 10 aa, Homo Sapiens
FVSAGIQTSF

SEQ ID NO: 140822 - protein, 10 aa, Homo Sapiens
GAIGGTPPAF

SEQ ID NO: 140823 - protein, 10 aa, Homo Sapiens
GPPGTGKTLI

SEQ ID NO: 140824 - protein, 10 aa, Homo Sapiens
GPPPPPGKPQ

SEQ ID NO: 140825 - protein, 10 aa, Homo Sapiens
HAAEYGAEAL

SEQ ID NO: 140826 - protein, 10 aa, Homo Sapiens
HAIDRVTTSV

SEQ ID NO: 140827 - protein, 10 aa, Homo Sapiens
HALPPSLIPL

SEQ ID NO: 140828 - protein, 10 aa, Homo Sapiens
HIYDNQGIEL

SEQ ID NO: 140829 - protein, 10 aa, Homo Sapiens
IADNHTPKEL

SEQ ID NO: 140830 - protein, 10 aa, Homo Sapiens
IAISRTPVLM

SEQ ID NO: 140831 - protein, 10 aa, Homo Sapiens
IAVDPRHLSL

SEQ ID NO: 140832 - protein, 10 aa, Homo Sapiens
IAVPAVLPSF

SEQ ID NO: 140833 - protein, 10 aa, Homo Sapiens
ISIEGNKMPL

SEQ ID NO: 140834 - protein, 10 aa, Homo Sapiens
ISNGELFQVL

SEQ ID NO: 140835 - protein, 10 aa, Homo Sapiens
KAVDPSSVAL

SEQ ID NO: 140836 - protein, 10 aa, Homo Sapiens
KGIDYDFPSL

SEQ ID NO: 140837 - protein, 10 aa, Homo Sapiens
KITPLEIEVL

SEQ ID NO: 140838 - protein, 10 aa, Homo Sapiens
KLPEYNPRTL

SEQ ID NO: 140839 - protein, 10 aa, Homo Sapiens
LAAAGLGGVA

SEQ ID NO: 140840 - protein, 10 aa, Homo Sapiens
LAAPATRAAL

SEQ ID NO: 140841 - protein, 10 aa, Homo Sapiens
LAAPGHPPVL

SEQ ID NO: 140842 - protein, 10 aa, Homo Sapiens
LAAPNGAEPL

SEQ ID NO: 140843 - protein, 10 aa, Homo Sapiens
LAEEGTAKLI

SEQ ID NO: 140844 - protein, 10 aa, Homo Sapiens
LAFDPSGQRL

SEQ ID NO: 140845 - protein, 10 aa, Homo Sapiens
LAFSNDGTTL

SEQ ID NO: 140846 - protein, 10 aa, Homo Sapiens
LAHIYTELQL

SEQ ID NO: 140847 - protein, 10 aa, Homo Sapiens
LALGAPSPTV

SEQ ID NO: 140848 - protein, 10 aa, Homo Sapiens
LALPGKPPFL

SEQ ID NO: 140849 - protein, 10 aa, Homo Sapiens
LAMGVNLTSM

SEQ ID NO: 140850 - protein, 10 aa, Homo Sapiens
LASNPGMANL

SEQ ID NO: 140851 - protein, 10 aa, Homo Sapiens
LASPLDPQAL

SEQ ID NO: 140852 - protein, 10 aa, Homo Sapiens
LATDFIQSLL

SEQ ID NO: 140853 - protein, 10 aa, Homo Sapiens
LAVDPNGAFL

SEQ ID NO: 140854 - protein, 10 aa, Homo Sapiens
LAVDPNGIYL

SEQ ID NO: 140855 - protein, 10 aa, Homo Sapiens
LAVEHDNISL

SEQ ID NO: 140856 - protein, 10 aa, Homo Sapiens
LAVHPPGVSK

SEQ ID NO: 140857 - protein, 10 aa, Homo Sapiens
LAVHPSGVAL

SEQ ID NO: 140858 - protein, 10 aa, Homo Sapiens
LAYPARPAQL

SEQ ID NO: 140859 - protein, 10 aa, Homo Sapiens
LAYSGKLEEL

SEQ ID NO: 140860 - protein, 10 aa, Homo Sapiens
LDIEIATYRK

SEQ ID NO: 140861 - protein, 10 aa, Homo Sapiens
LGIPYAQPPL

SEQ ID NO: 140862 - protein, 10 aa, Homo Sapiens
LLDPNIYRTM

SEQ ID NO: 140863 - protein, 10 aa, Homo Sapiens
LLESGTLGTK

SEQ ID NO: 140864 - protein, 10 aa, Homo Sapiens
LQPPKPLSSL

SEQ ID NO: 140865 - protein, 10 aa, Homo Sapiens
LSFETTEESL

SEQ ID NO: 140866 - protein, 10 aa, Homo Sapiens
LSSPFPSSSF

SEQ ID NO: 140867 - protein, 10 aa, Homo Sapiens
LVHPNPPSVL

SEQ ID NO: 140868 - protein, 10 aa, Homo Sapiens
LVVPVGGLSF

SEQ ID NO: 140869 - protein, 10 aa, Homo Sapiens
MAALPFTKSL

SEQ ID NO: 140870 - protein, 10 aa, Homo Sapiens
MAIAPNVTVM

SEQ ID NO: 140871 - protein, 10 aa, Homo Sapiens
MAYGASFLSF

SEQ ID NO: 140872 - protein, 10 aa, Homo Sapiens
MAYHGLTVPL

SEQ ID NO: 140873 - protein, 10 aa, Homo Sapiens
MMPPMGGPPM

SEQ ID NO: 140874 - protein, 10 aa, Homo Sapiens
MVPPVQVSPL

SEQ ID NO: 140875 - protein, 10 aa, Homo Sapiens
NAAGVPKQSL

SEQ ID NO: 140876 - protein, 10 aa, Homo Sapiens
NGWGVMVSHR

SEQ ID NO: 140877 - protein, 10 aa, Homo Sapiens
PLELELCPGR

SEQ ID NO: 140878 - protein, 10 aa, Homo Sapiens
QEYEALLNIK

SEQ ID NO: 140879 - protein, 10 aa, Homo Sapiens
RAGGVGLLVL

SEQ ID NO: 140880 - protein, 10 aa, Homo Sapiens
RAMEGELGEL

SEQ ID NO: 140881 - protein, 10 aa, Homo Sapiens
RAVVPSYIPL

SEQ ID NO: 140882 - protein, 10 aa, Homo Sapiens
RLLLPGELAK

SEQ ID NO: 140883 - protein, 10 aa, Homo Sapiens
RVLEKPESLL

SEQ ID NO: 140884 - protein, 10 aa, Homo Sapiens
SAAFPYGGVL

SEQ ID NO: 140885 - protein, 10 aa, Homo Sapiens
SANPANPAIL

SEQ ID NO: 140886 - protein, 10 aa, Homo Sapiens
SAPGPGYAPL

SEQ ID NO: 140887 - protein, 10 aa, Homo Sapiens
SIFETVGSVL

SEQ ID NO: 140888 - protein, 10 aa, Homo Sapiens
SLEVENQSLR

SEQ ID NO: 140889 - protein, 10 aa, Homo Sapiens
STASAVPLAK

SEQ ID NO: 140890 - protein, 10 aa, Homo Sapiens
TLMLPSAVTR

SEQ ID NO: 140891 - protein, 10 aa, Homo Sapiens
TLNPNYCRSK

SEQ ID NO: 140892 - protein, 10 aa, Homo Sapiens
TLSNHQLTHL

SEQ ID NO: 140893 - protein, 10 aa, Homo Sapiens
VAAPPPKNSF

SEQ ID NO: 140894 - protein, 10 aa, Homo Sapiens
VADGIFKAEL

SEQ ID NO: 140895 - protein, 10 aa, Homo Sapiens
VAFLAMLLVL

SEQ ID NO: 140896 - protein, 10 aa, Homo Sapiens
VAMNPTNTVF

SEQ ID NO: 140897 - protein, 10 aa, Homo Sapiens
VAMPGVPAFL

SEQ ID NO: 140898 - protein, 10 aa, Homo Sapiens
VAVPASLLGM

SEQ ID NO: 140899 - protein, 10 aa, Homo Sapiens
VAYPRTGGTL

SEQ ID NO: 140900 - protein, 10 aa, Homo Sapiens
VAYSHDGAFL

SEQ ID NO: 140901 - protein, 10 aa, Homo Sapiens
VEQCEREKEI

SEQ ID NO: 140902 - protein, 10 aa, Homo Sapiens
VFPSIVGRPR

SEQ ID NO: 140903 - protein, 10 aa, Homo Sapiens
VIADPRGNTL

SEQ ID NO: 140904 - protein, 10 aa, Homo Sapiens
VSAAGLVQGL

SEQ ID NO: 140905 - protein, 10 aa, Homo Sapiens
VSIEPNFHSL

SEQ ID NO: 140906 - protein, 10 aa, Homo Sapiens
VVPPFLQPEV

SEQ ID NO: 140907 - protein, 10 aa, Homo Sapiens
WADPTGTRKL

SEQ ID NO: 140908 - protein, 10 aa, Homo Sapiens
WHHTFYNELR

SEQ ID NO: 140909 - protein, 10 aa, Homo Sapiens
YAAKVGVNIL

SEQ ID NO: 140910 - protein, 10 aa, Homo Sapiens
YACRVNHVTL

SEQ ID NO: 140911 - protein, 10 aa, Homo Sapiens
YADPNFVRTF

SEQ ID NO: 140912 - protein, 10 aa, Homo Sapiens
YADPTKRLEL

SEQ ID NO: 140913 - protein, 10 aa, Homo Sapiens
YAFNGTQRFL

SEQ ID NO: 140914 - protein, 10 aa, Homo Sapiens
YAFPKAVSVF

SEQ ID NO: 140915 - protein, 10 aa, Homo Sapiens
YAHPLETLIL

SEQ ID NO: 140916 - protein, 10 aa, Homo Sapiens
YAIENVETNL

SEQ ID NO: 140917 - protein, 10 aa, Homo Sapiens
YAIPTVCVGL

SEQ ID NO: 140918 - protein, 10 aa, Homo Sapiens
YAIVANVESM

SEQ ID NO: 140919 - protein, 10 aa, Homo Sapiens
YALCGFGGVL

SEQ ID NO: 140920 - protein, 10 aa, Homo Sapiens
YALDVRVNSL

SEQ ID NO: 140921 - protein, 10 aa, Homo Sapiens
YALPHAILRL

SEQ ID NO: 140922 - protein, 10 aa, Homo Sapiens
YAMDYSNKAL

SEQ ID NO: 140923 - protein, 10 aa, Homo Sapiens
YAQHSYFGSF

SEQ ID NO: 140924 - protein, 10 aa, Homo Sapiens
YASFIEDNEL

SEQ ID NO: 140925 - protein, 10 aa, Homo Sapiens
YATDVVEAFL

SEQ ID NO: 140926 - protein, 10 aa, Homo Sapiens
YAVDRAITHL

SEQ ID NO: 140927 - protein, 10 aa, Homo Sapiens
YAVEGRDLTL

SEQ ID NO: 140928 - protein, 10 aa, Homo Sapiens
YAVWFGGSML

SEQ ID NO: 140929 - protein, 10 aa, Homo Sapiens
YAYDGKDYIA

SEQ ID NO: 140930 - protein, 10 aa, Homo Sapiens
YCEPPTGVSL

SEQ ID NO: 140931 - protein, 10 aa, Homo Sapiens
YFIAPSGHGL

SEQ ID NO: 140932 - protein, 10 aa, Homo Sapiens
YFIAPTGHSL

SEQ ID NO: 140933 - protein, 10 aa, Homo Sapiens
YFIPATGHSL

SEQ ID NO: 140934 - protein, 10 aa, Homo Sapiens
YFISPTGHSL

SEQ ID NO: 140935 - protein, 10 aa, Homo Sapiens
YFITPTGHSL

SEQ ID NO: 140936 - protein, 10 aa, Homo Sapiens
YGPPGTGKTL

SEQ ID NO: 140937 - protein, 10 aa, Homo Sapiens
YIAEPSMHSM

SEQ ID NO: 140938 - protein, 10 aa, Homo Sapiens
YISPFHDIPI

SEQ ID NO: 140939 - protein, 10 aa, Homo Sapiens
YLDPRITVAW

SEQ ID NO: 140940 - protein, 10 aa, Homo Sapiens
YQDPSFHLSL

SEQ ID NO: 140941 - protein, 10 aa, Homo Sapiens
YSWVGRPLLD

SEQ ID NO: 140942 - protein, 10 aa, Homo Sapiens
YTYESKMAFL

SEQ ID NO: 140943 - protein, 10 aa, Homo Sapiens
YVFDGKPPQL

SEQ ID NO: 140944 - protein, 10 aa, Homo Sapiens
YVIEPHSMEF

SEQ ID NO: 140945 - protein, 10 aa, Homo Sapiens
YVIGPKGNSL

SEQ ID NO: 140946 - protein, 10 aa, Homo Sapiens
YVIPHPVHAF

SEQ ID NO: 140947 - protein, 11 aa, Homo Sapiens
AAAPPSPPFSF

SEQ ID NO: 140948 - protein, 11 aa, Homo Sapiens
AAFLAKDFNFL

SEQ ID NO: 140949 - protein, 11 aa, Homo Sapiens
AAFQPNQYQML

SEQ ID NO: 140950 - protein, 11 aa, Homo Sapiens
AAFTADPLSLL

SEQ ID NO: 140951 - protein, 11 aa, Homo Sapiens
AAIDARIFHEL

SEQ ID NO: 140952 - protein, 11 aa, Homo Sapiens
AALLKYNEAVK

SEQ ID NO: 140953 - protein, 11 aa, Homo Sapiens
AALPAELQREL

SEQ ID NO: 140954 - protein, 11 aa, Homo Sapiens
AALPDASPGNL

SEQ ID NO: 140955 - protein, 11 aa, Homo Sapiens
AAMASLGALAL

SEQ ID NO: 140956 - protein, 11 aa, Homo Sapiens
AATGATPIAGR

SEQ ID NO: 140957 - protein, 11 aa, Homo Sapiens
AAVVVSKSGSL

SEQ ID NO: 140958 - protein, 11 aa, Homo Sapiens
AAYYPSDVSSL

SEQ ID NO: 140959 - protein, 11 aa, Homo Sapiens
AKTREVLVSHL

SEQ ID NO: 140960 - protein, 11 aa, Homo Sapiens
ALNEANLSNLK

SEQ ID NO: 140961 - protein, 11 aa, Homo Sapiens
ATIDPDTISAL

SEQ ID NO: 140962 - protein, 11 aa, Homo Sapiens
AVVGGLDIHKK

SEQ ID NO: 140963 - protein, 11 aa, Homo Sapiens
CEASLPTVPVL

SEQ ID NO: 140964 - protein, 11 aa, Homo Sapiens
CGLTHTAVVPL

SEQ ID NO: 140965 - protein, 11 aa, Homo Sapiens
CSALLDVSQVD

SEQ ID NO: 140966 - protein, 11 aa, Homo Sapiens
CSLSPDVDPVL

SEQ ID NO: 140967 - protein, 11 aa, Homo Sapiens
CTFIRVSGSEL

SEQ ID NO: 140968 - protein, 11 aa, Homo Sapiens
FAFDSEGNYML

SEQ ID NO: 140969 - protein, 11 aa, Homo Sapiens
FAFEGIGDEDL

SEQ ID NO: 140970 - protein, 11 aa, Homo Sapiens
FAFESDLHSLL

SEQ ID NO: 140971 - protein, 11 aa, Homo Sapiens
FAFQESPPRFL

SEQ ID NO: 140972 - protein, 11 aa, Homo Sapiens
FAHFPGLASEL

SEQ ID NO: 140973 - protein, 11 aa, Homo Sapiens
FAKPVYPGQTL

SEQ ID NO: 140974 - protein, 11 aa, Homo Sapiens
FALAVRKGGAL

SEQ ID NO: 140975 - protein, 11 aa, Homo Sapiens
FALESGGGSIL

SEQ ID NO: 140976 - protein, 11 aa, Homo Sapiens
FALLTGPGSEL

SEQ ID NO: 140977 - protein, 11 aa, Homo Sapiens
FAMNVGKARGF

SEQ ID NO: 140978 - protein, 11 aa, Homo Sapiens
FANTPKYSQVL

SEQ ID NO: 140979 - protein, 11 aa, Homo Sapiens
FASDASAVIEH

SEQ ID NO: 140980 - protein, 11 aa, Homo Sapiens
FAVDNVGNRTL

SEQ ID NO: 140981 - protein, 11 aa, Homo Sapiens
FAVESEHDQAM

SEQ ID NO: 140982 - protein, 11 aa, Homo Sapiens
FAVEVGPKSTM

SEQ ID NO: 140983 - protein, 11 aa, Homo Sapiens
FAVPIESDKTL

SEQ ID NO: 140984 - protein, 11 aa, Homo Sapiens
FAVPPALGSNL

SEQ ID NO: 140985 - protein, 11 aa, Homo Sapiens
FAVVARGTTIL

SEQ ID NO: 140986 - protein, 11 aa, Homo Sapiens
FAVVATGETAL

SEQ ID NO: 140987 - protein, 11 aa, Homo Sapiens
FAWCPDGEHIL

SEQ ID NO: 140988 - protein, 11 aa, Homo Sapiens
FAWEPFRGLEL

SEQ ID NO: 140989 - protein, 11 aa, Homo Sapiens
FAYDGKDYLTL

SEQ ID NO: 140990 - protein, 11 aa, Homo Sapiens
FAYDPSNYEYL

SEQ ID NO: 140991 - protein, 11 aa, Homo Sapiens
FAYTGRTAQEL

SEQ ID NO: 140992 - protein, 11 aa, Homo Sapiens
FGISSVPTKGL

SEQ ID NO: 140993 - protein, 11 aa, Homo Sapiens
FILDPNQENVL

SEQ ID NO: 140994 - protein, 11 aa, Homo Sapiens
FLFKVRESGSL

SEQ ID NO: 140995 - protein, 11 aa, Homo Sapiens
FLWDVPSNWTL

SEQ ID NO: 140996 - protein, 11 aa, Homo Sapiens
FQFSSEKQQAL

SEQ ID NO: 140997 - protein, 11 aa, Homo Sapiens
FSDDPNVTKTL

SEQ ID NO: 140998 - protein, 11 aa, Homo Sapiens
FSIDVGYERFL

SEQ ID NO: 140999 - protein, 11 aa, Homo Sapiens
FSLPENIQLSL

SEQ ID NO: 141000 - protein, 11 aa, Homo Sapiens
FTEPGAGLRAL

SEQ ID NO: 141001 - protein, 11 aa, Homo Sapiens
FYLPLDAIKQL

SEQ ID NO: 141002 - protein, 11 aa, Homo Sapiens
GADDRIREFSL

SEQ ID NO: 141003 - protein, 11 aa, Homo Sapiens
GFMCQGGDFTR

SEQ ID NO: 141004 - protein, 11 aa, Homo Sapiens
GGFEITPPVVL

SEQ ID NO: 141005 - protein, 11 aa, Homo Sapiens
GIHETTFNSIM

SEQ ID NO: 141006 - protein, 11 aa, Homo Sapiens
GPPPPPPGKPQ

SEQ ID NO: 141007 - protein, 11 aa, Homo Sapiens
GVVDPRAISVL

SEQ ID NO: 141008 - protein, 11 aa, Homo Sapiens
HAYDGKDYISL

SEQ ID NO: 141009 - protein, 11 aa, Homo Sapiens
HSAPFSTQIPL

SEQ ID NO: 141010 - protein, 11 aa, Homo Sapiens
HTIFASNTSSL

SEQ ID NO: 141011 - protein, 11 aa, Homo Sapiens
IAIKQTPELTL

SEQ ID NO: 141012 - protein, 11 aa, Homo Sapiens
IALDPDTMQAL

SEQ ID NO: 141013 - protein, 11 aa, Homo Sapiens
IAQVPRPGTSL

SEQ ID NO: 141014 - protein, 11 aa, Homo Sapiens
IIHDPGRGAPL

SEQ ID NO: 141015 - protein, 11 aa, Homo Sapiens
IIMEPTECSEL

SEQ ID NO: 141016 - protein, 11 aa, Homo Sapiens
ISPLSASAMIL

SEQ ID NO: 141017 - protein, 11 aa, Homo Sapiens
ITAYLSANITF

SEQ ID NO: 141018 - protein, 11 aa, Homo Sapiens
KSISNPPGSNL

SEQ ID NO: 141019 - protein, 11 aa, Homo Sapiens
LAAEGRLESAL

SEQ ID NO: 141020 - protein, 11 aa, Homo Sapiens
LADCYDAIAVF

SEQ ID NO: 141021 - protein, 11 aa, Homo Sapiens
LADPTERFRSL

SEQ ID NO: 141022 - protein, 11 aa, Homo Sapiens
LALDASQHSSL

SEQ ID NO: 141023 - protein, 11 aa, Homo Sapiens
LATDFIQSLLV

SEQ ID NO: 141024 - protein, 11 aa, Homo Sapiens
LAVDPNRAVPL

SEQ ID NO: 141025 - protein, 11 aa, Homo Sapiens
LAYLGAKPRSL

SEQ ID NO: 141026 - protein, 11 aa, Homo Sapiens
LAYLSTAVGCL

SEQ ID NO: 141027 - protein, 11 aa, Homo Sapiens
LDNISFPKQGS

SEQ ID NO: 141028 - protein, 11 aa, Homo Sapiens
MSIYPSPTGVL

SEQ ID NO: 141029 - protein, 11 aa, Homo Sapiens
MSMEISIHRSL

SEQ ID NO: 141030 - protein, 11 aa, Homo Sapiens
NALKPGFFSHL

SEQ ID NO: 141031 - protein, 11 aa, Homo Sapiens
NDISNLIASEI

SEQ ID NO: 141032 - protein, 11 aa, Homo Sapiens
NLTHLNLSGNK

SEQ ID NO: 141033 - protein, 11 aa, Homo Sapiens
PMFIVNTNVPR

SEQ ID NO: 141034 - protein, 11 aa, Homo Sapiens
RAAPLDSIHSL

SEQ ID NO: 141035 - protein, 11 aa, Homo Sapiens
RAFEVSENGNL

SEQ ID NO: 141036 - protein, 11 aa, Homo Sapiens
SAVCSGLAHAL

SEQ ID NO: 141037 - protein, 11 aa, Homo Sapiens
SIICPGYNAVL

SEQ ID NO: 141038 - protein, 11 aa, Homo Sapiens
SIISPKVKMAL

SEQ ID NO: 141039 - protein, 11 aa, Homo Sapiens
SVTQAECSGVI

SEQ ID NO: 141040 - protein, 11 aa, Homo Sapiens
TAIPVHDGYVL

SEQ ID NO: 141041 - protein, 11 aa, Homo Sapiens
TAISISDHTAL

SEQ ID NO: 141042 - protein, 11 aa, Homo Sapiens
TYAFSGTHYWR

SEQ ID NO: 141043 - protein, 11 aa, Homo Sapiens
VAAPPTAVGSL

SEQ ID NO: 141044 - protein, 11 aa, Homo Sapiens
VAFPSGDASSL

SEQ ID NO: 141045 - protein, 11 aa, Homo Sapiens
VAILIHFLPAK

SEQ ID NO: 141046 - protein, 11 aa, Homo Sapiens
VAMAAGPSGCL

SEQ ID NO: 141047 - protein, 11 aa, Homo Sapiens
VAVDPSILARL

SEQ ID NO: 141048 - protein, 11 aa, Homo Sapiens
VAVHPSTVNPL

SEQ ID NO: 141049 - protein, 11 aa, Homo Sapiens
VAYPHDGKIFF

SEQ ID NO: 141050 - protein, 11 aa, Homo Sapiens
VAYRPISASVL

SEQ ID NO: 141051 - protein, 11 aa, Homo Sapiens
VAYWRQAGLSY

SEQ ID NO: 141052 - protein, 11 aa, Homo Sapiens
WAICPRDSLAL

SEQ ID NO: 141053 - protein, 11 aa, Homo Sapiens
WRPSFSEGTDL

SEQ ID NO: 141054 - protein, 11 aa, Homo Sapiens
YAFGQETNVPL

SEQ ID NO: 141055 - protein, 11 aa, Homo Sapiens
YAFQTEGKLYL

SEQ ID NO: 141056 - protein, 11 aa, Homo Sapiens
YAFRSAEPNAL

SEQ ID NO: 141057 - protein, 11 aa, Homo Sapiens
YAIGVSHPLSI

SEQ ID NO: 141058 - protein, 11 aa, Homo Sapiens
YAISPGLDITF

SEQ ID NO: 141059 - protein, 11 aa, Homo Sapiens
YALCGFGGVLS

SEQ ID NO: 141060 - protein, 11 aa, Homo Sapiens
YAMEQSIKSVL

SEQ ID NO: 141061 - protein, 11 aa, Homo Sapiens
YAVDAYFREAL

SEQ ID NO: 141062 - protein, 11 aa, Homo Sapiens
YAYDGKDYIAL

SEQ ID NO: 141063 - protein, 11 aa, Homo Sapiens
YAYETKDALCL

SEQ ID NO: 141064 - protein, 11 aa, Homo Sapiens
YAYPATAAAPM

SEQ ID NO: 141065 - protein, 11 aa, Homo Sapiens
YGAEALERMFL

SEQ ID NO: 141066 - protein, 11 aa, Homo Sapiens
YGLLPSHASYL

SEQ ID NO: 141067 - protein, 11 aa, Homo Sapiens
YIIGGSVINEL

SEQ ID NO: 141068 - protein, 11 aa, Homo Sapiens
YIMEPSIFNTL

SEQ ID NO: 141069 - protein, 11 aa, Homo Sapiens
YISVPKENSTL

SEQ ID NO: 141070 - protein, 11 aa, Homo Sapiens
YLHDQNPDAAL

SEQ ID NO: 141071 - protein, 11 aa, Homo Sapiens
YSHPVVSSVPL

SEQ ID NO: 141072 - protein, 11 aa, Homo Sapiens
YSLPTSFSGSF

SEQ ID NO: 141073 - protein, 11 aa, Homo Sapiens
YSYPAAVPQAL

SEQ ID NO: 141074 - protein, 11 aa, Homo Sapiens
YTLSPENLQSL

SEQ ID NO: 141075 - protein, 8 aa, Homo Sapiens
AAAPHLLL

SEQ ID NO: 141076 - protein, 8 aa, Homo Sapiens
AAAPPLTL

SEQ ID NO: 141077 - protein, 8 aa, Homo Sapiens
AAAVGLEL

SEQ ID NO: 141078 - protein, 8 aa, Homo Sapiens
AAAWPLLL

SEQ ID NO: 141079 - protein, 8 aa, Homo Sapiens
AAFPGASL

SEQ ID NO: 141080 - protein, 8 aa, Homo Sapiens
AAGPGFSL

SEQ ID NO: 141081 - protein, 8 aa, Homo Sapiens
AAGRPLEL

SEQ ID NO: 141082 - protein, 8 aa, Homo Sapiens
AAIKALEL

SEQ ID NO: 141083 - protein, 8 aa, Homo Sapiens
AASHPLLL

SEQ ID NO: 141084 - protein, 8 aa, Homo Sapiens
AFAEALLL

SEQ ID NO: 141085 - protein, 8 aa, Homo Sapiens
AFVTGYDI

SEQ ID NO: 141086 - protein, 8 aa, Homo Sapiens
AIIPSKKL

SEQ ID NO: 141087 - protein, 8 aa, Homo Sapiens
ASYVSPVL

SEQ ID NO: 141088 - protein, 8 aa, Homo Sapiens
AVGPASIL

SEQ ID NO: 141089 - protein, 8 aa, Homo Sapiens
AYIAHPKL

SEQ ID NO: 141090 - protein, 8 aa, Homo Sapiens
FAAEAIAL

SEQ ID NO: 141091 - protein, 8 aa, Homo Sapiens
FAAEAIAM

SEQ ID NO: 141092 - protein, 8 aa, Homo Sapiens
FAAETLVL

SEQ ID NO: 141093 - protein, 8 aa, Homo Sapiens
FAARPVLL

SEQ ID NO: 141094 - protein, 8 aa, Homo Sapiens
FAFSSQEL

SEQ ID NO: 141095 - protein, 8 aa, Homo Sapiens
FAGFGIGL

SEQ ID NO: 141096 - protein, 8 aa, Homo Sapiens
FAGKVLRL

SEQ ID NO: 141097 - protein, 8 aa, Homo Sapiens
FAGLVQEI

SEQ ID NO: 141098 - protein, 8 aa, Homo Sapiens
FAGMPITL

SEQ ID NO: 141099 - protein, 8 aa, Homo Sapiens
FAGQPLTI

SEQ ID NO: 141100 - protein, 8 aa, Homo Sapiens
FAGWGRAL

SEQ ID NO: 141101 - protein, 8 aa, Homo Sapiens
FAHSFIEL

SEQ ID NO: 141102 - protein, 8 aa, Homo Sapiens
FAHWGQEL

SEQ ID NO: 141103 - protein, 8 aa, Homo Sapiens
FAIDPHLL

SEQ ID NO: 141104 - protein, 8 aa, Homo Sapiens
FALNHPEL

SEQ ID NO: 141105 - protein, 8 aa, Homo Sapiens
FASGAVEL

SEQ ID NO: 141106 - protein, 8 aa, Homo Sapiens
FAVAGQEL

SEQ ID NO: 141107 - protein, 8 aa, Homo Sapiens
FAWGHDEL

SEQ ID NO: 141108 - protein, 8 aa, Homo Sapiens
FAWKPQLL

SEQ ID NO: 141109 - protein, 8 aa, Homo Sapiens
FFLIGPPL

SEQ ID NO: 141110 - protein, 8 aa, Homo Sapiens
FFQVGSDL

SEQ ID NO: 141111 - protein, 8 aa, Homo Sapiens
FFWPGIDL

SEQ ID NO: 141112 - protein, 8 aa, Homo Sapiens
FIGYPITL

SEQ ID NO: 141113 - protein, 8 aa, Homo Sapiens
FITDPVVL

SEQ ID NO: 141114 - protein, 8 aa, Homo Sapiens
FIYNDPTL

SEQ ID NO: 141115 - protein, 8 aa, Homo Sapiens
FIYVNQSF

SEQ ID NO: 141116 - protein, 8 aa, Homo Sapiens
FLAPSLVL

SEQ ID NO: 141117 - protein, 8 aa, Homo Sapiens
FNFVGKIL

SEQ ID NO: 141118 - protein, 8 aa, Homo Sapiens
FNFVGRIL

SEQ ID NO: 141119 - protein, 8 aa, Homo Sapiens
FNHINVEL

SEQ ID NO: 141120 - protein, 8 aa, Homo Sapiens
FQHVGKAF

SEQ ID NO: 141121 - protein, 8 aa, Homo Sapiens
FSAHALKL

SEQ ID NO: 141122 - protein, 8 aa, Homo Sapiens
FSANPKEL

SEQ ID NO: 141123 - protein, 8 aa, Homo Sapiens
FSFDGPEI

SEQ ID NO: 141124 - protein, 8 aa, Homo Sapiens
FSFEGPEI

SEQ ID NO: 141125 - protein, 8 aa, Homo Sapiens
FSFVMPSL

SEQ ID NO: 141126 - protein, 8 aa, Homo Sapiens
FSGPAITL

SEQ ID NO: 141127 - protein, 8 aa, Homo Sapiens
FSGRILGL

SEQ ID NO: 141128 - protein, 8 aa, Homo Sapiens
FSHVAMIL

SEQ ID NO: 141129 - protein, 8 aa, Homo Sapiens
FSHVGWLL

SEQ ID NO: 141130 - protein, 8 aa, Homo Sapiens
FSSNPISL

SEQ ID NO: 141131 - protein, 8 aa, Homo Sapiens
FSVNGKVL

SEQ ID NO: 141132 - protein, 8 aa, Homo Sapiens
FSVTGRVL

SEQ ID NO: 141133 - protein, 8 aa, Homo Sapiens
FSVTGTSL

SEQ ID NO: 141134 - protein, 8 aa, Homo Sapiens
FSYAGFEM

SEQ ID NO: 141135 - protein, 8 aa, Homo Sapiens
FTADPLSL

SEQ ID NO: 141136 - protein, 8 aa, Homo Sapiens
FTFPSHSL

SEQ ID NO: 141137 - protein, 8 aa, Homo Sapiens
FTHASPTL

SEQ ID NO: 141138 - protein, 8 aa, Homo Sapiens
FTIVAESL

SEQ ID NO: 141139 - protein, 8 aa, Homo Sapiens
FTMGGPAI

SEQ ID NO: 141140 - protein, 8 aa, Homo Sapiens
FTMVGKTF

SEQ ID NO: 141141 - protein, 8 aa, Homo Sapiens
FTQQGPRL

SEQ ID NO: 141142 - protein, 8 aa, Homo Sapiens
FTTDAIAL

SEQ ID NO: 141143 - protein, 8 aa, Homo Sapiens
FTYEAVEL

SEQ ID NO: 141144 - protein, 8 aa, Homo Sapiens
FVAPPLVM

SEQ ID NO: 141145 - protein, 8 aa, Homo Sapiens
FVGPSRYL

SEQ ID NO: 141146 - protein, 8 aa, Homo Sapiens
FVGYGVTL

SEQ ID NO: 141147 - protein, 8 aa, Homo Sapiens
FVNVQKEL

SEQ ID NO: 141148 - protein, 8 aa, Homo Sapiens
FVVTGPAL

SEQ ID NO: 141149 - protein, 8 aa, Homo Sapiens
HAAEALLL

SEQ ID NO: 141150 - protein, 8 aa, Homo Sapiens
HSHVALAL

SEQ ID NO: 141151 - protein, 8 aa, Homo Sapiens
HTGPITCL

SEQ ID NO: 141152 - protein, 8 aa, Homo Sapiens
IAAIAQEL

SEQ ID NO: 141153 - protein, 8 aa, Homo Sapiens
IADLAHLL

SEQ ID NO: 141154 - protein, 8 aa, Homo Sapiens
IAGPVVEI

SEQ ID NO: 141155 - protein, 8 aa, Homo Sapiens
IAVNPSIL

SEQ ID NO: 141156 - protein, 8 aa, Homo Sapiens
IIAPSLGF

SEQ ID NO: 141157 - protein, 8 aa, Homo Sapiens
ILGPTFTL

SEQ ID NO: 141158 - protein, 8 aa, Homo Sapiens
ISFSGMSL

SEQ ID NO: 141159 - protein, 8 aa, Homo Sapiens
ISILGKSL

SEQ ID NO: 141160 - protein, 8 aa, Homo Sapiens
ISLEGKPL

SEQ ID NO: 141161 - protein, 8 aa, Homo Sapiens
ISYPGAML

SEQ ID NO: 141162 - protein, 8 aa, Homo Sapiens
ITAPSYVL

SEQ ID NO: 141163 - protein, 8 aa, Homo Sapiens
ITFVNKHL

SEQ ID NO: 141164 - protein, 8 aa, Homo Sapiens
IVFSGSSL

SEQ ID NO: 141165 - protein, 8 aa, Homo Sapiens
IVVEGHEL

SEQ ID NO: 141166 - protein, 8 aa, Homo Sapiens
LAAIAMQL

SEQ ID NO: 141167 - protein, 8 aa, Homo Sapiens
LAAIATEL

SEQ ID NO: 141168 - protein, 8 aa, Homo Sapiens
LADQPHLL

SEQ ID NO: 141169 - protein, 8 aa, Homo Sapiens
LAEVGRVL

SEQ ID NO: 141170 - protein, 8 aa, Homo Sapiens
LAFPGETL

SEQ ID NO: 141171 - protein, 8 aa, Homo Sapiens
LAFVSPSL

SEQ ID NO: 141172 - protein, 8 aa, Homo Sapiens
LAGPALEL

SEQ ID NO: 141173 - protein, 8 aa, Homo Sapiens
LAGPPLEI

SEQ ID NO: 141174 - protein, 8 aa, Homo Sapiens
LAGPVLGL

SEQ ID NO: 141175 - protein, 8 aa, Homo Sapiens
LAHVGPRL

SEQ ID NO: 141176 - protein, 8 aa, Homo Sapiens
LANVSTVL

SEQ ID NO: 141177 - protein, 8 aa, Homo Sapiens
LAWTSSAL

SEQ ID NO: 141178 - protein, 8 aa, Homo Sapiens
LFFVGNQL

SEQ ID NO: 141179 - protein, 8 aa, Homo Sapiens
LGGPPLLL

SEQ ID NO: 141180 - protein, 8 aa, Homo Sapiens
LGIVGPVL

SEQ ID NO: 141181 - protein, 8 aa, Homo Sapiens
LIGPPLLI

SEQ ID NO: 141182 - protein, 8 aa, Homo Sapiens
LIYQGRVL

SEQ ID NO: 141183 - protein, 8 aa, Homo Sapiens
LLGPTVML

SEQ ID NO: 141184 - protein, 8 aa, Homo Sapiens
LLWPGAAL

SEQ ID NO: 141185 - protein, 8 aa, Homo Sapiens
LPSHPLEL

SEQ ID NO: 141186 - protein, 8 aa, Homo Sapiens
LQGPILRL

SEQ ID NO: 141187 - protein, 8 aa, Homo Sapiens
LQKIGPIL

SEQ ID NO: 141188 - protein, 8 aa, Homo Sapiens
LQYSAILT

SEQ ID NO: 141189 - protein, 8 aa, Homo Sapiens
LSFTSQEL

SEQ ID NO: 141190 - protein, 8 aa, Homo Sapiens
LSWPGLAV

SEQ ID NO: 141191 - protein, 8 aa, Homo Sapiens
LTALGPEL

SEQ ID NO: 141192 - protein, 8 aa, Homo Sapiens
LTFVDPVL

SEQ ID NO: 141193 - protein, 8 aa, Homo Sapiens
LTGPVLEL

SEQ ID NO: 141194 - protein, 8 aa, Homo Sapiens
LVGPGVEL

SEQ ID NO: 141195 - protein, 8 aa, Homo Sapiens
MALLGHSL

SEQ ID NO: 141196 - protein, 8 aa, Homo Sapiens
MALLGQAL

SEQ ID NO: 141197 - protein, 8 aa, Homo Sapiens
MAYNAPSL

SEQ ID NO: 141198 - protein, 8 aa, Homo Sapiens
MGHLGVVL

SEQ ID NO: 141199 - protein, 8 aa, Homo Sapiens
MIHLGHIL

SEQ ID NO: 141200 - protein, 8 aa, Homo Sapiens
MTYVGAVF

SEQ ID NO: 141201 - protein, 8 aa, Homo Sapiens
MVGPILEM

SEQ ID NO: 141202 - protein, 8 aa, Homo Sapiens
NAGPAIVI

SEQ ID NO: 141203 - protein, 8 aa, Homo Sapiens
NAYTGIVL

SEQ ID NO: 141204 - protein, 8 aa, Homo Sapiens
QAAPPIEL

SEQ ID NO: 141205 - protein, 8 aa, Homo Sapiens
QMAFQILL

SEQ ID NO: 141206 - protein, 8 aa, Homo Sapiens
QTPPISSL

SEQ ID NO: 141207 - protein, 8 aa, Homo Sapiens
RAHIGPVL

SEQ ID NO: 141208 - protein, 8 aa, Homo Sapiens
SAAPAIQL

SEQ ID NO: 141209 - protein, 8 aa, Homo Sapiens
SAAPAIYL

SEQ ID NO: 141210 - protein, 8 aa, Homo Sapiens
SANIGPFL

SEQ ID NO: 141211 - protein, 8 aa, Homo Sapiens
TAAHGLEL

SEQ ID NO: 141212 - protein, 8 aa, Homo Sapiens
TAAPDLKL

SEQ ID NO: 141213 - protein, 8 aa, Homo Sapiens
TAFIGPAL

SEQ ID NO: 141214 - protein, 8 aa, Homo Sapiens
TAGRVLEL

SEQ ID NO: 141215 - protein, 8 aa, Homo Sapiens
TAIVGMAL

SEQ ID NO: 141216 - protein, 8 aa, Homo Sapiens
TASEPLTL

SEQ ID NO: 141217 - protein, 8 aa, Homo Sapiens
TGWTGIAL

SEQ ID NO: 141218 - protein, 8 aa, Homo Sapiens
TIAPTLIA

SEQ ID NO: 141219 - protein, 8 aa, Homo Sapiens
TSYVGLVL

SEQ ID NO: 141220 - protein, 8 aa, Homo Sapiens
VADLAHVL

SEQ ID NO: 141221 - protein, 8 aa, Homo Sapiens
VATTALEL

SEQ ID NO: 141222 - protein, 8 aa, Homo Sapiens
VAVTPFSL

SEQ ID NO: 141223 - protein, 8 aa, Homo Sapiens
VAYEAPSL

SEQ ID NO: 141224 - protein, 8 aa, Homo Sapiens
VIGPPVVL

SEQ ID NO: 141225 - protein, 8 aa, Homo Sapiens
VIIKPSEL

SEQ ID NO: 141226 - protein, 8 aa, Homo Sapiens
VSGPAMTL

SEQ ID NO: 141227 - protein, 8 aa, Homo Sapiens
VSIVGMAL

SEQ ID NO: 141228 - protein, 8 aa, Homo Sapiens
VSMSPRVY

SEQ ID NO: 141229 - protein, 8 aa, Homo Sapiens
VSQVGKEL

SEQ ID NO: 141230 - protein, 8 aa, Homo Sapiens
VVFVGNFL

SEQ ID NO: 141231 - protein, 8 aa, Homo Sapiens
VVGPNITL

SEQ ID NO: 141232 - protein, 8 aa, Homo Sapiens
VVGPSSVL

SEQ ID NO: 141233 - protein, 8 aa, Homo Sapiens
YAEGVRVL

SEQ ID NO: 141234 - protein, 8 aa, Homo Sapiens
YAFEGSYL

SEQ ID NO: 141235 - protein, 8 aa, Homo Sapiens
YAFLHRTL

SEQ ID NO: 141236 - protein, 8 aa, Homo Sapiens
YAFSARPL

SEQ ID NO: 141237 - protein, 8 aa, Homo Sapiens
YAGPGLSL

SEQ ID NO: 141238 - protein, 8 aa, Homo Sapiens
YAIEAIKL

SEQ ID NO: 141239 - protein, 8 aa, Homo Sapiens
YASRFIVI

SEQ ID NO: 141240 - protein, 8 aa, Homo Sapiens
YATYPREL

SEQ ID NO: 141241 - protein, 8 aa, Homo Sapiens
YFFVDPDL

SEQ ID NO: 141242 - protein, 8 aa, Homo Sapiens
YFNEGTVL

SEQ ID NO: 141243 - protein, 8 aa, Homo Sapiens
YGFVNHAL

SEQ ID NO: 141244 - protein, 8 aa, Homo Sapiens
YIFPGVAL

SEQ ID NO: 141245 - protein, 8 aa, Homo Sapiens
YIHVGAQL

SEQ ID NO: 141246 - protein, 8 aa, Homo Sapiens
YILTSKEL

SEQ ID NO: 141247 - protein, 8 aa, Homo Sapiens
YINLGNVL

SEQ ID NO: 141248 - protein, 8 aa, Homo Sapiens
YLGKVLEL

SEQ ID NO: 141249 - protein, 8 aa, Homo Sapiens
YLNLGPAL

SEQ ID NO: 141250 - protein, 8 aa, Homo Sapiens
YLYVGPSL

SEQ ID NO: 141251 - protein, 8 aa, Homo Sapiens
YSFDGPSL

SEQ ID NO: 141252 - protein, 8 aa, Homo Sapiens
YSIVGQKL

SEQ ID NO: 141253 - protein, 8 aa, Homo Sapiens
YSLDMWRL

SEQ ID NO: 141254 - protein, 8 aa, Homo Sapiens
YSLPGVAL

SEQ ID NO: 141255 - protein, 8 aa, Homo Sapiens
YSWLGETL

SEQ ID NO: 141256 - protein, 8 aa, Homo Sapiens
YTAEPVTL

SEQ ID NO: 141257 - protein, 8 aa, Homo Sapiens
YTNLGPRL

SEQ ID NO: 141258 - protein, 8 aa, Homo Sapiens
YTYIGEVL

SEQ ID NO: 141259 - protein, 8 aa, Homo Sapiens
YTYIGPVL

SEQ ID NO: 141260 - protein, 8 aa, Homo Sapiens
YVGPAKVI

SEQ ID NO: 141261 - protein, 8 aa, Homo Sapiens
YVGPSLRM

SEQ ID NO: 141262 - protein, 8 aa, Homo Sapiens
YVSFPLEL

SEQ ID NO: 141263 - protein, 8 aa, Homo Sapiens
YWQNHPEL

SEQ ID NO: 141264 - protein, 8 aa, Homo Sapiens
YYINSPEL

SEQ ID NO: 141265 - protein, 9 aa, Homo Sapiens
AAAAATMAL

SEQ ID NO: 141266 - protein, 9 aa, Homo Sapiens
AAAALHPAL

SEQ ID NO: 141267 - protein, 9 aa, Homo Sapiens
AAAAPPLTL

SEQ ID NO: 141268 - protein, 9 aa, Homo Sapiens
AAAAPSPVL

SEQ ID NO: 141269 - protein, 9 aa, Homo Sapiens
AAADVLEAL

SEQ ID NO: 141270 - protein, 9 aa, Homo Sapiens
AAAGSPLSL

SEQ ID NO: 141271 - protein, 9 aa, Homo Sapiens
AAAHFYFEL

SEQ ID NO: 141272 - protein, 9 aa, Homo Sapiens
AAAIKALEL

SEQ ID NO: 141273 - protein, 9 aa, Homo Sapiens
AAANPTLAF

SEQ ID NO: 141274 - protein, 9 aa, Homo Sapiens
AAAPEYKTL

SEQ ID NO: 141275 - protein, 9 aa, Homo Sapiens
AAAPHLLLL

SEQ ID NO: 141276 - protein, 9 aa, Homo Sapiens
AAAPPSPAW

SEQ ID NO: 141277 - protein, 9 aa, Homo Sapiens
AAAPQSLEF

SEQ ID NO: 141278 - protein, 9 aa, Homo Sapiens
AAAPSLLIL

SEQ ID NO: 141279 - protein, 9 aa, Homo Sapiens
AAASAFTSL

SEQ ID NO: 141280 - protein, 9 aa, Homo Sapiens
AAASHFFNL

SEQ ID NO: 141281 - protein, 9 aa, Homo Sapiens
AAASPLLLL

SEQ ID NO: 141282 - protein, 9 aa, Homo Sapiens
AAATSALLL

SEQ ID NO: 141283 - protein, 9 aa, Homo Sapiens
AAAVPRAAF

SEQ ID NO: 141284 - protein, 9 aa, Homo Sapiens
AADAALRVL

SEQ ID NO: 141285 - protein, 9 aa, Homo Sapiens
AADPQIRQF

SEQ ID NO: 141286 - protein, 9 aa, Homo Sapiens
AADPVSPLL

SEQ ID NO: 141287 - protein, 9 aa, Homo Sapiens
AADWHNLIL

SEQ ID NO: 141288 - protein, 9 aa, Homo Sapiens
AAEDAIRNL

SEQ ID NO: 141289 - protein, 9 aa, Homo Sapiens
AAEEGLREL

SEQ ID NO: 141290 - protein, 9 aa, Homo Sapiens
AAFGKSPEI

SEQ ID NO: 141291 - protein, 9 aa, Homo Sapiens
AAFPYGGVL

SEQ ID NO: 141292 - protein, 9 aa, Homo Sapiens
AAFWGQMQM

SEQ ID NO: 141293 - protein, 9 aa, Homo Sapiens
AAGPRPMAL

SEQ ID NO: 141294 - protein, 9 aa, Homo Sapiens
AAGSHVIIL

SEQ ID NO: 141295 - protein, 9 aa, Homo Sapiens
AAHMPAAAL

SEQ ID NO: 141296 - protein, 9 aa, Homo Sapiens
AAIAAVNAL

SEQ ID NO: 141297 - protein, 9 aa, Homo Sapiens
AAIAFLHAL

SEQ ID NO: 141298 - protein, 9 aa, Homo Sapiens
AAIAPPTSL

SEQ ID NO: 141299 - protein, 9 aa, Homo Sapiens
AAIASLLYL

SEQ ID NO: 141300 - protein, 9 aa, Homo Sapiens
AAIDHQIEV

SEQ ID NO: 141301 - protein, 9 aa, Homo Sapiens
AAIEGNLQL

SEQ ID NO: 141302 - protein, 9 aa, Homo Sapiens
AAIETYNLL

SEQ ID NO: 141303 - protein, 9 aa, Homo Sapiens
AAIFHYLII

SEQ ID NO: 141304 - protein, 9 aa, Homo Sapiens
AAIHPSLEI

SEQ ID NO: 141305 - protein, 9 aa, Homo Sapiens
AAIKAFIAV

SEQ ID NO: 141306 - protein, 9 aa, Homo Sapiens
AAIKPGTPL

SEQ ID NO: 141307 - protein, 9 aa, Homo Sapiens
AAINPNHPL

SEQ ID NO: 141308 - protein, 9 aa, Homo Sapiens
AAINRQINL

SEQ ID NO: 141309 - protein, 9 aa, Homo Sapiens
AAIPYWLLL

SEQ ID NO: 141310 - protein, 9 aa, Homo Sapiens
AAISHFLNC

SEQ ID NO: 141311 - protein, 9 aa, Homo Sapiens
AAISHGRVF

SEQ ID NO: 141312 - protein, 9 aa, Homo Sapiens
AAIVAKQVL

SEQ ID NO: 141313 - protein, 9 aa, Homo Sapiens
AAIVPGSQL

SEQ ID NO: 141314 - protein, 9 aa, Homo Sapiens
AAIWFRTYL

SEQ ID NO: 141315 - protein, 9 aa, Homo Sapiens
AAIWQYESL

SEQ ID NO: 141316 - protein, 9 aa, Homo Sapiens
AALDIYETL

SEQ ID NO: 141317 - protein, 9 aa, Homo Sapiens
AALDKATVL

SEQ ID NO: 141318 - protein, 9 aa, Homo Sapiens
AALFKAWAL

SEQ ID NO: 141319 - protein, 9 aa, Homo Sapiens
AALGRALAM

SEQ ID NO: 141320 - protein, 9 aa, Homo Sapiens
AALPFTKSL

SEQ ID NO: 141321 - protein, 9 aa, Homo Sapiens
AALPKATIL

SEQ ID NO: 141322 - protein, 9 aa, Homo Sapiens
AALPLALVL

SEQ ID NO: 141323 - protein, 9 aa, Homo Sapiens
AALPVYQEL

SEQ ID NO: 141324 - protein, 9 aa, Homo Sapiens
AALVPRQAL

SEQ ID NO: 141325 - protein, 9 aa, Homo Sapiens
AALWRFAEL

SEQ ID NO: 141326 - protein, 9 aa, Homo Sapiens
AALYHGMAL

SEQ ID NO: 141327 - protein, 9 aa, Homo Sapiens
AAMEFLQEL

SEQ ID NO: 141328 - protein, 9 aa, Homo Sapiens
AAMKALQAL

SEQ ID NO: 141329 - protein, 9 aa, Homo Sapiens
AAMKLMTAL

SEQ ID NO: 141330 - protein, 9 aa, Homo Sapiens
AAMKNVTEL

SEQ ID NO: 141331 - protein, 9 aa, Homo Sapiens
AAMMAVRVL

SEQ ID NO: 141332 - protein, 9 aa, Homo Sapiens
AAMPRIYEL

SEQ ID NO: 141333 - protein, 9 aa, Homo Sapiens
AAMPVAQHL

SEQ ID NO: 141334 - protein, 9 aa, Homo Sapiens
AAMSHLLEM

SEQ ID NO: 141335 - protein, 9 aa, Homo Sapiens
AAMYKSLEL

SEQ ID NO: 141336 - protein, 9 aa, Homo Sapiens
AANKTIIYL

SEQ ID NO: 141337 - protein, 9 aa, Homo Sapiens
AANKVVLQL

SEQ ID NO: 141338 - protein, 9 aa, Homo Sapiens
AANPFFKLL

SEQ ID NO: 141339 - protein, 9 aa, Homo Sapiens
AANPHSFVF

SEQ ID NO: 141340 - protein, 9 aa, Homo Sapiens
AANPIQFTL

SEQ ID NO: 141341 - protein, 9 aa, Homo Sapiens
AANRLTLEL

SEQ ID NO: 141342 - protein, 9 aa, Homo Sapiens
AAQDRVLSL

SEQ ID NO: 141343 - protein, 9 aa, Homo Sapiens
AAQIPTAAL

SEQ ID NO: 141344 - protein, 9 aa, Homo Sapiens
AASFHSLSL

SEQ ID NO: 141345 - protein, 9 aa, Homo Sapiens
AASMRALVL

SEQ ID NO: 141346 - protein, 9 aa, Homo Sapiens
AASPAGLDL

SEQ ID NO: 141347 - protein, 9 aa, Homo Sapiens
AASPQAPTL

SEQ ID NO: 141348 - protein, 9 aa, Homo Sapiens
AATAATLAL

SEQ ID NO: 141349 - protein, 9 aa, Homo Sapiens
AATDIFSYL

SEQ ID NO: 141350 - protein, 9 aa, Homo Sapiens
AATLLHLEL

SEQ ID NO: 141351 - protein, 9 aa, Homo Sapiens
AATSRIAEL

SEQ ID NO: 141352 - protein, 9 aa, Homo Sapiens
AATTVLQEL

SEQ ID NO: 141353 - protein, 9 aa, Homo Sapiens
AAVALAHAL

SEQ ID NO: 141354 - protein, 9 aa, Homo Sapiens
AAVDTNLTL

SEQ ID NO: 141355 - protein, 9 aa, Homo Sapiens
AAVGEPAFL

SEQ ID NO: 141356 - protein, 9 aa, Homo Sapiens
AAVGSVATL

SEQ ID NO: 141357 - protein, 9 aa, Homo Sapiens
AAVHIILVI

SEQ ID NO: 141358 - protein, 9 aa, Homo Sapiens
AAVKVIQSL

SEQ ID NO: 141359 - protein, 9 aa, Homo Sapiens
AAVNHISQL

SEQ ID NO: 141360 - protein, 9 aa, Homo Sapiens
AAVNSALAF

SEQ ID NO: 141361 - protein, 9 aa, Homo Sapiens
AAVNVICEL

SEQ ID NO: 141362 - protein, 9 aa, Homo Sapiens
AAVPDSVAL

SEQ ID NO: 141363 - protein, 9 aa, Homo Sapiens
AAVPKSLQL

SEQ ID NO: 141364 - protein, 9 aa, Homo Sapiens
AAVPKTFQL

SEQ ID NO: 141365 - protein, 9 aa, Homo Sapiens
AAVPPGSLL

SEQ ID NO: 141366 - protein, 9 aa, Homo Sapiens
AAVPRAAFL

SEQ ID NO: 141367 - protein, 9 aa, Homo Sapiens
AAVRHVLAL

SEQ ID NO: 141368 - protein, 9 aa, Homo Sapiens
AAVRIGSVL

SEQ ID NO: 141369 - protein, 9 aa, Homo Sapiens
AAVSRIVAL

SEQ ID NO: 141370 - protein, 9 aa, Homo Sapiens
AAYAGGLVL

SEQ ID NO: 141371 - protein, 9 aa, Homo Sapiens
AAYDRYLKL

SEQ ID NO: 141372 - protein, 9 aa, Homo Sapiens
AAYHLIIEL

SEQ ID NO: 141373 - protein, 9 aa, Homo Sapiens
AAYLRALSL

SEQ ID NO: 141374 - protein, 9 aa, Homo Sapiens
AAYQSVRIL

SEQ ID NO: 141375 - protein, 9 aa, Homo Sapiens
AAYYHPSYL

SEQ ID NO: 141376 - protein, 9 aa, Homo Sapiens
AFGEGLAQR

SEQ ID NO: 141377 - protein, 9 aa, Homo Sapiens
AGSAVFWVL

SEQ ID NO: 141378 - protein, 9 aa, Homo Sapiens
AGVPLFLLE

SEQ ID NO: 141379 - protein, 9 aa, Homo Sapiens
AIAAVFHTL

SEQ ID NO: 141380 - protein, 9 aa, Homo Sapiens
AIIESGKTL

SEQ ID NO: 141381 - protein, 9 aa, Homo Sapiens
AIIPYFITL

SEQ ID NO: 141382 - protein, 9 aa, Homo Sapiens
AIMDLLLRL

SEQ ID NO: 141383 - protein, 9 aa, Homo Sapiens
AIVGQAQEI

SEQ ID NO: 141384 - protein, 9 aa, Homo Sapiens
AIVKVFLAL

SEQ ID NO: 141385 - protein, 9 aa, Homo Sapiens
ALSHILTAL

SEQ ID NO: 141386 - protein, 9 aa, Homo Sapiens
ALVLLRPVI

SEQ ID NO: 141387 - protein, 9 aa, Homo Sapiens
AQAEVYKEL

SEQ ID NO: 141388 - protein, 9 aa, Homo Sapiens
AQVPFEQIL

SEQ ID NO: 141389 - protein, 9 aa, Homo Sapiens
ASAAAALVL

SEQ ID NO: 141390 - protein, 9 aa, Homo Sapiens
ASAPDPPVL

SEQ ID NO: 141391 - protein, 9 aa, Homo Sapiens
ASFIITKAI

SEQ ID NO: 141392 - protein, 9 aa, Homo Sapiens
ASGPPVSEL

SEQ ID NO: 141393 - protein, 9 aa, Homo Sapiens
ASIPYFHAM

SEQ ID NO: 141394 - protein, 9 aa, Homo Sapiens
ASITPGTIL

SEQ ID NO: 141395 - protein, 9 aa, Homo Sapiens
ASIYTGITL

SEQ ID NO: 141396 - protein, 9 aa, Homo Sapiens
ASLHVMMTL

SEQ ID NO: 141397 - protein, 9 aa, Homo Sapiens
ASLPSGLPI

SEQ ID NO: 141398 - protein, 9 aa, Homo Sapiens
ASSPEHPEL

SEQ ID NO: 141399 - protein, 9 aa, Homo Sapiens
ASSPGILVL

SEQ ID NO: 141400 - protein, 9 aa, Homo Sapiens
ASSPPVLSL

SEQ ID NO: 141401 - protein, 9 aa, Homo Sapiens
ASSPYFAAL

SEQ ID NO: 141402 - protein, 9 aa, Homo Sapiens
ASTARHLYL

SEQ ID NO: 141403 - protein, 9 aa, Homo Sapiens
ASVDKVLEL

SEQ ID NO: 141404 - protein, 9 aa, Homo Sapiens
ASVGKTSIL

SEQ ID NO: 141405 - protein, 9 aa, Homo Sapiens
ASYLRLWAL

SEQ ID NO: 141406 - protein, 9 aa, Homo Sapiens
ATIPPISSL

SEQ ID NO: 141407 - protein, 9 aa, Homo Sapiens
ATTHLSPEL

SEQ ID NO: 141408 - protein, 9 aa, Homo Sapiens
ATVHPGLEL

SEQ ID NO: 141409 - protein, 9 aa, Homo Sapiens
AVAPVASAL

SEQ ID NO: 141410 - protein, 9 aa, Homo Sapiens
AVCVAPSIL

SEQ ID NO: 141411 - protein, 9 aa, Homo Sapiens
AVFGHPFSL

SEQ ID NO: 141412 - protein, 9 aa, Homo Sapiens
AVLPFSPAL

SEQ ID NO: 141413 - protein, 9 aa, Homo Sapiens
AVMNYLPTL

SEQ ID NO: 141414 - protein, 9 aa, Homo Sapiens
AVNPKFVAL

SEQ ID NO: 141415 - protein, 9 aa, Homo Sapiens
AVVGDPIAL

SEQ ID NO: 141416 - protein, 9 aa, Homo Sapiens
AVVLPHQPL

SEQ ID NO: 141417 - protein, 9 aa, Homo Sapiens
CADPQWHVL

SEQ ID NO: 141418 - protein, 9 aa, Homo Sapiens
CAEAVSRVL

SEQ ID NO: 141419 - protein, 9 aa, Homo Sapiens
CAIAQAESL

SEQ ID NO: 141420 - protein, 9 aa, Homo Sapiens
CAIPQVMAI

SEQ ID NO: 141421 - protein, 9 aa, Homo Sapiens
CGVDHMVTL

SEQ ID NO: 141422 - protein, 9 aa, Homo Sapiens
CSLWPGQAL

SEQ ID NO: 141423 - protein, 9 aa, Homo Sapiens
CSSPHALVL

SEQ ID NO: 141424 - protein, 9 aa, Homo Sapiens
CSTVPSLAL

SEQ ID NO: 141425 - protein, 9 aa, Homo Sapiens
CTYGKPVTF

SEQ ID NO: 141426 - protein, 9 aa, Homo Sapiens
EATDIALLL

SEQ ID NO: 141427 - protein, 9 aa, Homo Sapiens
EAYTGGLEL

SEQ ID NO: 141428 - protein, 9 aa, Homo Sapiens
FAAASREVL

SEQ ID NO: 141429 - protein, 9 aa, Homo Sapiens
FAADAMARL

SEQ ID NO: 141430 - protein, 9 aa, Homo Sapiens
FAADIISVL

SEQ ID NO: 141431 - protein, 9 aa, Homo Sapiens
FAADLAEEL

SEQ ID NO: 141432 - protein, 9 aa, Homo Sapiens
FAADVRLMF

SEQ ID NO: 141433 - protein, 9 aa, Homo Sapiens
FAAGIIAHL

SEQ ID NO: 141434 - protein, 9 aa, Homo Sapiens
FAAGLGRSL

SEQ ID NO: 141435 - protein, 9 aa, Homo Sapiens
FAAIGSAVF

SEQ ID NO: 141436 - protein, 9 aa, Homo Sapiens
FAAISGMIL

SEQ ID NO: 141437 - protein, 9 aa, Homo Sapiens
FAALHGPAL

SEQ ID NO: 141438 - protein, 9 aa, Homo Sapiens
FAANVYEAF

SEQ ID NO: 141439 - protein, 9 aa, Homo Sapiens
FAAQRGLAV

SEQ ID NO: 141440 - protein, 9 aa, Homo Sapiens
FAATHSLEF

SEQ ID NO: 141441 - protein, 9 aa, Homo Sapiens
FAAVEGIFF

SEQ ID NO: 141442 - protein, 9 aa, Homo Sapiens
FADALCIGI

SEQ ID NO: 141443 - protein, 9 aa, Homo Sapiens
FADELSHLL

SEQ ID NO: 141444 - protein, 9 aa, Homo Sapiens
FADEVRLSF

SEQ ID NO: 141445 - protein, 9 aa, Homo Sapiens
FADFERHFL

SEQ ID NO: 141446 - protein, 9 aa, Homo Sapiens
FADGFVKAL

SEQ ID NO: 141447 - protein, 9 aa, Homo Sapiens
FADGHVLEL

SEQ ID NO: 141448 - protein, 9 aa, Homo Sapiens
FADGVILLL

SEQ ID NO: 141449 - protein, 9 aa, Homo Sapiens
FADGVYLVL

SEQ ID NO: 141450 - protein, 9 aa, Homo Sapiens
FADHVSSSL

SEQ ID NO: 141451 - protein, 9 aa, Homo Sapiens
FADHVVPLL

SEQ ID NO: 141452 - protein, 9 aa, Homo Sapiens
FADKHIQVL

SEQ ID NO: 141453 - protein, 9 aa, Homo Sapiens
FADLGYKQM

SEQ ID NO: 141454 - protein, 9 aa, Homo Sapiens
FADPHGKVF

SEQ ID NO: 141455 - protein, 9 aa, Homo Sapiens
FADQEVRSL

SEQ ID NO: 141456 - protein, 9 aa, Homo Sapiens
FADRSLLEM

SEQ ID NO: 141457 - protein, 9 aa, Homo Sapiens
FADSTVRVW

SEQ ID NO: 141458 - protein, 9 aa, Homo Sapiens
FADVAPLQL

SEQ ID NO: 141459 - protein, 9 aa, Homo Sapiens
FADVLVHRL

SEQ ID NO: 141460 - protein, 9 aa, Homo Sapiens
FADVNGWHL

SEQ ID NO: 141461 - protein, 9 aa, Homo Sapiens
FAEASGLEL

SEQ ID NO: 141462 - protein, 9 aa, Homo Sapiens
FAEDPPTSL

SEQ ID NO: 141463 - protein, 9 aa, Homo Sapiens
FAEDSLRVI

SEQ ID NO: 141464 - protein, 9 aa, Homo Sapiens
FAEEPGLVL

SEQ ID NO: 141465 - protein, 9 aa, Homo Sapiens
FAEEQTLVL

SEQ ID NO: 141466 - protein, 9 aa, Homo Sapiens
FAEEVGAAL

SEQ ID NO: 141467 - protein, 9 aa, Homo Sapiens
FAEGFVKAL

SEQ ID NO: 141468 - protein, 9 aa, Homo Sapiens
FAEGFVRAL

SEQ ID NO: 141469 - protein, 9 aa, Homo Sapiens
FAEGKPLAL

SEQ ID NO: 141470 - protein, 9 aa, Homo Sapiens
FAEGKPLEL

SEQ ID NO: 141471 - protein, 9 aa, Homo Sapiens
FAEGSTLKL

SEQ ID NO: 141472 - protein, 9 aa, Homo Sapiens
FAEPGRVPF

SEQ ID NO: 141473 - protein, 9 aa, Homo Sapiens
FAESLRTSL

SEQ ID NO: 141474 - protein, 9 aa, Homo Sapiens
FAFDEIVAL

SEQ ID NO: 141475 - protein, 9 aa, Homo Sapiens
FAFESVVAI

SEQ ID NO: 141476 - protein, 9 aa, Homo Sapiens
FAFGSPIGM

SEQ ID NO: 141477 - protein, 9 aa, Homo Sapiens
FAFIQHPSL

SEQ ID NO: 141478 - protein, 9 aa, Homo Sapiens
FAFLTGVGL

SEQ ID NO: 141479 - protein, 9 aa, Homo Sapiens
FAFPGEILM

SEQ ID NO: 141480 - protein, 9 aa, Homo Sapiens
FAFRNFLYL

SEQ ID NO: 141481 - protein, 9 aa, Homo Sapiens
FAGDIANQL

SEQ ID NO: 141482 - protein, 9 aa, Homo Sapiens
FAGFPSAAA

SEQ ID NO: 141483 - protein, 9 aa, Homo Sapiens
FAGGHPAQL

SEQ ID NO: 141484 - protein, 9 aa, Homo Sapiens
FAGLVFLHL

SEQ ID NO: 141485 - protein, 9 aa, Homo Sapiens
FAGVERLAL

SEQ ID NO: 141486 - protein, 9 aa, Homo Sapiens
FAHDSTRVI

SEQ ID NO: 141487 - protein, 9 aa, Homo Sapiens
FAHLNSPQL

SEQ ID NO: 141488 - protein, 9 aa, Homo Sapiens
FAHLRLEVL

SEQ ID NO: 141489 - protein, 9 aa, Homo Sapiens
FAHPPLLVL

SEQ ID NO: 141490 - protein, 9 aa, Homo Sapiens
FAHPYQYEL

SEQ ID NO: 141491 - protein, 9 aa, Homo Sapiens
FAHTNVESL

SEQ ID NO: 141492 - protein, 9 aa, Homo Sapiens
FAIDPHLLL

SEQ ID NO: 141493 - protein, 9 aa, Homo Sapiens
FAIGLTPML

SEQ ID NO: 141494 - protein, 9 aa, Homo Sapiens
FAIGVNFLI

SEQ ID NO: 141495 - protein, 9 aa, Homo Sapiens
FAIHKKIVL

SEQ ID NO: 141496 - protein, 9 aa, Homo Sapiens
FAIKSLRKL

SEQ ID NO: 141497 - protein, 9 aa, Homo Sapiens
FAILIHDVL

SEQ ID NO: 141498 - protein, 9 aa, Homo Sapiens
FAILRQAEL

SEQ ID NO: 141499 - protein, 9 aa, Homo Sapiens
FAINNSKSF

SEQ ID NO: 141500 - protein, 9 aa, Homo Sapiens
FAIPGSSFL

SEQ ID NO: 141501 - protein, 9 aa, Homo Sapiens
FAIPLIEKL

SEQ ID NO: 141502 - protein, 9 aa, Homo Sapiens
FAIPMIHAV

SEQ ID NO: 141503 - protein, 9 aa, Homo Sapiens
FAIQKGLQA

SEQ ID NO: 141504 - protein, 9 aa, Homo Sapiens
FAISILQQI

SEQ ID NO: 141505 - protein, 9 aa, Homo Sapiens
FAIYKMSFF

SEQ ID NO: 141506 - protein, 9 aa, Homo Sapiens
FAKPENIDL

SEQ ID NO: 141507 - protein, 9 aa, Homo Sapiens
FALDMKYAL

SEQ ID NO: 141508 - protein, 9 aa, Homo Sapiens
FALDSGLEI

SEQ ID NO: 141509 - protein, 9 aa, Homo Sapiens
FALGSPIAM

SEQ ID NO: 141510 - protein, 9 aa, Homo Sapiens
FALGVYRTL

SEQ ID NO: 141511 - protein, 9 aa, Homo Sapiens
FALKGLRTL

SEQ ID NO: 141512 - protein, 9 aa, Homo Sapiens
FALLAGTAV

SEQ ID NO: 141513 - protein, 9 aa, Homo Sapiens
FALLTTPEM

SEQ ID NO: 141514 - protein, 9 aa, Homo Sapiens
FALNLFKHL

SEQ ID NO: 141515 - protein, 9 aa, Homo Sapiens
FALPAYHTL

SEQ ID NO: 141516 - protein, 9 aa, Homo Sapiens
FALPFGRTA

SEQ ID NO: 141517 - protein, 9 aa, Homo Sapiens
FALPGNSQL

SEQ ID NO: 141518 - protein, 9 aa, Homo Sapiens
FALPILNAL

SEQ ID NO: 141519 - protein, 9 aa, Homo Sapiens
FALPYIRDV

SEQ ID NO: 141520 - protein, 9 aa, Homo Sapiens
FALPYVIVL

SEQ ID NO: 141521 - protein, 9 aa, Homo Sapiens
FALRPTFDL

SEQ ID NO: 141522 - protein, 9 aa, Homo Sapiens
FALSGPLFL

SEQ ID NO: 141523 - protein, 9 aa, Homo Sapiens
FALSQPRAM

SEQ ID NO: 141524 - protein, 9 aa, Homo Sapiens
FALSVTNPL

SEQ ID NO: 141525 - protein, 9 aa, Homo Sapiens
FALVGSYTL

SEQ ID NO: 141526 - protein, 9 aa, Homo Sapiens
FAMAGHENL

SEQ ID NO: 141527 - protein, 9 aa, Homo Sapiens
FAMDVYKNL

SEQ ID NO: 141528 - protein, 9 aa, Homo Sapiens
FAMEIDPSL

SEQ ID NO: 141529 - protein, 9 aa, Homo Sapiens
FAMFSGTHV

SEQ ID NO: 141530 - protein, 9 aa, Homo Sapiens
FAMIPAKEA

SEQ ID NO: 141531 - protein, 9 aa, Homo Sapiens
FAMIVSSAL

SEQ ID NO: 141532 - protein, 9 aa, Homo Sapiens
FAMPPPHGM

SEQ ID NO: 141533 - protein, 9 aa, Homo Sapiens
FAMPYFIQV

SEQ ID NO: 141534 - protein, 9 aa, Homo Sapiens
FAMQLVKIL

SEQ ID NO: 141535 - protein, 9 aa, Homo Sapiens
FAMYPPSMI

SEQ ID NO: 141536 - protein, 9 aa, Homo Sapiens
FANEPFADF

SEQ ID NO: 141537 - protein, 9 aa, Homo Sapiens
FANFGVLRL

SEQ ID NO: 141538 - protein, 9 aa, Homo Sapiens
FANLKYVSL

SEQ ID NO: 141539 - protein, 9 aa, Homo Sapiens
FANMLGVSL

SEQ ID NO: 141540 - protein, 9 aa, Homo Sapiens
FANNVQLSL

SEQ ID NO: 141541 - protein, 9 aa, Homo Sapiens
FAQAPQLSV

SEQ ID NO: 141542 - protein, 9 aa, Homo Sapiens
FAQEAISVL

SEQ ID NO: 141543 - protein, 9 aa, Homo Sapiens
FAQEALTVL

SEQ ID NO: 141544 - protein, 9 aa, Homo Sapiens
FAQGDVITL

SEQ ID NO: 141545 - protein, 9 aa, Homo Sapiens
FAQHGGIYV

SEQ ID NO: 141546 - protein, 9 aa, Homo Sapiens
FAQKSGYFL

SEQ ID NO: 141547 - protein, 9 aa, Homo Sapiens
FAQMYQKTL

SEQ ID NO: 141548 - protein, 9 aa, Homo Sapiens
FAQPSGLSL

SEQ ID NO: 141549 - protein, 9 aa, Homo Sapiens
FAQQMQLML

SEQ ID NO: 141550 - protein, 9 aa, Homo Sapiens
FAQTLHPSL

SEQ ID NO: 141551 - protein, 9 aa, Homo Sapiens
FASDIAPFL

SEQ ID NO: 141552 - protein, 9 aa, Homo Sapiens
FASDVQFVL

SEQ ID NO: 141553 - protein, 9 aa, Homo Sapiens
FASELSRSL

SEQ ID NO: 141554 - protein, 9 aa, Homo Sapiens
FASETNLDF

SEQ ID NO: 141555 - protein, 9 aa, Homo Sapiens
FASEVSNVL

SEQ ID NO: 141556 - protein, 9 aa, Homo Sapiens
FASEYPLIL

SEQ ID NO: 141557 - protein, 9 aa, Homo Sapiens
FASFPHMVL

SEQ ID NO: 141558 - protein, 9 aa, Homo Sapiens
FASGAFLHI

SEQ ID NO: 141559 - protein, 9 aa, Homo Sapiens
FASHVSPEV

SEQ ID NO: 141560 - protein, 9 aa, Homo Sapiens
FASIPGLEF

SEQ ID NO: 141561 - protein, 9 aa, Homo Sapiens
FASLPDPVL

SEQ ID NO: 141562 - protein, 9 aa, Homo Sapiens
FASSPLRVL

SEQ ID NO: 141563 - protein, 9 aa, Homo Sapiens
FASTILHLV

SEQ ID NO: 141564 - protein, 9 aa, Homo Sapiens
FASTMVHAL

SEQ ID NO: 141565 - protein, 9 aa, Homo Sapiens
FATDAILAT

SEQ ID NO: 141566 - protein, 9 aa, Homo Sapiens
FATDSGLEF

SEQ ID NO: 141567 - protein, 9 aa, Homo Sapiens
FATEGLRTL

SEQ ID NO: 141568 - protein, 9 aa, Homo Sapiens
FATEVRAVI

SEQ ID NO: 141569 - protein, 9 aa, Homo Sapiens
FATFPSSAF

SEQ ID NO: 141570 - protein, 9 aa, Homo Sapiens
FATGVWHQM

SEQ ID NO: 141571 - protein, 9 aa, Homo Sapiens
FATIKSASL

SEQ ID NO: 141572 - protein, 9 aa, Homo Sapiens
FATIRTASL

SEQ ID NO: 141573 - protein, 9 aa, Homo Sapiens
FATMVRPVA

SEQ ID NO: 141574 - protein, 9 aa, Homo Sapiens
FATSTEPVL

SEQ ID NO: 141575 - protein, 9 aa, Homo Sapiens
FATTSPLVL

SEQ ID NO: 141576 - protein, 9 aa, Homo Sapiens
FAVALPQLL

SEQ ID NO: 141577 - protein, 9 aa, Homo Sapiens
FAVDREARL

SEQ ID NO: 141578 - protein, 9 aa, Homo Sapiens
FAVEEGDHL

SEQ ID NO: 141579 - protein, 9 aa, Homo Sapiens
FAVEYFTRL

SEQ ID NO: 141580 - protein, 9 aa, Homo Sapiens
FAVGPGHGI

SEQ ID NO: 141581 - protein, 9 aa, Homo Sapiens
FAVGSFHTL

SEQ ID NO: 141582 - protein, 9 aa, Homo Sapiens
FAVGVQQVL

SEQ ID NO: 141583 - protein, 9 aa, Homo Sapiens
FAVIAHVGM

SEQ ID NO: 141584 - protein, 9 aa, Homo Sapiens
FAVISRHSL

SEQ ID NO: 141585 - protein, 9 aa, Homo Sapiens
FAVLEDHTL

SEQ ID NO: 141586 - protein, 9 aa, Homo Sapiens
FAVLPRLLL

SEQ ID NO: 141587 - protein, 9 aa, Homo Sapiens
FAVNMFRTL

SEQ ID NO: 141588 - protein, 9 aa, Homo Sapiens
FAVPENSSV

SEQ ID NO: 141589 - protein, 9 aa, Homo Sapiens
FAVPESDHL

SEQ ID NO: 141590 - protein, 9 aa, Homo Sapiens
FAVPKNYKL

SEQ ID NO: 141591 - protein, 9 aa, Homo Sapiens
FAVSDGLEL

SEQ ID NO: 141592 - protein, 9 aa, Homo Sapiens
FAVTLETVL

SEQ ID NO: 141593 - protein, 9 aa, Homo Sapiens
FAVVPSTAT

SEQ ID NO: 141594 - protein, 9 aa, Homo Sapiens
FAVYIHALL

SEQ ID NO: 141595 - protein, 9 aa, Homo Sapiens
FAWPQPASL

SEQ ID NO: 141596 - protein, 9 aa, Homo Sapiens
FAYEGPMYL

SEQ ID NO: 141597 - protein, 9 aa, Homo Sapiens
FAYLRDLLI

SEQ ID NO: 141598 - protein, 9 aa, Homo Sapiens
FAYMPNNSL

SEQ ID NO: 141599 - protein, 9 aa, Homo Sapiens
FAYNFREEL

SEQ ID NO: 141600 - protein, 9 aa, Homo Sapiens
FAYPAIRYL

SEQ ID NO: 141601 - protein, 9 aa, Homo Sapiens
FAYPAPLEV

SEQ ID NO: 141602 - protein, 9 aa, Homo Sapiens
FAYRGFKYL

SEQ ID NO: 141603 - protein, 9 aa, Homo Sapiens
FAYTARISV

SEQ ID NO: 141604 - protein, 9 aa, Homo Sapiens
FAYTRLQLL

SEQ ID NO: 141605 - protein, 9 aa, Homo Sapiens
FAYTVKYVL

SEQ ID NO: 141606 - protein, 9 aa, Homo Sapiens
FAYVEGESL

SEQ ID NO: 141607 - protein, 9 aa, Homo Sapiens
FCEKSFRQL

SEQ ID NO: 141608 - protein, 9 aa, Homo Sapiens
FCIEVGKNL

SEQ ID NO: 141609 - protein, 9 aa, Homo Sapiens
FCIQVGRTM

SEQ ID NO: 141610 - protein, 9 aa, Homo Sapiens
FCMDRALEF

SEQ ID NO: 141611 - protein, 9 aa, Homo Sapiens
FGDIFLHLL

SEQ ID NO: 141612 - protein, 9 aa, Homo Sapiens
FGDVTAHLL

SEQ ID NO: 141613 - protein, 9 aa, Homo Sapiens
FGEMGGKFM

SEQ ID NO: 141614 - protein, 9 aa, Homo Sapiens
FGFSHLEAL

SEQ ID NO: 141615 - protein, 9 aa, Homo Sapiens
FGFSSGAFL

SEQ ID NO: 141616 - protein, 9 aa, Homo Sapiens
FGGPEVLKL

SEQ ID NO: 141617 - protein, 9 aa, Homo Sapiens
FGHYQQAEL

SEQ ID NO: 141618 - protein, 9 aa, Homo Sapiens
FGIDKSKSI

SEQ ID NO: 141619 - protein, 9 aa, Homo Sapiens
FGIDPIWSL

SEQ ID NO: 141620 - protein, 9 aa, Homo Sapiens
FGIDRPAEL

SEQ ID NO: 141621 - protein, 9 aa, Homo Sapiens
FGINHGIEL

SEQ ID NO: 141622 - protein, 9 aa, Homo Sapiens
FGLARAFSL

SEQ ID NO: 141623 - protein, 9 aa, Homo Sapiens
FGLNIFHQL

SEQ ID NO: 141624 - protein, 9 aa, Homo Sapiens
FGLPRWVTL

SEQ ID NO: 141625 - protein, 9 aa, Homo Sapiens
FGMQARYSL

SEQ ID NO: 141626 - protein, 9 aa, Homo Sapiens
FGNGWIPTL

SEQ ID NO: 141627 - protein, 9 aa, Homo Sapiens
FGNNKLTTF

SEQ ID NO: 141628 - protein, 9 aa, Homo Sapiens
FGNPRKPVL

SEQ ID NO: 141629 - protein, 9 aa, Homo Sapiens
FGSDISPEI

SEQ ID NO: 141630 - protein, 9 aa, Homo Sapiens
FGSEFSPEL

SEQ ID NO: 141631 - protein, 9 aa, Homo Sapiens
FGSQPGLYL

SEQ ID NO: 141632 - protein, 9 aa, Homo Sapiens
FGVDPYNVL

SEQ ID NO: 141633 - protein, 9 aa, Homo Sapiens
FGVFSGHTL

SEQ ID NO: 141634 - protein, 9 aa, Homo Sapiens
FGVIPSTPL

SEQ ID NO: 141635 - protein, 9 aa, Homo Sapiens
FGVPVVVAL

SEQ ID NO: 141636 - protein, 9 aa, Homo Sapiens
FGWSHLEAL

SEQ ID NO: 141637 - protein, 9 aa, Homo Sapiens
FGYDYPSVL

SEQ ID NO: 141638 - protein, 9 aa, Homo Sapiens
FGYPDPTYL

SEQ ID NO: 141639 - protein, 9 aa, Homo Sapiens
FIADHCPTL

SEQ ID NO: 141640 - protein, 9 aa, Homo Sapiens
FIAEHYMFL

SEQ ID NO: 141641 - protein, 9 aa, Homo Sapiens
FIAPSGHGL

SEQ ID NO: 141642 - protein, 9 aa, Homo Sapiens
FIAPTGHSL

SEQ ID NO: 141643 - protein, 9 aa, Homo Sapiens
FICDSSPML

SEQ ID NO: 141644 - protein, 9 aa, Homo Sapiens
FIDGGGSVL

SEQ ID NO: 141645 - protein, 9 aa, Homo Sapiens
FIDGHFVEM

SEQ ID NO: 141646 - protein, 9 aa, Homo Sapiens
FIDTAQHML

SEQ ID NO: 141647 - protein, 9 aa, Homo Sapiens
FIEDAVHVL

SEQ ID NO: 141648 - protein, 9 aa, Homo Sapiens
FIEPNVRFW

SEQ ID NO: 141649 - protein, 9 aa, Homo Sapiens
FIFLPGNTL

SEQ ID NO: 141650 - protein, 9 aa, Homo Sapiens
FIFSDTHEL

SEQ ID NO: 141651 - protein, 9 aa, Homo Sapiens
FIGDSGIPL

SEQ ID NO: 141652 - protein, 9 aa, Homo Sapiens
FIIDGKGVL

SEQ ID NO: 141653 - protein, 9 aa, Homo Sapiens
FIIISSQHL

SEQ ID NO: 141654 - protein, 9 aa, Homo Sapiens
FIIQGLRSV

SEQ ID NO: 141655 - protein, 9 aa, Homo Sapiens
FIISRTQAL

SEQ ID NO: 141656 - protein, 9 aa, Homo Sapiens
FIIYDTHSL

SEQ ID NO: 141657 - protein, 9 aa, Homo Sapiens
FILEHIMVI

SEQ ID NO: 141658 - protein, 9 aa, Homo Sapiens
FILEHIMVV

SEQ ID NO: 141659 - protein, 9 aa, Homo Sapiens
FILEPRSFL

SEQ ID NO: 141660 - protein, 9 aa, Homo Sapiens
FILGHLRTL

SEQ ID NO: 141661 - protein, 9 aa, Homo Sapiens
FILQPIHNL

SEQ ID NO: 141662 - protein, 9 aa, Homo Sapiens
FIMDESNVL

SEQ ID NO: 141663 - protein, 9 aa, Homo Sapiens
FIMDRAQAL

SEQ ID NO: 141664 - protein, 9 aa, Homo Sapiens
FIMSATPTM

SEQ ID NO: 141665 - protein, 9 aa, Homo Sapiens
FINGDISSL

SEQ ID NO: 141666 - protein, 9 aa, Homo Sapiens
FIPATGHSL

SEQ ID NO: 141667 - protein, 9 aa, Homo Sapiens
FIQAVRQTL

SEQ ID NO: 141668 - protein, 9 aa, Homo Sapiens
FISGHTSEL

SEQ ID NO: 141669 - protein, 9 aa, Homo Sapiens
FISHLFMQL

SEQ ID NO: 141670 - protein, 9 aa, Homo Sapiens
FISNVKTAL

SEQ ID NO: 141671 - protein, 9 aa, Homo Sapiens
FISPTGHSL

SEQ ID NO: 141672 - protein, 9 aa, Homo Sapiens
FITESYQTL

SEQ ID NO: 141673 - protein, 9 aa, Homo Sapiens
FITPTGHSL

SEQ ID NO: 141674 - protein, 9 aa, Homo Sapiens
FIVAEGDSL

SEQ ID NO: 141675 - protein, 9 aa, Homo Sapiens
FIVDARPAM

SEQ ID NO: 141676 - protein, 9 aa, Homo Sapiens
FIVEETLPL

SEQ ID NO: 141677 - protein, 9 aa, Homo Sapiens
FIVVNTQSL

SEQ ID NO: 141678 - protein, 9 aa, Homo Sapiens
FIYHLPQEF

SEQ ID NO: 141679 - protein, 9 aa, Homo Sapiens
FIYTSELEL

SEQ ID NO: 141680 - protein, 9 aa, Homo Sapiens
FLADPVSNM

SEQ ID NO: 141681 - protein, 9 aa, Homo Sapiens
FLAEAARSL

SEQ ID NO: 141682 - protein, 9 aa, Homo Sapiens
FLANVSTVL

SEQ ID NO: 141683 - protein, 9 aa, Homo Sapiens
FLDEKTHEL

SEQ ID NO: 141684 - protein, 9 aa, Homo Sapiens
FLEEANRVL

SEQ ID NO: 141685 - protein, 9 aa, Homo Sapiens
FLEGRHAEL

SEQ ID NO: 141686 - protein, 9 aa, Homo Sapiens
FLENHVRHL

SEQ ID NO: 141687 - protein, 9 aa, Homo Sapiens
FLFDHLLTL

SEQ ID NO: 141688 - protein, 9 aa, Homo Sapiens
FLFDHQMVL

SEQ ID NO: 141689 - protein, 9 aa, Homo Sapiens
FLFPPAESL

SEQ ID NO: 141690 - protein, 9 aa, Homo Sapiens
FLFSKFIEL

SEQ ID NO: 141691 - protein, 9 aa, Homo Sapiens
FLHPHLLVL

SEQ ID NO: 141692 - protein, 9 aa, Homo Sapiens
FLIDNGVSL

SEQ ID NO: 141693 - protein, 9 aa, Homo Sapiens
FLIIPLHSL

SEQ ID NO: 141694 - protein, 9 aa, Homo Sapiens
FLINFIHTL

SEQ ID NO: 141695 - protein, 9 aa, Homo Sapiens
FLIPFVITV

SEQ ID NO: 141696 - protein, 9 aa, Homo Sapiens
FLIPKFFEL

SEQ ID NO: 141697 - protein, 9 aa, Homo Sapiens
FLIRESETL

SEQ ID NO: 141698 - protein, 9 aa, Homo Sapiens
FLLEGIRSL

SEQ ID NO: 141699 - protein, 9 aa, Homo Sapiens
FLLEHIRIL

SEQ ID NO: 141700 - protein, 9 aa, Homo Sapiens
FLLEKPFSV

SEQ ID NO: 141701 - protein, 9 aa, Homo Sapiens
FLLPVINEM

SEQ ID NO: 141702 - protein, 9 aa, Homo Sapiens
FLLQHVQEL

SEQ ID NO: 141703 - protein, 9 aa, Homo Sapiens
FLMPTSSEL

SEQ ID NO: 141704 - protein, 9 aa, Homo Sapiens
FLNPAQRAL

SEQ ID NO: 141705 - protein, 9 aa, Homo Sapiens
FLNQPHMVL

SEQ ID NO: 141706 - protein, 9 aa, Homo Sapiens
FLPEAPAEL

SEQ ID NO: 141707 - protein, 9 aa, Homo Sapiens
FLQDTRLAL

SEQ ID NO: 141708 - protein, 9 aa, Homo Sapiens
FLQEHNTTL

SEQ ID NO: 141709 - protein, 9 aa, Homo Sapiens
FLQTPLTEL

SEQ ID NO: 141710 - protein, 9 aa, Homo Sapiens
FLVDPNLDL

SEQ ID NO: 141711 - protein, 9 aa, Homo Sapiens
FLVEHNLVL

SEQ ID NO: 141712 - protein, 9 aa, Homo Sapiens
FLVEHVLTL

SEQ ID NO: 141713 - protein, 9 aa, Homo Sapiens
FLVTVIHTL

SEQ ID NO: 141714 - protein, 9 aa, Homo Sapiens
FLYAGHIFL

SEQ ID NO: 141715 - protein, 9 aa, Homo Sapiens
FLYDKALTF

SEQ ID NO: 141716 - protein, 9 aa, Homo Sapiens
FLYDTHQNL

SEQ ID NO: 141717 - protein, 9 aa, Homo Sapiens
FLYPFFGVL

SEQ ID NO: 141718 - protein, 9 aa, Homo Sapiens
FLYPFPLAL

SEQ ID NO: 141719 - protein, 9 aa, Homo Sapiens
FLYSGHLAL

SEQ ID NO: 141720 - protein, 9 aa, Homo Sapiens
FMEETERSL

SEQ ID NO: 141721 - protein, 9 aa, Homo Sapiens
FMNPHLISV

SEQ ID NO: 141722 - protein, 9 aa, Homo Sapiens
FMSDLMKAL

SEQ ID NO: 141723 - protein, 9 aa, Homo Sapiens
FMVEKGPTL

SEQ ID NO: 141724 - protein, 9 aa, Homo Sapiens
FNDPVAMVL

SEQ ID NO: 141725 - protein, 9 aa, Homo Sapiens
FNYPGGVAM

SEQ ID NO: 141726 - protein, 9 aa, Homo Sapiens
FQAPTAKEM

SEQ ID NO: 141727 - protein, 9 aa, Homo Sapiens
FQDAVNKVL

SEQ ID NO: 141728 - protein, 9 aa, Homo Sapiens
FQEADSPTL

SEQ ID NO: 141729 - protein, 9 aa, Homo Sapiens
FQEPDIHFL

SEQ ID NO: 141730 - protein, 9 aa, Homo Sapiens
FQFGVPQAL

SEQ ID NO: 141731 - protein, 9 aa, Homo Sapiens
FQIQTSTSL

SEQ ID NO: 141732 - protein, 9 aa, Homo Sapiens
FQLEHIMDL

SEQ ID NO: 141733 - protein, 9 aa, Homo Sapiens
FQMESQKFL

SEQ ID NO: 141734 - protein, 9 aa, Homo Sapiens
FQMQTTYVL

SEQ ID NO: 141735 - protein, 9 aa, Homo Sapiens
FQNPFRSEL

SEQ ID NO: 141736 - protein, 9 aa, Homo Sapiens
FQNPSTVTL

SEQ ID NO: 141737 - protein, 9 aa, Homo Sapiens
FQSSAVMAL

SEQ ID NO: 141738 - protein, 9 aa, Homo Sapiens
FQTEVGKQL

SEQ ID NO: 141739 - protein, 9 aa, Homo Sapiens
FQTHTTPVL

SEQ ID NO: 141740 - protein, 9 aa, Homo Sapiens
FQTIARNAL

SEQ ID NO: 141741 - protein, 9 aa, Homo Sapiens
FQVNHTVAL

SEQ ID NO: 141742 - protein, 9 aa, Homo Sapiens
FQYPAESVL

SEQ ID NO: 141743 - protein, 9 aa, Homo Sapiens
FQYPDTRYL

SEQ ID NO: 141744 - protein, 9 aa, Homo Sapiens
FQYSKSPSL

SEQ ID NO: 141745 - protein, 9 aa, Homo Sapiens
FQYSSHVSL

SEQ ID NO: 141746 - protein, 9 aa, Homo Sapiens
FSADGHTML

SEQ ID NO: 141747 - protein, 9 aa, Homo Sapiens
FSAGEPRVL

SEQ ID NO: 141748 - protein, 9 aa, Homo Sapiens
FSDDSDLQL

SEQ ID NO: 141749 - protein, 9 aa, Homo Sapiens
FSDFEARQL

SEQ ID NO: 141750 - protein, 9 aa, Homo Sapiens
FSDLTMHEL

SEQ ID NO: 141751 - protein, 9 aa, Homo Sapiens
FSDPIHPQL

SEQ ID NO: 141752 - protein, 9 aa, Homo Sapiens
FSDPVYKEI

SEQ ID NO: 141753 - protein, 9 aa, Homo Sapiens
FSEEDYRTL

SEQ ID NO: 141754 - protein, 9 aa, Homo Sapiens
FSEEMNRVL

SEQ ID NO: 141755 - protein, 9 aa, Homo Sapiens
FSEGGERLL

SEQ ID NO: 141756 - protein, 9 aa, Homo Sapiens
FSEGLIKAL

SEQ ID NO: 141757 - protein, 9 aa, Homo Sapiens
FSEPFHLIV

SEQ ID NO: 141758 - protein, 9 aa, Homo Sapiens
FSESHLVII

SEQ ID NO: 141759 - protein, 9 aa, Homo Sapiens
FSFDGPEIM

SEQ ID NO: 141760 - protein, 9 aa, Homo Sapiens
FSFEAQGGL

SEQ ID NO: 141761 - protein, 9 aa, Homo Sapiens
FSFHHVLSL

SEQ ID NO: 141762 - protein, 9 aa, Homo Sapiens
FSFLPTRAL

SEQ ID NO: 141763 - protein, 9 aa, Homo Sapiens
FSFPEPEAL

SEQ ID NO: 141764 - protein, 9 aa, Homo Sapiens
FSFVRITAL

SEQ ID NO: 141765 - protein, 9 aa, Homo Sapiens
FSFVRVISL

SEQ ID NO: 141766 - protein, 9 aa, Homo Sapiens
FSHAQTVVL

SEQ ID NO: 141767 - protein, 9 aa, Homo Sapiens
FSHHRVTVL

SEQ ID NO: 141768 - protein, 9 aa, Homo Sapiens
FSHPQAAQL

SEQ ID NO: 141769 - protein, 9 aa, Homo Sapiens
FSHPREPAL

SEQ ID NO: 141770 - protein, 9 aa, Homo Sapiens
FSIADSIEL

SEQ ID NO: 141771 - protein, 9 aa, Homo Sapiens
FSIDPARTL

SEQ ID NO: 141772 - protein, 9 aa, Homo Sapiens
FSIDSPDSL

SEQ ID NO: 141773 - protein, 9 aa, Homo Sapiens
FSIEPWLKV

SEQ ID NO: 141774 - protein, 9 aa, Homo Sapiens
FSIGADTAL

SEQ ID NO: 141775 - protein, 9 aa, Homo Sapiens
FSIGVGSRL

SEQ ID NO: 141776 - protein, 9 aa, Homo Sapiens
FSINPLENL

SEQ ID NO: 141777 - protein, 9 aa, Homo Sapiens
FSIPFAPHI

SEQ ID NO: 141778 - protein, 9 aa, Homo Sapiens
FSIPILMQL

SEQ ID NO: 141779 - protein, 9 aa, Homo Sapiens
FSIPVVSDV

SEQ ID NO: 141780 - protein, 9 aa, Homo Sapiens
FSITPLSEL

SEQ ID NO: 141781 - protein, 9 aa, Homo Sapiens
FSLAPITKL

SEQ ID NO: 141782 - protein, 9 aa, Homo Sapiens
FSLDLVHTL

SEQ ID NO: 141783 - protein, 9 aa, Homo Sapiens
FSLLPLSHL

SEQ ID NO: 141784 - protein, 9 aa, Homo Sapiens
FSLPHPEAL

SEQ ID NO: 141785 - protein, 9 aa, Homo Sapiens
FSLPPGHAV

SEQ ID NO: 141786 - protein, 9 aa, Homo Sapiens
FSMDIIDSL

SEQ ID NO: 141787 - protein, 9 aa, Homo Sapiens
FSMEEGDVL

SEQ ID NO: 141788 - protein, 9 aa, Homo Sapiens
FSMLESPAL

SEQ ID NO: 141789 - protein, 9 aa, Homo Sapiens
FSNAHINEL

SEQ ID NO: 141790 - protein, 9 aa, Homo Sapiens
FSNGHIKVL

SEQ ID NO: 141791 - protein, 9 aa, Homo Sapiens
FSNPETLDL

SEQ ID NO: 141792 - protein, 9 aa, Homo Sapiens
FSNPRALYL

SEQ ID NO: 141793 - protein, 9 aa, Homo Sapiens
FSQALQHAL

SEQ ID NO: 141794 - protein, 9 aa, Homo Sapiens
FSQEEFRNL

SEQ ID NO: 141795 - protein, 9 aa, Homo Sapiens
FSQIPNNGL

SEQ ID NO: 141796 - protein, 9 aa, Homo Sapiens
FSQKSFLVL

SEQ ID NO: 141797 - protein, 9 aa, Homo Sapiens
FSQPGLRSL

SEQ ID NO: 141798 - protein, 9 aa, Homo Sapiens
FSQPKVTEL

SEQ ID NO: 141799 - protein, 9 aa, Homo Sapiens
FSQPSLTTL

SEQ ID NO: 141800 - protein, 9 aa, Homo Sapiens
FSQPVFPYL

SEQ ID NO: 141801 - protein, 9 aa, Homo Sapiens
FSSAIGLVL

SEQ ID NO: 141802 - protein, 9 aa, Homo Sapiens
FSSANSPFL

SEQ ID NO: 141803 - protein, 9 aa, Homo Sapiens
FSSDNIAVL

SEQ ID NO: 141804 - protein, 9 aa, Homo Sapiens
FSSDVTHEM

SEQ ID NO: 141805 - protein, 9 aa, Homo Sapiens
FSSEVTAAL

SEQ ID NO: 141806 - protein, 9 aa, Homo Sapiens
FSSPHLQML

SEQ ID NO: 141807 - protein, 9 aa, Homo Sapiens
FSSPHLVQV

SEQ ID NO: 141808 - protein, 9 aa, Homo Sapiens
FSSPSFQTL

SEQ ID NO: 141809 - protein, 9 aa, Homo Sapiens
FSTGNFNVL

SEQ ID NO: 141810 - protein, 9 aa, Homo Sapiens
FSTLYGRVL

SEQ ID NO: 141811 - protein, 9 aa, Homo Sapiens
FSTPLNPFL

SEQ ID NO: 141812 - protein, 9 aa, Homo Sapiens
FSTPLNPLL

SEQ ID NO: 141813 - protein, 9 aa, Homo Sapiens
FSTSVVRPF

SEQ ID NO: 141814 - protein, 9 aa, Homo Sapiens
FSTVVIHFL

SEQ ID NO: 141815 - protein, 9 aa, Homo Sapiens
FSVAVSPSL

SEQ ID NO: 141816 - protein, 9 aa, Homo Sapiens
FSVEGQLEF

SEQ ID NO: 141817 - protein, 9 aa, Homo Sapiens
FSVENKWSL

SEQ ID NO: 141818 - protein, 9 aa, Homo Sapiens
FSVEQITAM

SEQ ID NO: 141819 - protein, 9 aa, Homo Sapiens
FSVGLQPTL

SEQ ID NO: 141820 - protein, 9 aa, Homo Sapiens
FSVISSSEV

SEQ ID NO: 141821 - protein, 9 aa, Homo Sapiens
FSVKAGEAL

SEQ ID NO: 141822 - protein, 9 aa, Homo Sapiens
FSVNLFRTL

SEQ ID NO: 141823 - protein, 9 aa, Homo Sapiens
FSVPFHQAL

SEQ ID NO: 141824 - protein, 9 aa, Homo Sapiens
FSVPGGHNL

SEQ ID NO: 141825 - protein, 9 aa, Homo Sapiens
FSVPHTKSL

SEQ ID NO: 141826 - protein, 9 aa, Homo Sapiens
FSVPLPARL

SEQ ID NO: 141827 - protein, 9 aa, Homo Sapiens
FSVVSPSSF

SEQ ID NO: 141828 - protein, 9 aa, Homo Sapiens
FSYAFPKAV

SEQ ID NO: 141829 - protein, 9 aa, Homo Sapiens
FSYAFPKEF

SEQ ID NO: 141830 - protein, 9 aa, Homo Sapiens
FSYEHFYVI

SEQ ID NO: 141831 - protein, 9 aa, Homo Sapiens
FSYEVSRSL

SEQ ID NO: 141832 - protein, 9 aa, Homo Sapiens
FSYHQFIHL

SEQ ID NO: 141833 - protein, 9 aa, Homo Sapiens
FSYITAVTL

SEQ ID NO: 141834 - protein, 9 aa, Homo Sapiens
FSYLNPQEL

SEQ ID NO: 141835 - protein, 9 aa, Homo Sapiens
FSYMSKISL

SEQ ID NO: 141836 - protein, 9 aa, Homo Sapiens
FSYPAGTEL

SEQ ID NO: 141837 - protein, 9 aa, Homo Sapiens
FSYQVASTL

SEQ ID NO: 141838 - protein, 9 aa, Homo Sapiens
FSYTGRVAV

SEQ ID NO: 141839 - protein, 9 aa, Homo Sapiens
FSYVTPRAF

SEQ ID NO: 141840 - protein, 9 aa, Homo Sapiens
FTADPLSLL

SEQ ID NO: 141841 - protein, 9 aa, Homo Sapiens
FTADVRSVL

SEQ ID NO: 141842 - protein, 9 aa, Homo Sapiens
FTAMPPLTL

SEQ ID NO: 141843 - protein, 9 aa, Homo Sapiens
FTAPATVSL

SEQ ID NO: 141844 - protein, 9 aa, Homo Sapiens
FTDASFLTL

SEQ ID NO: 141845 - protein, 9 aa, Homo Sapiens
FTDSGIHII

SEQ ID NO: 141846 - protein, 9 aa, Homo Sapiens
FTEAGLKEL

SEQ ID NO: 141847 - protein, 9 aa, Homo Sapiens
FTEMASRVL

SEQ ID NO: 141848 - protein, 9 aa, Homo Sapiens
FTEQGVRLL

SEQ ID NO: 141849 - protein, 9 aa, Homo Sapiens
FTFPDPPPL

SEQ ID NO: 141850 - protein, 9 aa, Homo Sapiens
FTIDIKSFL

SEQ ID NO: 141851 - protein, 9 aa, Homo Sapiens
FTIEVERAL

SEQ ID NO: 141852 - protein, 9 aa, Homo Sapiens
FTIFRTISV

SEQ ID NO: 141853 - protein, 9 aa, Homo Sapiens
FTIPHTQEA

SEQ ID NO: 141854 - protein, 9 aa, Homo Sapiens
FTIVSPLDI

SEQ ID NO: 141855 - protein, 9 aa, Homo Sapiens
FTLDVMKEL

SEQ ID NO: 141856 - protein, 9 aa, Homo Sapiens
FTLPMMSTL

SEQ ID NO: 141857 - protein, 9 aa, Homo Sapiens
FTLSHITQL

SEQ ID NO: 141858 - protein, 9 aa, Homo Sapiens
FTLVGKVLL

SEQ ID NO: 141859 - protein, 9 aa, Homo Sapiens
FTMDPKLSA

SEQ ID NO: 141860 - protein, 9 aa, Homo Sapiens
FTMKTVLML

SEQ ID NO: 141861 - protein, 9 aa, Homo Sapiens
FTNDKIINL

SEQ ID NO: 141862 - protein, 9 aa, Homo Sapiens
FTNGQTVNL

SEQ ID NO: 141863 - protein, 9 aa, Homo Sapiens
FTNPWTKEL

SEQ ID NO: 141864 - protein, 9 aa, Homo Sapiens
FTNRTVLEL

SEQ ID NO: 141865 - protein, 9 aa, Homo Sapiens
FTSEKFLVM

SEQ ID NO: 141866 - protein, 9 aa, Homo Sapiens
FTSLPGSTM

SEQ ID NO: 141867 - protein, 9 aa, Homo Sapiens
FTSPFCLQV

SEQ ID NO: 141868 - protein, 9 aa, Homo Sapiens
FTTGAIKDL

SEQ ID NO: 141869 - protein, 9 aa, Homo Sapiens
FTTHVMNLL

SEQ ID NO: 141870 - protein, 9 aa, Homo Sapiens
FTVKLPVAL

SEQ ID NO: 141871 - protein, 9 aa, Homo Sapiens
FTVMPGQTL

SEQ ID NO: 141872 - protein, 9 aa, Homo Sapiens
FTVNPKGEL

SEQ ID NO: 141873 - protein, 9 aa, Homo Sapiens
FTVNQQPFL

SEQ ID NO: 141874 - protein, 9 aa, Homo Sapiens
FTVPANQAF

SEQ ID NO: 141875 - protein, 9 aa, Homo Sapiens
FTVPFYKQL

SEQ ID NO: 141876 - protein, 9 aa, Homo Sapiens
FTVPHTHVF

SEQ ID NO: 141877 - protein, 9 aa, Homo Sapiens
FTVPKNRSL

SEQ ID NO: 141878 - protein, 9 aa, Homo Sapiens
FTVPQIIEM

SEQ ID NO: 141879 - protein, 9 aa, Homo Sapiens
FTVRPGELL

SEQ ID NO: 141880 - protein, 9 aa, Homo Sapiens
FTVTVPKDL

SEQ ID NO: 141881 - protein, 9 aa, Homo Sapiens
FTVTVPKEL

SEQ ID NO: 141882 - protein, 9 aa, Homo Sapiens
FTYGLHMIL

SEQ ID NO: 141883 - protein, 9 aa, Homo Sapiens
FTYKGLRAL

SEQ ID NO: 141884 - protein, 9 aa, Homo Sapiens
FVADVRLIF

SEQ ID NO: 141885 - protein, 9 aa, Homo Sapiens
FVAEGGPEL

SEQ ID NO: 141886 - protein, 9 aa, Homo Sapiens
FVAETHIVL

SEQ ID NO: 141887 - protein, 9 aa, Homo Sapiens
FVALPGVAV

SEQ ID NO: 141888 - protein, 9 aa, Homo Sapiens
FVAPPTAAV

SEQ ID NO: 141889 - protein, 9 aa, Homo Sapiens
FVDEGIKTL

SEQ ID NO: 141890 - protein, 9 aa, Homo Sapiens
FVEEEEHFL

SEQ ID NO: 141891 - protein, 9 aa, Homo Sapiens
FVFPGELLL

SEQ ID NO: 141892 - protein, 9 aa, Homo Sapiens
FVHDLVLYL

SEQ ID NO: 141893 - protein, 9 aa, Homo Sapiens
FVHPKPVSL

SEQ ID NO: 141894 - protein, 9 aa, Homo Sapiens
FVIDLQTRL

SEQ ID NO: 141895 - protein, 9 aa, Homo Sapiens
FVIETARQL

SEQ ID NO: 141896 - protein, 9 aa, Homo Sapiens
FVIGNGKNL

SEQ ID NO: 141897 - protein, 9 aa, Homo Sapiens
FVINEVCEM

SEQ ID NO: 141898 - protein, 9 aa, Homo Sapiens
FVIPVVQAL

SEQ ID NO: 141899 - protein, 9 aa, Homo Sapiens
FVLDKVPFL

SEQ ID NO: 141900 - protein, 9 aa, Homo Sapiens
FVLGRLLTL

SEQ ID NO: 141901 - protein, 9 aa, Homo Sapiens
FVMEGVKNL

SEQ ID NO: 141902 - protein, 9 aa, Homo Sapiens
FVMETFVHL

SEQ ID NO: 141903 - protein, 9 aa, Homo Sapiens
FVNPHVSSF

SEQ ID NO: 141904 - protein, 9 aa, Homo Sapiens
FVNPSLRVL

SEQ ID NO: 141905 - protein, 9 aa, Homo Sapiens
FVNPVQVVL

SEQ ID NO: 141906 - protein, 9 aa, Homo Sapiens
FVNSQEWTL

SEQ ID NO: 141907 - protein, 9 aa, Homo Sapiens
FVSDPLSDL

SEQ ID NO: 141908 - protein, 9 aa, Homo Sapiens
FVSPLVKYL

SEQ ID NO: 141909 - protein, 9 aa, Homo Sapiens
FVSSFMSEL

SEQ ID NO: 141910 - protein, 9 aa, Homo Sapiens
FVTEEIIPL

SEQ ID NO: 141911 - protein, 9 aa, Homo Sapiens
FVTKPNSAL

SEQ ID NO: 141912 - protein, 9 aa, Homo Sapiens
FVTSSHLQL

SEQ ID NO: 141913 - protein, 9 aa, Homo Sapiens
FVVDHCPYM

SEQ ID NO: 141914 - protein, 9 aa, Homo Sapiens
FVVDRLIAL

SEQ ID NO: 141915 - protein, 9 aa, Homo Sapiens
FVVERQPCM

SEQ ID NO: 141916 - protein, 9 aa, Homo Sapiens
FVVPDTVDM

SEQ ID NO: 141917 - protein, 9 aa, Homo Sapiens
FVVPNQKEL

SEQ ID NO: 141918 - protein, 9 aa, Homo Sapiens
FVVPNQKRL

SEQ ID NO: 141919 - protein, 9 aa, Homo Sapiens
FVVPRAALL

SEQ ID NO: 141920 - protein, 9 aa, Homo Sapiens
FVVPYGTPL

SEQ ID NO: 141921 - protein, 9 aa, Homo Sapiens
FVYENPISL

SEQ ID NO: 141922 - protein, 9 aa, Homo Sapiens
FVYGESVEL

SEQ ID NO: 141923 - protein, 9 aa, Homo Sapiens
FVYPFGATL

SEQ ID NO: 141924 - protein, 9 aa, Homo Sapiens
FWIPYIHNL

SEQ ID NO: 141925 - protein, 9 aa, Homo Sapiens
FYILTSKEL

SEQ ID NO: 141926 - protein, 9 aa, Homo Sapiens
FYVPFAKAL

SEQ ID NO: 141927 - protein, 9 aa, Homo Sapiens
GAAAPLLPM

SEQ ID NO: 141928 - protein, 9 aa, Homo Sapiens
GAAAWARPL

SEQ ID NO: 141929 - protein, 9 aa, Homo Sapiens
GAADPGFTM

SEQ ID NO: 141930 - protein, 9 aa, Homo Sapiens
GAFQPGRPL

SEQ ID NO: 141931 - protein, 9 aa, Homo Sapiens
GAHFSVSSL

SEQ ID NO: 141932 - protein, 9 aa, Homo Sapiens
GAINHVLQL

SEQ ID NO: 141933 - protein, 9 aa, Homo Sapiens
GAIPAFISL

SEQ ID NO: 141934 - protein, 9 aa, Homo Sapiens
GAIPVFFSF

SEQ ID NO: 141935 - protein, 9 aa, Homo Sapiens
GAISKIFVL

SEQ ID NO: 141936 - protein, 9 aa, Homo Sapiens
GALAVFPSL

SEQ ID NO: 141937 - protein, 9 aa, Homo Sapiens
GALFISPAL

SEQ ID NO: 141938 - protein, 9 aa, Homo Sapiens
GALPYFSEM

SEQ ID NO: 141939 - protein, 9 aa, Homo Sapiens
GAMDLLREL

SEQ ID NO: 141940 - protein, 9 aa, Homo Sapiens
GANHISPFL

SEQ ID NO: 141941 - protein, 9 aa, Homo Sapiens
GASPIGPTL

SEQ ID NO: 141942 - protein, 9 aa, Homo Sapiens
GATKLFLIL

SEQ ID NO: 141943 - protein, 9 aa, Homo Sapiens
GATPVSLAL

SEQ ID NO: 141944 - protein, 9 aa, Homo Sapiens
GAVDPLLAL

SEQ ID NO: 141945 - protein, 9 aa, Homo Sapiens
GAVPIFIEL

SEQ ID NO: 141946 - protein, 9 aa, Homo Sapiens
GAVSPFGML

SEQ ID NO: 141947 - protein, 9 aa, Homo Sapiens
GAYKYIQEL

SEQ ID NO: 141948 - protein, 9 aa, Homo Sapiens
GAYVPSLAL

SEQ ID NO: 141949 - protein, 9 aa, Homo Sapiens
GIIDPGSTV

SEQ ID NO: 141950 - protein, 9 aa, Homo Sapiens
GIIEPLMNL

SEQ ID NO: 141951 - protein, 9 aa, Homo Sapiens
GIIHVISRP

SEQ ID NO: 141952 - protein, 9 aa, Homo Sapiens
GIIRPGTAF

SEQ ID NO: 141953 - protein, 9 aa, Homo Sapiens
GIVFSGSSL

SEQ ID NO: 141954 - protein, 9 aa, Homo Sapiens
GIVGSGAAL

SEQ ID NO: 141955 - protein, 9 aa, Homo Sapiens
GSAPWAPVL

SEQ ID NO: 141956 - protein, 9 aa, Homo Sapiens
GSIAPGLSV

SEQ ID NO: 141957 - protein, 9 aa, Homo Sapiens
GTAPPTLAL

SEQ ID NO: 141958 - protein, 9 aa, Homo Sapiens
GTIPWFMEI

SEQ ID NO: 141959 - protein, 9 aa, Homo Sapiens
GVIDAYMTL

SEQ ID NO: 141960 - protein, 9 aa, Homo Sapiens
GVIEPNKEL

SEQ ID NO: 141961 - protein, 9 aa, Homo Sapiens
GVISKVSTL

SEQ ID NO: 141962 - protein, 9 aa, Homo Sapiens
HAAHIISEL

SEQ ID NO: 141963 - protein, 9 aa, Homo Sapiens
HAASVFLTL

SEQ ID NO: 141964 - protein, 9 aa, Homo Sapiens
HACGVIATI

SEQ ID NO: 141965 - protein, 9 aa, Homo Sapiens
HADDSFLVL

SEQ ID NO: 141966 - protein, 9 aa, Homo Sapiens
HAFAQPFAV

SEQ ID NO: 141967 - protein, 9 aa, Homo Sapiens
HAIEESVVL

SEQ ID NO: 141968 - protein, 9 aa, Homo Sapiens
HAIMRSPQM

SEQ ID NO: 141969 - protein, 9 aa, Homo Sapiens
HAIPPTLAM

SEQ ID NO: 141970 - protein, 9 aa, Homo Sapiens
HAMQFPAEL

SEQ ID NO: 141971 - protein, 9 aa, Homo Sapiens
HAMVILLTL

SEQ ID NO: 141972 - protein, 9 aa, Homo Sapiens
HANPILLLV

SEQ ID NO: 141973 - protein, 9 aa, Homo Sapiens
HASDRIIAL

SEQ ID NO: 141974 - protein, 9 aa, Homo Sapiens
HATQAIFEI

SEQ ID NO: 141975 - protein, 9 aa, Homo Sapiens
HAVEWPVVM

SEQ ID NO: 141976 - protein, 9 aa, Homo Sapiens
HAVHVALVL

SEQ ID NO: 141977 - protein, 9 aa, Homo Sapiens
HFSAYSSLI

SEQ ID NO: 141978 - protein, 9 aa, Homo Sapiens
HIIENIVAV

SEQ ID NO: 141979 - protein, 9 aa, Homo Sapiens
HILDFSPSL

SEQ ID NO: 141980 - protein, 9 aa, Homo Sapiens
HIPVFSPAL

SEQ ID NO: 141981 - protein, 9 aa, Homo Sapiens
HLDEAIHVL

SEQ ID NO: 141982 - protein, 9 aa, Homo Sapiens
HLTPVTLEL

SEQ ID NO: 141983 - protein, 9 aa, Homo Sapiens
HSALPNQSL

SEQ ID NO: 141984 - protein, 9 aa, Homo Sapiens
HSIGSYFTL

SEQ ID NO: 141985 - protein, 9 aa, Homo Sapiens
HSIIPRGSL

SEQ ID NO: 141986 - protein, 9 aa, Homo Sapiens
HTIFPSEYL

SEQ ID NO: 141987 - protein, 9 aa, Homo Sapiens
HTIVPGQVL

SEQ ID NO: 141988 - protein, 9 aa, Homo Sapiens
HVFIGGTPL

SEQ ID NO: 141989 - protein, 9 aa, Homo Sapiens
HVITKTMEL

SEQ ID NO: 141990 - protein, 9 aa, Homo Sapiens
HVLEPLSSL

SEQ ID NO: 141991 - protein, 9 aa, Homo Sapiens
HVMKAMQSL

SEQ ID NO: 141992 - protein, 9 aa, Homo Sapiens
HVPEHAVVL

SEQ ID NO: 141993 - protein, 9 aa, Homo Sapiens
IAAGIFNDL

SEQ ID NO: 141994 - protein, 9 aa, Homo Sapiens
IAAMPLISL

SEQ ID NO: 141995 - protein, 9 aa, Homo Sapiens
IAAPFTSKL

SEQ ID NO: 141996 - protein, 9 aa, Homo Sapiens
IAAPNMKAM

SEQ ID NO: 141997 - protein, 9 aa, Homo Sapiens
IAAPTSSAL

SEQ ID NO: 141998 - protein, 9 aa, Homo Sapiens
IAAVPATAM

SEQ ID NO: 141999 - protein, 9 aa, Homo Sapiens
IAAVTDIPL

SEQ ID NO: 142000 - protein, 9 aa, Homo Sapiens
IADGVFRFL

SEQ ID NO: 142001 - protein, 9 aa, Homo Sapiens
IADLVSKEL

SEQ ID NO: 142002 - protein, 9 aa, Homo Sapiens
IADPFFRSA

SEQ ID NO: 142003 - protein, 9 aa, Homo Sapiens
IADPNIAKL

SEQ ID NO: 142004 - protein, 9 aa, Homo Sapiens
IADSGLKIL

SEQ ID NO: 142005 - protein, 9 aa, Homo Sapiens
IAEMVRHAL

SEQ ID NO: 142006 - protein, 9 aa, Homo Sapiens
IAENLPKQL

SEQ ID NO: 142007 - protein, 9 aa, Homo Sapiens
IAFGPALAL

SEQ ID NO: 142008 - protein, 9 aa, Homo Sapiens
IAFGQSMDL

SEQ ID NO: 142009 - protein, 9 aa, Homo Sapiens
IAFHSAVSL

SEQ ID NO: 142010 - protein, 9 aa, Homo Sapiens
IAFPAAPLL

SEQ ID NO: 142011 - protein, 9 aa, Homo Sapiens
IAFPKAEEL

SEQ ID NO: 142012 - protein, 9 aa, Homo Sapiens
IAFPTSISV

SEQ ID NO: 142013 - protein, 9 aa, Homo Sapiens
IAFQYSTVL

SEQ ID NO: 142014 - protein, 9 aa, Homo Sapiens
IAIAPNGAL

SEQ ID NO: 142015 - protein, 9 aa, Homo Sapiens
IAIDGGKVL

SEQ ID NO: 142016 - protein, 9 aa, Homo Sapiens
IAIEDPFSV

SEQ ID NO: 142017 - protein, 9 aa, Homo Sapiens
IAIEGIMNL

SEQ ID NO: 142018 - protein, 9 aa, Homo Sapiens
IAIGSQPVL

SEQ ID NO: 142019 - protein, 9 aa, Homo Sapiens
IAIIPSKKL

SEQ ID NO: 142020 - protein, 9 aa, Homo Sapiens
IAIKFGSAL

SEQ ID NO: 142021 - protein, 9 aa, Homo Sapiens
IAIKYSRTL

SEQ ID NO: 142022 - protein, 9 aa, Homo Sapiens
IAINISRNL

SEQ ID NO: 142023 - protein, 9 aa, Homo Sapiens
IAIPDASKL

SEQ ID NO: 142024 - protein, 9 aa, Homo Sapiens
IAIPFGTAL

SEQ ID NO: 142025 - protein, 9 aa, Homo Sapiens
IAIPFLIKL

SEQ ID NO: 142026 - protein, 9 aa, Homo Sapiens
IAIPVTQEL

SEQ ID NO: 142027 - protein, 9 aa, Homo Sapiens
IAIPVTVAF

SEQ ID NO: 142028 - protein, 9 aa, Homo Sapiens
IAISRTPVL

SEQ ID NO: 142029 - protein, 9 aa, Homo Sapiens
IALEAAKAL

SEQ ID NO: 142030 - protein, 9 aa, Homo Sapiens
IALGEFSTL

SEQ ID NO: 142031 - protein, 9 aa, Homo Sapiens
IALLKAIIL

SEQ ID NO: 142032 - protein, 9 aa, Homo Sapiens
IAMDLILKM

SEQ ID NO: 142033 - protein, 9 aa, Homo Sapiens
IAMGMAQAL

SEQ ID NO: 142034 - protein, 9 aa, Homo Sapiens
IAMPLHMIF

SEQ ID NO: 142035 - protein, 9 aa, Homo Sapiens
IANAVVKEL

SEQ ID NO: 142036 - protein, 9 aa, Homo Sapiens
IANDRFINM

SEQ ID NO: 142037 - protein, 9 aa, Homo Sapiens
IANPTAMLL

SEQ ID NO: 142038 - protein, 9 aa, Homo Sapiens
IANPTATLL

SEQ ID NO: 142039 - protein, 9 aa, Homo Sapiens
IAQDFKTDL

SEQ ID NO: 142040 - protein, 9 aa, Homo Sapiens
IAQGSYIAL

SEQ ID NO: 142041 - protein, 9 aa, Homo Sapiens
IAQPVRSFL

SEQ ID NO: 142042 - protein, 9 aa, Homo Sapiens
IARLPSSTL

SEQ ID NO: 142043 - protein, 9 aa, Homo Sapiens
IASAIVNEL

SEQ ID NO: 142044 - protein, 9 aa, Homo Sapiens
IASIHSFEL

SEQ ID NO: 142045 - protein, 9 aa, Homo Sapiens
IASPPSLIL

SEQ ID NO: 142046 - protein, 9 aa, Homo Sapiens
IASPVIAAV

SEQ ID NO: 142047 - protein, 9 aa, Homo Sapiens
IASPVQPVL

SEQ ID NO: 142048 - protein, 9 aa, Homo Sapiens
IATNGTPEL

SEQ ID NO: 142049 - protein, 9 aa, Homo Sapiens
IATWGIVVM

SEQ ID NO: 142050 - protein, 9 aa, Homo Sapiens
IAVAITEAL

SEQ ID NO: 142051 - protein, 9 aa, Homo Sapiens
IAVANAQEL

SEQ ID NO: 142052 - protein, 9 aa, Homo Sapiens
IAVDMTQHL

SEQ ID NO: 142053 - protein, 9 aa, Homo Sapiens
IAVEPGNQW

SEQ ID NO: 142054 - protein, 9 aa, Homo Sapiens
IAVGVGAQL

SEQ ID NO: 142055 - protein, 9 aa, Homo Sapiens
IAVPDPSVL

SEQ ID NO: 142056 - protein, 9 aa, Homo Sapiens
IAVPEARFL

SEQ ID NO: 142057 - protein, 9 aa, Homo Sapiens
IAVYHLQEL

SEQ ID NO: 142058 - protein, 9 aa, Homo Sapiens
IAWPPPTEL

SEQ ID NO: 142059 - protein, 9 aa, Homo Sapiens
IAYDVTYSL

SEQ ID NO: 142060 - protein, 9 aa, Homo Sapiens
IAYIRDLAL

SEQ ID NO: 142061 - protein, 9 aa, Homo Sapiens
IAYPKAVTM

SEQ ID NO: 142062 - protein, 9 aa, Homo Sapiens
IGIDHIKEL

SEQ ID NO: 142063 - protein, 9 aa, Homo Sapiens
IGYSSPLTL

SEQ ID NO: 142064 - protein, 9 aa, Homo Sapiens
IIEPSLRQL

SEQ ID NO: 142065 - protein, 9 aa, Homo Sapiens
IIINPSSSL

SEQ ID NO: 142066 - protein, 9 aa, Homo Sapiens
IIIPNPAAL

SEQ ID NO: 142067 - protein, 9 aa, Homo Sapiens
IIITPGYGL

SEQ ID NO: 142068 - protein, 9 aa, Homo Sapiens
IILAPTREL

SEQ ID NO: 142069 - protein, 9 aa, Homo Sapiens
IISPLFAEL

SEQ ID NO: 142070 - protein, 9 aa, Homo Sapiens
IITAFIRAL

SEQ ID NO: 142071 - protein, 9 aa, Homo Sapiens
IITPAFAEL

SEQ ID NO: 142072 - protein, 9 aa, Homo Sapiens
IITTVGPEL

SEQ ID NO: 142073 - protein, 9 aa, Homo Sapiens
IIVDPAREL

SEQ ID NO: 142074 - protein, 9 aa, Homo Sapiens
IIVGNPKAL

SEQ ID NO: 142075 - protein, 9 aa, Homo Sapiens
IIYTAKISL

SEQ ID NO: 142076 - protein, 9 aa, Homo Sapiens
ILNPHGIPL

SEQ ID NO: 142077 - protein, 9 aa, Homo Sapiens
INVEPLSSL

SEQ ID NO: 142078 - protein, 9 aa, Homo Sapiens
IQIERQKIL

SEQ ID NO: 142079 - protein, 9 aa, Homo Sapiens
ISEENFRVM

SEQ ID NO: 142080 - protein, 9 aa, Homo Sapiens
ISFPSPDAL

SEQ ID NO: 142081 - protein, 9 aa, Homo Sapiens
ISGGKPLEV

SEQ ID NO: 142082 - protein, 9 aa, Homo Sapiens
ISIDRFLAV

SEQ ID NO: 142083 - protein, 9 aa, Homo Sapiens
ISIGPGASF

SEQ ID NO: 142084 - protein, 9 aa, Homo Sapiens
ISIGVTQIL

SEQ ID NO: 142085 - protein, 9 aa, Homo Sapiens
ISIHVGQAG

SEQ ID NO: 142086 - protein, 9 aa, Homo Sapiens
ISILQQIEL

SEQ ID NO: 142087 - protein, 9 aa, Homo Sapiens
ISNPNSIIL

SEQ ID NO: 142088 - protein, 9 aa, Homo Sapiens
ISNSHPLSL

SEQ ID NO: 142089 - protein, 9 aa, Homo Sapiens
ISSPVILQF

SEQ ID NO: 142090 - protein, 9 aa, Homo Sapiens
ISSPVVTSL

SEQ ID NO: 142091 - protein, 9 aa, Homo Sapiens
ISTEVNPKL

SEQ ID NO: 142092 - protein, 9 aa, Homo Sapiens
ISTNSHPIL

SEQ ID NO: 142093 - protein, 9 aa, Homo Sapiens
ISVASFQEL

SEQ ID NO: 142094 - protein, 9 aa, Homo Sapiens
ISVQPSSSL

SEQ ID NO: 142095 - protein, 9 aa, Homo Sapiens
ITAPPSRVL

SEQ ID NO: 142096 - protein, 9 aa, Homo Sapiens
ITDFQFKEL

SEQ ID NO: 142097 - protein, 9 aa, Homo Sapiens
ITIKPVLSL

SEQ ID NO: 142098 - protein, 9 aa, Homo Sapiens
ITISPLQEL

SEQ ID NO: 142099 - protein, 9 aa, Homo Sapiens
ITIVKSTEL

SEQ ID NO: 142100 - protein, 9 aa, Homo Sapiens
ITLHVFWEL

SEQ ID NO: 142101 - protein, 9 aa, Homo Sapiens
ITLLREISL

SEQ ID NO: 142102 - protein, 9 aa, Homo Sapiens
ITSDPGLSL

SEQ ID NO: 142103 - protein, 9 aa, Homo Sapiens
ITSPHGIPL

SEQ ID NO: 142104 - protein, 9 aa, Homo Sapiens
ITVGPRGPL

SEQ ID NO: 142105 - protein, 9 aa, Homo Sapiens
ITYGQFAQL

SEQ ID NO: 142106 - protein, 9 aa, Homo Sapiens
IVAEPGAVL

SEQ ID NO: 142107 - protein, 9 aa, Homo Sapiens
IVIDGSGAL

SEQ ID NO: 142108 - protein, 9 aa, Homo Sapiens
IVIDPKNPL

SEQ ID NO: 142109 - protein, 9 aa, Homo Sapiens
IVINPKTTL

SEQ ID NO: 142110 - protein, 9 aa, Homo Sapiens
IVMEHVVFL

SEQ ID NO: 142111 - protein, 9 aa, Homo Sapiens
IVMPLHYSL

SEQ ID NO: 142112 - protein, 9 aa, Homo Sapiens
IVMPNILVL

SEQ ID NO: 142113 - protein, 9 aa, Homo Sapiens
IVNGHTLLV

SEQ ID NO: 142114 - protein, 9 aa, Homo Sapiens
IVVAPSQTL

SEQ ID NO: 142115 - protein, 9 aa, Homo Sapiens
IVVPAGVEL

SEQ ID NO: 142116 - protein, 9 aa, Homo Sapiens
IVYPGIAVF

SEQ ID NO: 142117 - protein, 9 aa, Homo Sapiens
KAAHFFSTL

SEQ ID NO: 142118 - protein, 9 aa, Homo Sapiens
KAASVRPVL

SEQ ID NO: 142119 - protein, 9 aa, Homo Sapiens
KADMNVHLL

SEQ ID NO: 142120 - protein, 9 aa, Homo Sapiens
KAFFTSKAL

SEQ ID NO: 142121 - protein, 9 aa, Homo Sapiens
KAFNWFSTL

SEQ ID NO: 142122 - protein, 9 aa, Homo Sapiens
KAFNYFSSL

SEQ ID NO: 142123 - protein, 9 aa, Homo Sapiens
KAFPASAAL

SEQ ID NO: 142124 - protein, 9 aa, Homo Sapiens
KAFPFHIIF

SEQ ID NO: 142125 - protein, 9 aa, Homo Sapiens
KAFQKIVVL

SEQ ID NO: 142126 - protein, 9 aa, Homo Sapiens
KAIDFAASL

SEQ ID NO: 142127 - protein, 9 aa, Homo Sapiens
KAIDLMNAL

SEQ ID NO: 142128 - protein, 9 aa, Homo Sapiens
KAIEVLLTL

SEQ ID NO: 142129 - protein, 9 aa, Homo Sapiens
KAIGLFISF

SEQ ID NO: 142130 - protein, 9 aa, Homo Sapiens
KAINVFVSA

SEQ ID NO: 142131 - protein, 9 aa, Homo Sapiens
KAIRPYHAL

SEQ ID NO: 142132 - protein, 9 aa, Homo Sapiens
KAISRWSSL

SEQ ID NO: 142133 - protein, 9 aa, Homo Sapiens
KALSIFNEL

SEQ ID NO: 142134 - protein, 9 aa, Homo Sapiens
KAMELIREL

SEQ ID NO: 142135 - protein, 9 aa, Homo Sapiens
KAMEYMFGW

SEQ ID NO: 142136 - protein, 9 aa, Homo Sapiens
KAMPITLHL

SEQ ID NO: 142137 - protein, 9 aa, Homo Sapiens
KANPALYVL

SEQ ID NO: 142138 - protein, 9 aa, Homo Sapiens
KASDLYITL

SEQ ID NO: 142139 - protein, 9 aa, Homo Sapiens
KATFHYRTL

SEQ ID NO: 142140 - protein, 9 aa, Homo Sapiens
KATPQVPVL

SEQ ID NO: 142141 - protein, 9 aa, Homo Sapiens
KAVPSFDSL

SEQ ID NO: 142142 - protein, 9 aa, Homo Sapiens
KAYEIMREL

SEQ ID NO: 142143 - protein, 9 aa, Homo Sapiens
KCLELFSEL

SEQ ID NO: 142144 - protein, 9 aa, Homo Sapiens
KINEAFIEM

SEQ ID NO: 142145 - protein, 9 aa, Homo Sapiens
KITEDFRAL

SEQ ID NO: 142146 - protein, 9 aa, Homo Sapiens
KIVKWDRDM

SEQ ID NO: 142147 - protein, 9 aa, Homo Sapiens
KSIPSFSSL

SEQ ID NO: 142148 - protein, 9 aa, Homo Sapiens
KTIPSWATL

SEQ ID NO: 142149 - protein, 9 aa, Homo Sapiens
LAAAMVRVL

SEQ ID NO: 142150 - protein, 9 aa, Homo Sapiens
LAAEGQLTL

SEQ ID NO: 142151 - protein, 9 aa, Homo Sapiens
LAAGVVSAM

SEQ ID NO: 142152 - protein, 9 aa, Homo Sapiens
LAAHIPLFL

SEQ ID NO: 142153 - protein, 9 aa, Homo Sapiens
LAAHLGSAL

SEQ ID NO: 142154 - protein, 9 aa, Homo Sapiens
LAALLHAIA

SEQ ID NO: 142155 - protein, 9 aa, Homo Sapiens
LAALPGVSL

SEQ ID NO: 142156 - protein, 9 aa, Homo Sapiens
LAALSWQYL

SEQ ID NO: 142157 - protein, 9 aa, Homo Sapiens
LAAPMILSL

SEQ ID NO: 142158 - protein, 9 aa, Homo Sapiens
LAAPSNLSM

SEQ ID NO: 142159 - protein, 9 aa, Homo Sapiens
LAAPSPAAL

SEQ ID NO: 142160 - protein, 9 aa, Homo Sapiens
LAAPVISVL

SEQ ID NO: 142161 - protein, 9 aa, Homo Sapiens
LAAVAHSPL

SEQ ID NO: 142162 - protein, 9 aa, Homo Sapiens
LAAVPVQDL

SEQ ID NO: 142163 - protein, 9 aa, Homo Sapiens
LACIPVQEL

SEQ ID NO: 142164 - protein, 9 aa, Homo Sapiens
LADHTVHVL

SEQ ID NO: 142165 - protein, 9 aa, Homo Sapiens
LADIGYKTF

SEQ ID NO: 142166 - protein, 9 aa, Homo Sapiens
LADPVFRTL

SEQ ID NO: 142167 - protein, 9 aa, Homo Sapiens
LADQKVHML

SEQ ID NO: 142168 - protein, 9 aa, Homo Sapiens
LADVKVHIL

SEQ ID NO: 142169 - protein, 9 aa, Homo Sapiens
LAEAGVRLL

SEQ ID NO: 142170 - protein, 9 aa, Homo Sapiens
LAEFKVRAL

SEQ ID NO: 142171 - protein, 9 aa, Homo Sapiens
LAEIFGKVL

SEQ ID NO: 142172 - protein, 9 aa, Homo Sapiens
LAFEGPILL

SEQ ID NO: 142173 - protein, 9 aa, Homo Sapiens
LAFGSGMGL

SEQ ID NO: 142174 - protein, 9 aa, Homo Sapiens
LAFLGSQSL

SEQ ID NO: 142175 - protein, 9 aa, Homo Sapiens
LAFNSAISL

SEQ ID NO: 142176 - protein, 9 aa, Homo Sapiens
LAFPDVVSL

SEQ ID NO: 142177 - protein, 9 aa, Homo Sapiens
LAFPGEMLL

SEQ ID NO: 142178 - protein, 9 aa, Homo Sapiens
LAFPSPEKL

SEQ ID NO: 142179 - protein, 9 aa, Homo Sapiens
LAFPTGCSL

SEQ ID NO: 142180 - protein, 9 aa, Homo Sapiens
LAFSRALEL

SEQ ID NO: 142181 - protein, 9 aa, Homo Sapiens
LAGPDHLSL

SEQ ID NO: 142182 - protein, 9 aa, Homo Sapiens
LAHLRAAVL

SEQ ID NO: 142183 - protein, 9 aa, Homo Sapiens
LAHPNIIAL

SEQ ID NO: 142184 - protein, 9 aa, Homo Sapiens
LAHPYFESL

SEQ ID NO: 142185 - protein, 9 aa, Homo Sapiens
LAHVVITQL

SEQ ID NO: 142186 - protein, 9 aa, Homo Sapiens
LAIDAIHQL

SEQ ID NO: 142187 - protein, 9 aa, Homo Sapiens
LAIDSIHQL

SEQ ID NO: 142188 - protein, 9 aa, Homo Sapiens
LAIESANEL

SEQ ID NO: 142189 - protein, 9 aa, Homo Sapiens
LAIFVICQL

SEQ ID NO: 142190 - protein, 9 aa, Homo Sapiens
LAIGPCKSL

SEQ ID NO: 142191 - protein, 9 aa, Homo Sapiens
LAIHGMETL

SEQ ID NO: 142192 - protein, 9 aa, Homo Sapiens
LAIIPHVTI

SEQ ID NO: 142193 - protein, 9 aa, Homo Sapiens
LAIPFAITI

SEQ ID NO: 142194 - protein, 9 aa, Homo Sapiens
LAIPVFLTL

SEQ ID NO: 142195 - protein, 9 aa, Homo Sapiens
LAITGGVTL

SEQ ID NO: 142196 - protein, 9 aa, Homo Sapiens
LAITTEHTL

SEQ ID NO: 142197 - protein, 9 aa, Homo Sapiens
LAIVPVNTL

SEQ ID NO: 142198 - protein, 9 aa, Homo Sapiens
LALAIAQEL

SEQ ID NO: 142199 - protein, 9 aa, Homo Sapiens
LALDDVAAL

SEQ ID NO: 142200 - protein, 9 aa, Homo Sapiens
LALDHLHSL

SEQ ID NO: 142201 - protein, 9 aa, Homo Sapiens
LALELHQEL

SEQ ID NO: 142202 - protein, 9 aa, Homo Sapiens
LALFPGVAL

SEQ ID NO: 142203 - protein, 9 aa, Homo Sapiens
LALGSQMTL

SEQ ID NO: 142204 - protein, 9 aa, Homo Sapiens
LALTRSSSL

SEQ ID NO: 142205 - protein, 9 aa, Homo Sapiens
LAMEPTPEL

SEQ ID NO: 142206 - protein, 9 aa, Homo Sapiens
LAMLRSLDL

SEQ ID NO: 142207 - protein, 9 aa, Homo Sapiens
LAMRPLASL

SEQ ID NO: 142208 - protein, 9 aa, Homo Sapiens
LANERLMTL

SEQ ID NO: 142209 - protein, 9 aa, Homo Sapiens
LANIRSPVF

SEQ ID NO: 142210 - protein, 9 aa, Homo Sapiens
LANLHITAL

SEQ ID NO: 142211 - protein, 9 aa, Homo Sapiens
LANPHELSL

SEQ ID NO: 142212 - protein, 9 aa, Homo Sapiens
LANPTTSAL

SEQ ID NO: 142213 - protein, 9 aa, Homo Sapiens
LAQAHIQQL

SEQ ID NO: 142214 - protein, 9 aa, Homo Sapiens
LAQAMETAL

SEQ ID NO: 142215 - protein, 9 aa, Homo Sapiens
LAQDIFKEL

SEQ ID NO: 142216 - protein, 9 aa, Homo Sapiens
LAQEIVKAL

SEQ ID NO: 142217 - protein, 9 aa, Homo Sapiens
LAQHTMLTL

SEQ ID NO: 142218 - protein, 9 aa, Homo Sapiens
LAQPQMMVV

SEQ ID NO: 142219 - protein, 9 aa, Homo Sapiens
LAQPTLLYL

SEQ ID NO: 142220 - protein, 9 aa, Homo Sapiens
LAQQAILSL

SEQ ID NO: 142221 - protein, 9 aa, Homo Sapiens
LAQVSGLEM

SEQ ID NO: 142222 - protein, 9 aa, Homo Sapiens
LASAIINTL

SEQ ID NO: 142223 - protein, 9 aa, Homo Sapiens
LASFKILAL

SEQ ID NO: 142224 - protein, 9 aa, Homo Sapiens
LASHILTAL

SEQ ID NO: 142225 - protein, 9 aa, Homo Sapiens
LASPESLEL

SEQ ID NO: 142226 - protein, 9 aa, Homo Sapiens
LASPPWRVL

SEQ ID NO: 142227 - protein, 9 aa, Homo Sapiens
LASPVFARL

SEQ ID NO: 142228 - protein, 9 aa, Homo Sapiens
LASPVSPEL

SEQ ID NO: 142229 - protein, 9 aa, Homo Sapiens
LASSEWPEL

SEQ ID NO: 142230 - protein, 9 aa, Homo Sapiens
LASVPSPAL

SEQ ID NO: 142231 - protein, 9 aa, Homo Sapiens
LATAAALTY

SEQ ID NO: 142232 - protein, 9 aa, Homo Sapiens
LATASSPKF

SEQ ID NO: 142233 - protein, 9 aa, Homo Sapiens
LATAVIPQW

SEQ ID NO: 142234 - protein, 9 aa, Homo Sapiens
LATDAVQIL

SEQ ID NO: 142235 - protein, 9 aa, Homo Sapiens
LATDFIQSL

SEQ ID NO: 142236 - protein, 9 aa, Homo Sapiens
LATGAAMVL

SEQ ID NO: 142237 - protein, 9 aa, Homo Sapiens
LATHPGISF

SEQ ID NO: 142238 - protein, 9 aa, Homo Sapiens
LATIHLPYL

SEQ ID NO: 142239 - protein, 9 aa, Homo Sapiens
LATLIHQVL

SEQ ID NO: 142240 - protein, 9 aa, Homo Sapiens
LATPPFSRL

SEQ ID NO: 142241 - protein, 9 aa, Homo Sapiens
LATPVDLKL

SEQ ID NO: 142242 - protein, 9 aa, Homo Sapiens
LATRAIPEL

SEQ ID NO: 142243 - protein, 9 aa, Homo Sapiens
LATRSFPQL

SEQ ID NO: 142244 - protein, 9 aa, Homo Sapiens
LATSHMLEL

SEQ ID NO: 142245 - protein, 9 aa, Homo Sapiens
LATWATKEL

SEQ ID NO: 142246 - protein, 9 aa, Homo Sapiens
LAVAGATSL

SEQ ID NO: 142247 - protein, 9 aa, Homo Sapiens
LAVDGLMEM

SEQ ID NO: 142248 - protein, 9 aa, Homo Sapiens
LAVDKSASL

SEQ ID NO: 142249 - protein, 9 aa, Homo Sapiens
LAVDTQLLL

SEQ ID NO: 142250 - protein, 9 aa, Homo Sapiens
LAVEAVLRL

SEQ ID NO: 142251 - protein, 9 aa, Homo Sapiens
LAVEKAAEL

SEQ ID NO: 142252 - protein, 9 aa, Homo Sapiens
LAVEPGSNL

SEQ ID NO: 142253 - protein, 9 aa, Homo Sapiens
LAVEYVDSL

SEQ ID NO: 142254 - protein, 9 aa, Homo Sapiens
LAVHIAHSL

SEQ ID NO: 142255 - protein, 9 aa, Homo Sapiens
LAVNLTRVL

SEQ ID NO: 142256 - protein, 9 aa, Homo Sapiens
LAVPDMSSL

SEQ ID NO: 142257 - protein, 9 aa, Homo Sapiens
LAVVVTKEM

SEQ ID NO: 142258 - protein, 9 aa, Homo Sapiens
LAYDTQLVL

SEQ ID NO: 142259 - protein, 9 aa, Homo Sapiens
LAYEPFSTL

SEQ ID NO: 142260 - protein, 9 aa, Homo Sapiens
LAYHLAVVL

SEQ ID NO: 142261 - protein, 9 aa, Homo Sapiens
LAYIAHPKL

SEQ ID NO: 142262 - protein, 9 aa, Homo Sapiens
LAYIHLIEF

SEQ ID NO: 142263 - protein, 9 aa, Homo Sapiens
LAYLQRIAL

SEQ ID NO: 142264 - protein, 9 aa, Homo Sapiens
LAYMNHIMV

SEQ ID NO: 142265 - protein, 9 aa, Homo Sapiens
LAYPGSATI

SEQ ID NO: 142266 - protein, 9 aa, Homo Sapiens
LAYTGFVKL

SEQ ID NO: 142267 - protein, 9 aa, Homo Sapiens
LCHPHIIRL

SEQ ID NO: 142268 - protein, 9 aa, Homo Sapiens
LFMPRSTEF

SEQ ID NO: 142269 - protein, 9 aa, Homo Sapiens
LGIPHSFAL

SEQ ID NO: 142270 - protein, 9 aa, Homo Sapiens
LGIPIITVL

SEQ ID NO: 142271 - protein, 9 aa, Homo Sapiens
LGIPISNIL

SEQ ID NO: 142272 - protein, 9 aa, Homo Sapiens
LGSPWAVEL

SEQ ID NO: 142273 - protein, 9 aa, Homo Sapiens
LGYTSGLSL

SEQ ID NO: 142274 - protein, 9 aa, Homo Sapiens
LIDVARTSL

SEQ ID NO: 142275 - protein, 9 aa, Homo Sapiens
LIMDAYNSL

SEQ ID NO: 142276 - protein, 9 aa, Homo Sapiens
LINANMMVL

SEQ ID NO: 142277 - protein, 9 aa, Homo Sapiens
LIVDRPVTL

SEQ ID NO: 142278 - protein, 9 aa, Homo Sapiens
LIVDSVKEL

SEQ ID NO: 142279 - protein, 9 aa, Homo Sapiens
LIVEPSREL

SEQ ID NO: 142280 - protein, 9 aa, Homo Sapiens
LIYDGKVEM

SEQ ID NO: 142281 - protein, 9 aa, Homo Sapiens
LIYEDSIVL

SEQ ID NO: 142282 - protein, 9 aa, Homo Sapiens
LIYGTPRAA

SEQ ID NO: 142283 - protein, 9 aa, Homo Sapiens
LKETRAFPI

SEQ ID NO: 142284 - protein, 9 aa, Homo Sapiens
LLAMPVMVL

SEQ ID NO: 142285 - protein, 9 aa, Homo Sapiens
LLAQPGEAL

SEQ ID NO: 142286 - protein, 9 aa, Homo Sapiens
LLLAHIIAL

SEQ ID NO: 142287 - protein, 9 aa, Homo Sapiens
LLLPAGIAL

SEQ ID NO: 142288 - protein, 9 aa, Homo Sapiens
LLPEHFLFL

SEQ ID NO: 142289 - protein, 9 aa, Homo Sapiens
LLSLPATPL

SEQ ID NO: 142290 - protein, 9 aa, Homo Sapiens
LLVDHFMEL

SEQ ID NO: 142291 - protein, 9 aa, Homo Sapiens
LMEAVAVLV

SEQ ID NO: 142292 - protein, 9 aa, Homo Sapiens
LMMDPLTGL

SEQ ID NO: 142293 - protein, 9 aa, Homo Sapiens
LNAAPRIAL

SEQ ID NO: 142294 - protein, 9 aa, Homo Sapiens
LPINGNGKQ

SEQ ID NO: 142295 - protein, 9 aa, Homo Sapiens
LSAPIHTQM

SEQ ID NO: 142296 - protein, 9 aa, Homo Sapiens
LSAPSLHAL

SEQ ID NO: 142297 - protein, 9 aa, Homo Sapiens
LSDDHVLIL

SEQ ID NO: 142298 - protein, 9 aa, Homo Sapiens
LSDPFYRTL

SEQ ID NO: 142299 - protein, 9 aa, Homo Sapiens
LSDPQVHTV

SEQ ID NO: 142300 - protein, 9 aa, Homo Sapiens
LSDPTYREL

SEQ ID NO: 142301 - protein, 9 aa, Homo Sapiens
LSEPMVHEL

SEQ ID NO: 142302 - protein, 9 aa, Homo Sapiens
LSFNPLTSL

SEQ ID NO: 142303 - protein, 9 aa, Homo Sapiens
LSFTHPTSF

SEQ ID NO: 142304 - protein, 9 aa, Homo Sapiens
LSFWWPLAL

SEQ ID NO: 142305 - protein, 9 aa, Homo Sapiens
LSHSLLVTL

SEQ ID NO: 142306 - protein, 9 aa, Homo Sapiens
LSIDLFHVL

SEQ ID NO: 142307 - protein, 9 aa, Homo Sapiens
LSIEQLTTL

SEQ ID NO: 142308 - protein, 9 aa, Homo Sapiens
LSIPSFQAL

SEQ ID NO: 142309 - protein, 9 aa, Homo Sapiens
LSKDSILSL

SEQ ID NO: 142310 - protein, 9 aa, Homo Sapiens
LSKGPGLEV

SEQ ID NO: 142311 - protein, 9 aa, Homo Sapiens
LSLPRASSL

SEQ ID NO: 142312 - protein, 9 aa, Homo Sapiens
LSMERMVPA

SEQ ID NO: 142313 - protein, 9 aa, Homo Sapiens
LSMVPITSL

SEQ ID NO: 142314 - protein, 9 aa, Homo Sapiens
LSNHVFNAL

SEQ ID NO: 142315 - protein, 9 aa, Homo Sapiens
LSQDPVLEL

SEQ ID NO: 142316 - protein, 9 aa, Homo Sapiens
LSQPILLEL

SEQ ID NO: 142317 - protein, 9 aa, Homo Sapiens
LSQPTPATL

SEQ ID NO: 142318 - protein, 9 aa, Homo Sapiens
LSQQPFLSL

SEQ ID NO: 142319 - protein, 9 aa, Homo Sapiens
LSQVPMSAL

SEQ ID NO: 142320 - protein, 9 aa, Homo Sapiens
LSQVRFLVL

SEQ ID NO: 142321 - protein, 9 aa, Homo Sapiens
LSSLPLNSL

SEQ ID NO: 142322 - protein, 9 aa, Homo Sapiens
LSSPPTESL

SEQ ID NO: 142323 - protein, 9 aa, Homo Sapiens
LSSPVAQML

SEQ ID NO: 142324 - protein, 9 aa, Homo Sapiens
LSSSVIREL

SEQ ID NO: 142325 - protein, 9 aa, Homo Sapiens
LSTPFGQAL

SEQ ID NO: 142326 - protein, 9 aa, Homo Sapiens
LSTPYIHSL

SEQ ID NO: 142327 - protein, 9 aa, Homo Sapiens
LSTTVQPNL

SEQ ID NO: 142328 - protein, 9 aa, Homo Sapiens
LSTVVSPVI

SEQ ID NO: 142329 - protein, 9 aa, Homo Sapiens
LSVAPQQSL

SEQ ID NO: 142330 - protein, 9 aa, Homo Sapiens
LSVEIVHEL

SEQ ID NO: 142331 - protein, 9 aa, Homo Sapiens
LSVGSPSVL

SEQ ID NO: 142332 - protein, 9 aa, Homo Sapiens
LSVISSPQL

SEQ ID NO: 142333 - protein, 9 aa, Homo Sapiens
LSVRPQTAL

SEQ ID NO: 142334 - protein, 9 aa, Homo Sapiens
LTAEHFAAL

SEQ ID NO: 142335 - protein, 9 aa, Homo Sapiens
LTDGHPLTL

SEQ ID NO: 142336 - protein, 9 aa, Homo Sapiens
LTDPDIHVL

SEQ ID NO: 142337 - protein, 9 aa, Homo Sapiens
LTFNPSSAL

SEQ ID NO: 142338 - protein, 9 aa, Homo Sapiens
LTFPPATAL

SEQ ID NO: 142339 - protein, 9 aa, Homo Sapiens
LTIEKISAL

SEQ ID NO: 142340 - protein, 9 aa, Homo Sapiens
LTIPASLDL

SEQ ID NO: 142341 - protein, 9 aa, Homo Sapiens
LTLKHVKAL

SEQ ID NO: 142342 - protein, 9 aa, Homo Sapiens
LTLRPGVSL

SEQ ID NO: 142343 - protein, 9 aa, Homo Sapiens
LTMLPRLVL

SEQ ID NO: 142344 - protein, 9 aa, Homo Sapiens
LTTDISLIF

SEQ ID NO: 142345 - protein, 9 aa, Homo Sapiens
LTTEVHPEL

SEQ ID NO: 142346 - protein, 9 aa, Homo Sapiens
LTVEPGASL

SEQ ID NO: 142347 - protein, 9 aa, Homo Sapiens
LTYMPSVSL

SEQ ID NO: 142348 - protein, 9 aa, Homo Sapiens
LVFPGFFEL

SEQ ID NO: 142349 - protein, 9 aa, Homo Sapiens
LVIGRVLEL

SEQ ID NO: 142350 - protein, 9 aa, Homo Sapiens
LVINIIHSL

SEQ ID NO: 142351 - protein, 9 aa, Homo Sapiens
LVISDGSSL

SEQ ID NO: 142352 - protein, 9 aa, Homo Sapiens
LVLVPTREL

SEQ ID NO: 142353 - protein, 9 aa, Homo Sapiens
LVNGKSLEL

SEQ ID NO: 142354 - protein, 9 aa, Homo Sapiens
LVNPEGPTL

SEQ ID NO: 142355 - protein, 9 aa, Homo Sapiens
LVPALTDDS

SEQ ID NO: 142356 - protein, 9 aa, Homo Sapiens
LVTDIQPVL

SEQ ID NO: 142357 - protein, 9 aa, Homo Sapiens
LVVDKAMEL

SEQ ID NO: 142358 - protein, 9 aa, Homo Sapiens
MAAAALTSL

SEQ ID NO: 142359 - protein, 9 aa, Homo Sapiens
MAAAMPLAL

SEQ ID NO: 142360 - protein, 9 aa, Homo Sapiens
MAAMVLTSL

SEQ ID NO: 142361 - protein, 9 aa, Homo Sapiens
MAANVIPVL

SEQ ID NO: 142362 - protein, 9 aa, Homo Sapiens
MADPNIRFL

SEQ ID NO: 142363 - protein, 9 aa, Homo Sapiens
MAEPFTKAL

SEQ ID NO: 142364 - protein, 9 aa, Homo Sapiens
MAEPNAKFI

SEQ ID NO: 142365 - protein, 9 aa, Homo Sapiens
MAFDPTSTL

SEQ ID NO: 142366 - protein, 9 aa, Homo Sapiens
MAGPLRAPL

SEQ ID NO: 142367 - protein, 9 aa, Homo Sapiens
MAIAPNVTV

SEQ ID NO: 142368 - protein, 9 aa, Homo Sapiens
MAINSISKL

SEQ ID NO: 142369 - protein, 9 aa, Homo Sapiens
MAISGVPVL

SEQ ID NO: 142370 - protein, 9 aa, Homo Sapiens
MAISKPRNL

SEQ ID NO: 142371 - protein, 9 aa, Homo Sapiens
MAIVGGMAL

SEQ ID NO: 142372 - protein, 9 aa, Homo Sapiens
MALGHVIVL

SEQ ID NO: 142373 - protein, 9 aa, Homo Sapiens
MALLFLLPL

SEQ ID NO: 142374 - protein, 9 aa, Homo Sapiens
MAMAYGSSL

SEQ ID NO: 142375 - protein, 9 aa, Homo Sapiens
MANGAVIHL

SEQ ID NO: 142376 - protein, 9 aa, Homo Sapiens
MANPQMQQL

SEQ ID NO: 142377 - protein, 9 aa, Homo Sapiens
MASGHFAFL

SEQ ID NO: 142378 - protein, 9 aa, Homo Sapiens
MASLGALAL

SEQ ID NO: 142379 - protein, 9 aa, Homo Sapiens
MATAEAQSL

SEQ ID NO: 142380 - protein, 9 aa, Homo Sapiens
MATESILHF

SEQ ID NO: 142381 - protein, 9 aa, Homo Sapiens
MAVGGGLAV

SEQ ID NO: 142382 - protein, 9 aa, Homo Sapiens
MAYFPAISL

SEQ ID NO: 142383 - protein, 9 aa, Homo Sapiens
MAYPSLVAM

SEQ ID NO: 142384 - protein, 9 aa, Homo Sapiens
MAYVSGLSF

SEQ ID NO: 142385 - protein, 9 aa, Homo Sapiens
MGMVAGTTM

SEQ ID NO: 142386 - protein, 9 aa, Homo Sapiens
MIIEDPAAL

SEQ ID NO: 142387 - protein, 9 aa, Homo Sapiens
MIIENFEAL

SEQ ID NO: 142388 - protein, 9 aa, Homo Sapiens
MILIPGQTL

SEQ ID NO: 142389 - protein, 9 aa, Homo Sapiens
MPMMPGPPM

SEQ ID NO: 142390 - protein, 9 aa, Homo Sapiens
MSDTTFKAL

SEQ ID NO: 142391 - protein, 9 aa, Homo Sapiens
MSSDVFPLL

SEQ ID NO: 142392 - protein, 9 aa, Homo Sapiens
MSSPLSKEL

SEQ ID NO: 142393 - protein, 9 aa, Homo Sapiens
MSVEVRQTL

SEQ ID NO: 142394 - protein, 9 aa, Homo Sapiens
MSVQPTVSL

SEQ ID NO: 142395 - protein, 9 aa, Homo Sapiens
MTIENMNHL

SEQ ID NO: 142396 - protein, 9 aa, Homo Sapiens
MTQQPRPVL

SEQ ID NO: 142397 - protein, 9 aa, Homo Sapiens
MVADKFTEL

SEQ ID NO: 142398 - protein, 9 aa, Homo Sapiens
MVIVPTREL

SEQ ID NO: 142399 - protein, 9 aa, Homo Sapiens
MVNPVIYAL

SEQ ID NO: 142400 - protein, 9 aa, Homo Sapiens
MVVDIVQEL

SEQ ID NO: 142401 - protein, 9 aa, Homo Sapiens
MVVGTGTSL

SEQ ID NO: 142402 - protein, 9 aa, Homo Sapiens
NAATSFQVL

SEQ ID NO: 142403 - protein, 9 aa, Homo Sapiens
NADPIAKYL

SEQ ID NO: 142404 - protein, 9 aa, Homo Sapiens
NADPNMKLF

SEQ ID NO: 142405 - protein, 9 aa, Homo Sapiens
NAFMKAVEL

SEQ ID NO: 142406 - protein, 9 aa, Homo Sapiens
NAFSGVMML

SEQ ID NO: 142407 - protein, 9 aa, Homo Sapiens
NAIGPLVAL

SEQ ID NO: 142408 - protein, 9 aa, Homo Sapiens
NAILVDTPL

SEQ ID NO: 142409 - protein, 9 aa, Homo Sapiens
NAINITSAL

SEQ ID NO: 142410 - protein, 9 aa, Homo Sapiens
NAIREVLEL

SEQ ID NO: 142411 - protein, 9 aa, Homo Sapiens
NAISIHHAL

SEQ ID NO: 142412 - protein, 9 aa, Homo Sapiens
NAITAFSTL

SEQ ID NO: 142413 - protein, 9 aa, Homo Sapiens
NALFHASTL

SEQ ID NO: 142414 - protein, 9 aa, Homo Sapiens
NAMGFHVIL

SEQ ID NO: 142415 - protein, 9 aa, Homo Sapiens
NASPVISSV

SEQ ID NO: 142416 - protein, 9 aa, Homo Sapiens
NAVGLFSRL

SEQ ID NO: 142417 - protein, 9 aa, Homo Sapiens
NAVPLFLRL

SEQ ID NO: 142418 - protein, 9 aa, Homo Sapiens
NAVWALSNL

SEQ ID NO: 142419 - protein, 9 aa, Homo Sapiens
NAYTGIVLL

SEQ ID NO: 142420 - protein, 9 aa, Homo Sapiens
NGIFPGTPL

SEQ ID NO: 142421 - protein, 9 aa, Homo Sapiens
NIDEAYKIL

SEQ ID NO: 142422 - protein, 9 aa, Homo Sapiens
NILDRFLAL

SEQ ID NO: 142423 - protein, 9 aa, Homo Sapiens
NIYAANPVI

SEQ ID NO: 142424 - protein, 9 aa, Homo Sapiens
NSNPVIAEL

SEQ ID NO: 142425 - protein, 9 aa, Homo Sapiens
NTIDPSHPM

SEQ ID NO: 142426 - protein, 9 aa, Homo Sapiens
NTIETFNEL

SEQ ID NO: 142427 - protein, 9 aa, Homo Sapiens
NTMGHMMEM

SEQ ID NO: 142428 - protein, 9 aa, Homo Sapiens
NVIESFTEL

SEQ ID NO: 142429 - protein, 9 aa, Homo Sapiens
NVLDHFSEL

SEQ ID NO: 142430 - protein, 9 aa, Homo Sapiens
QAADSILVL

SEQ ID NO: 142431 - protein, 9 aa, Homo Sapiens
QAFPGLLQL

SEQ ID NO: 142432 - protein, 9 aa, Homo Sapiens
QAFPRITQL

SEQ ID NO: 142433 - protein, 9 aa, Homo Sapiens
QAHLTLMAL

SEQ ID NO: 142434 - protein, 9 aa, Homo Sapiens
QAIENAHVL

SEQ ID NO: 142435 - protein, 9 aa, Homo Sapiens
QAIERYLVV

SEQ ID NO: 142436 - protein, 9 aa, Homo Sapiens
QAIGAIRTL

SEQ ID NO: 142437 - protein, 9 aa, Homo Sapiens
QAIPVTSEL

SEQ ID NO: 142438 - protein, 9 aa, Homo Sapiens
QALDYFLKM

SEQ ID NO: 142439 - protein, 9 aa, Homo Sapiens
QALPWISIL

SEQ ID NO: 142440 - protein, 9 aa, Homo Sapiens
QAMGSFLSV

SEQ ID NO: 142441 - protein, 9 aa, Homo Sapiens
QAMPPLFSL

SEQ ID NO: 142442 - protein, 9 aa, Homo Sapiens
QAMPTLIEL

SEQ ID NO: 142443 - protein, 9 aa, Homo Sapiens
QANIRLTSL

SEQ ID NO: 142444 - protein, 9 aa, Homo Sapiens
QATDSILVF

SEQ ID NO: 142445 - protein, 9 aa, Homo Sapiens
QATMPHLSM

SEQ ID NO: 142446 - protein, 9 aa, Homo Sapiens
QATPAALVL

SEQ ID NO: 142447 - protein, 9 aa, Homo Sapiens
QAVKIGQSL

SEQ ID NO: 142448 - protein, 9 aa, Homo Sapiens
QIIAFFAHL

SEQ ID NO: 142449 - protein, 9 aa, Homo Sapiens
QLLDIKIRL

SEQ ID NO: 142450 - protein, 9 aa, Homo Sapiens
QSISPGSRL

SEQ ID NO: 142451 - protein, 9 aa, Homo Sapiens
QSLPPGLAV

SEQ ID NO: 142452 - protein, 9 aa, Homo Sapiens
QSYGNVVEL

SEQ ID NO: 142453 - protein, 9 aa, Homo Sapiens
QVEDAFRYM

SEQ ID NO: 142454 - protein, 9 aa, Homo Sapiens
RAFQPSVSL

SEQ ID NO: 142455 - protein, 9 aa, Homo Sapiens
RAHSEPLAL

SEQ ID NO: 142456 - protein, 9 aa, Homo Sapiens
RAIDFSPYL

SEQ ID NO: 142457 - protein, 9 aa, Homo Sapiens
RAIEIYTDM

SEQ ID NO: 142458 - protein, 9 aa, Homo Sapiens
RAIELATTL

SEQ ID NO: 142459 - protein, 9 aa, Homo Sapiens
RAIGIGAYL

SEQ ID NO: 142460 - protein, 9 aa, Homo Sapiens
RAIPNNQVL

SEQ ID NO: 142461 - protein, 9 aa, Homo Sapiens
RAIQFYLEF

SEQ ID NO: 142462 - protein, 9 aa, Homo Sapiens
RALDHYLTL

SEQ ID NO: 142463 - protein, 9 aa, Homo Sapiens
RALEHFTDL

SEQ ID NO: 142464 - protein, 9 aa, Homo Sapiens
RATPHFSGL

SEQ ID NO: 142465 - protein, 9 aa, Homo Sapiens
RAVAPTMSL

SEQ ID NO: 142466 - protein, 9 aa, Homo Sapiens
RAVPVGSGL

SEQ ID NO: 142467 - protein, 9 aa, Homo Sapiens
RAYAKFYTL

SEQ ID NO: 142468 - protein, 9 aa, Homo Sapiens
RCIPALDSL

SEQ ID NO: 142469 - protein, 9 aa, Homo Sapiens
RIFEKMFAM

SEQ ID NO: 142470 - protein, 9 aa, Homo Sapiens
RIIPRHLQL

SEQ ID NO: 142471 - protein, 9 aa, Homo Sapiens
RIPSFVTEL

SEQ ID NO: 142472 - protein, 9 aa, Homo Sapiens
RIVPRFSEL

SEQ ID NO: 142473 - protein, 9 aa, Homo Sapiens
RLLDWFRSL

SEQ ID NO: 142474 - protein, 9 aa, Homo Sapiens
RSIFPQQSL

SEQ ID NO: 142475 - protein, 9 aa, Homo Sapiens
RTFEAFMYL

SEQ ID NO: 142476 - protein, 9 aa, Homo Sapiens
RTIGFFYTL

SEQ ID NO: 142477 - protein, 9 aa, Homo Sapiens
RTMEIFQLL

SEQ ID NO: 142478 - protein, 9 aa, Homo Sapiens
RTNRPPLSL

SEQ ID NO: 142479 - protein, 9 aa, Homo Sapiens
RTVDLFPVL

SEQ ID NO: 142480 - protein, 9 aa, Homo Sapiens
RVIDVGSEW

SEQ ID NO: 142481 - protein, 9 aa, Homo Sapiens
RVIDYILDL

SEQ ID NO: 142482 - protein, 9 aa, Homo Sapiens
SAACPGLQL

SEQ ID NO: 142483 - protein, 9 aa, Homo Sapiens
SAAEAYQVL

SEQ ID NO: 142484 - protein, 9 aa, Homo Sapiens
SAAEIMAVL

SEQ ID NO: 142485 - protein, 9 aa, Homo Sapiens
SAAENFLVL

SEQ ID NO: 142486 - protein, 9 aa, Homo Sapiens
SAAFPGASL

SEQ ID NO: 142487 - protein, 9 aa, Homo Sapiens
SAAGPGFSL

SEQ ID NO: 142488 - protein, 9 aa, Homo Sapiens
SAAMPGASL

SEQ ID NO: 142489 - protein, 9 aa, Homo Sapiens
SAAMVFSAL

SEQ ID NO: 142490 - protein, 9 aa, Homo Sapiens
SAANIQPIF

SEQ ID NO: 142491 - protein, 9 aa, Homo Sapiens
SAAPEGVPL

SEQ ID NO: 142492 - protein, 9 aa, Homo Sapiens
SAAPLFFSW

SEQ ID NO: 142493 - protein, 9 aa, Homo Sapiens
SAAPLGTTL

SEQ ID NO: 142494 - protein, 9 aa, Homo Sapiens
SAAPLQPVL

SEQ ID NO: 142495 - protein, 9 aa, Homo Sapiens
SAAPRTVAL

SEQ ID NO: 142496 - protein, 9 aa, Homo Sapiens
SAAPTFLLL

SEQ ID NO: 142497 - protein, 9 aa, Homo Sapiens
SAAQPGVAF

SEQ ID NO: 142498 - protein, 9 aa, Homo Sapiens
SAASITPLL

SEQ ID NO: 142499 - protein, 9 aa, Homo Sapiens
SAASLYPVL

SEQ ID NO: 142500 - protein, 9 aa, Homo Sapiens
SADFPRVGM

SEQ ID NO: 142501 - protein, 9 aa, Homo Sapiens
SADPGILVL

SEQ ID NO: 142502 - protein, 9 aa, Homo Sapiens
SADSLEHVL

SEQ ID NO: 142503 - protein, 9 aa, Homo Sapiens
SAFDHFASV

SEQ ID NO: 142504 - protein, 9 aa, Homo Sapiens
SAFGYFITA

SEQ ID NO: 142505 - protein, 9 aa, Homo Sapiens
SAFLKTIAL

SEQ ID NO: 142506 - protein, 9 aa, Homo Sapiens
SAFPEVRSL

SEQ ID NO: 142507 - protein, 9 aa, Homo Sapiens
SAFPFPVTV

SEQ ID NO: 142508 - protein, 9 aa, Homo Sapiens
SAFPHLRVL

SEQ ID NO: 142509 - protein, 9 aa, Homo Sapiens
SAHSHFISL

SEQ ID NO: 142510 - protein, 9 aa, Homo Sapiens
SAIASTKVM

SEQ ID NO: 142511 - protein, 9 aa, Homo Sapiens
SAIDRIFTL

SEQ ID NO: 142512 - protein, 9 aa, Homo Sapiens
SAIEIYLKL

SEQ ID NO: 142513 - protein, 9 aa, Homo Sapiens
SAIFNFQSL

SEQ ID NO: 142514 - protein, 9 aa, Homo Sapiens
SAIFPDVAL

SEQ ID NO: 142515 - protein, 9 aa, Homo Sapiens
SAIGPFSGL

SEQ ID NO: 142516 - protein, 9 aa, Homo Sapiens
SAIGYIHSL

SEQ ID NO: 142517 - protein, 9 aa, Homo Sapiens
SAIHVLASL

SEQ ID NO: 142518 - protein, 9 aa, Homo Sapiens
SAIIFETPL

SEQ ID NO: 142519 - protein, 9 aa, Homo Sapiens
SAILRSPAF

SEQ ID NO: 142520 - protein, 9 aa, Homo Sapiens
SAINQVEAL

SEQ ID NO: 142521 - protein, 9 aa, Homo Sapiens
SAIPHPLIM

SEQ ID NO: 142522 - protein, 9 aa, Homo Sapiens
SAIPWGISA

SEQ ID NO: 142523 - protein, 9 aa, Homo Sapiens
SAITTLMHL

SEQ ID NO: 142524 - protein, 9 aa, Homo Sapiens
SALAKLSVL

SEQ ID NO: 142525 - protein, 9 aa, Homo Sapiens
SALAWQQSL

SEQ ID NO: 142526 - protein, 9 aa, Homo Sapiens
SALDTGFSL

SEQ ID NO: 142527 - protein, 9 aa, Homo Sapiens
SALEKFVEL

SEQ ID NO: 142528 - protein, 9 aa, Homo Sapiens
SALEKSLAV

SEQ ID NO: 142529 - protein, 9 aa, Homo Sapiens
SALERLTTL

SEQ ID NO: 142530 - protein, 9 aa, Homo Sapiens
SALGHLSFL

SEQ ID NO: 142531 - protein, 9 aa, Homo Sapiens
SALGKSPWL

SEQ ID NO: 142532 - protein, 9 aa, Homo Sapiens
SALHYAVEL

SEQ ID NO: 142533 - protein, 9 aa, Homo Sapiens
SALNRMKEL

SEQ ID NO: 142534 - protein, 9 aa, Homo Sapiens
SALNVRLFL

SEQ ID NO: 142535 - protein, 9 aa, Homo Sapiens
SALPFITYL

SEQ ID NO: 142536 - protein, 9 aa, Homo Sapiens
SAMAVVSRL

SEQ ID NO: 142537 - protein, 9 aa, Homo Sapiens
SAMEVVPAL

SEQ ID NO: 142538 - protein, 9 aa, Homo Sapiens
SAMKAVTEL

SEQ ID NO: 142539 - protein, 9 aa, Homo Sapiens
SAMMYIQEL

SEQ ID NO: 142540 - protein, 9 aa, Homo Sapiens
SAQGKPLAL

SEQ ID NO: 142541 - protein, 9 aa, Homo Sapiens
SAQPWIAAL

SEQ ID NO: 142542 - protein, 9 aa, Homo Sapiens
SASALAVAL

SEQ ID NO: 142543 - protein, 9 aa, Homo Sapiens
SASPASLLL

SEQ ID NO: 142544 - protein, 9 aa, Homo Sapiens
SASSFFKEL

SEQ ID NO: 142545 - protein, 9 aa, Homo Sapiens
SASTVFIAL

SEQ ID NO: 142546 - protein, 9 aa, Homo Sapiens
SATELMNIL

SEQ ID NO: 142547 - protein, 9 aa, Homo Sapiens
SATIVIAYL

SEQ ID NO: 142548 - protein, 9 aa, Homo Sapiens
SATQVFPRL

SEQ ID NO: 142549 - protein, 9 aa, Homo Sapiens
SATQVYTIL

SEQ ID NO: 142550 - protein, 9 aa, Homo Sapiens
SATRVYIVL

SEQ ID NO: 142551 - protein, 9 aa, Homo Sapiens
SAVDFIRTL

SEQ ID NO: 142552 - protein, 9 aa, Homo Sapiens
SAVDLPVTL

SEQ ID NO: 142553 - protein, 9 aa, Homo Sapiens
SAVDPVAVL

SEQ ID NO: 142554 - protein, 9 aa, Homo Sapiens
SAVDVHINM

SEQ ID NO: 142555 - protein, 9 aa, Homo Sapiens
SAVGHVFSL

SEQ ID NO: 142556 - protein, 9 aa, Homo Sapiens
SAVGKTSLL

SEQ ID NO: 142557 - protein, 9 aa, Homo Sapiens
SAVGQFVSL

SEQ ID NO: 142558 - protein, 9 aa, Homo Sapiens
SAVSHFFSL

SEQ ID NO: 142559 - protein, 9 aa, Homo Sapiens
SAVSIFHEL

SEQ ID NO: 142560 - protein, 9 aa, Homo Sapiens
SAVSSFVFL

SEQ ID NO: 142561 - protein, 9 aa, Homo Sapiens
SAVTTFEAL

SEQ ID NO: 142562 - protein, 9 aa, Homo Sapiens
SAVVQHMSL

SEQ ID NO: 142563 - protein, 9 aa, Homo Sapiens
SAVWNSPPL

SEQ ID NO: 142564 - protein, 9 aa, Homo Sapiens
SAVYVLSSM

SEQ ID NO: 142565 - protein, 9 aa, Homo Sapiens
SAYAGFLAL

SEQ ID NO: 142566 - protein, 9 aa, Homo Sapiens
SAYGKFRKL

SEQ ID NO: 142567 - protein, 9 aa, Homo Sapiens
SAYPLSVEW

SEQ ID NO: 142568 - protein, 9 aa, Homo Sapiens
SAYQNHLIL

SEQ ID NO: 142569 - protein, 9 aa, Homo Sapiens
SCYGYPIQL

SEQ ID NO: 142570 - protein, 9 aa, Homo Sapiens
SDLWPFEAI

SEQ ID NO: 142571 - protein, 9 aa, Homo Sapiens
SFLTQSYQL

SEQ ID NO: 142572 - protein, 9 aa, Homo Sapiens
SFVDLRLLL

SEQ ID NO: 142573 - protein, 9 aa, Homo Sapiens
SGIERMGPL

SEQ ID NO: 142574 - protein, 9 aa, Homo Sapiens
SGIGFGESL

SEQ ID NO: 142575 - protein, 9 aa, Homo Sapiens
SGIGVSQVL

SEQ ID NO: 142576 - protein, 9 aa, Homo Sapiens
SIAGIFKEV

SEQ ID NO: 142577 - protein, 9 aa, Homo Sapiens
SIFSGAASL

SEQ ID NO: 142578 - protein, 9 aa, Homo Sapiens
SIIAMGNTL

SEQ ID NO: 142579 - protein, 9 aa, Homo Sapiens
SIIGRLLEV

SEQ ID NO: 142580 - protein, 9 aa, Homo Sapiens
SIIGSARSL

SEQ ID NO: 142581 - protein, 9 aa, Homo Sapiens
SIILPQTEL

SEQ ID NO: 142582 - protein, 9 aa, Homo Sapiens
SILSHFQSL

SEQ ID NO: 142583 - protein, 9 aa, Homo Sapiens
SISGITMVL

SEQ ID NO: 142584 - protein, 9 aa, Homo Sapiens
SIVAPGGAL

SEQ ID NO: 142585 - protein, 9 aa, Homo Sapiens
SIVEQQLPL

SEQ ID NO: 142586 - protein, 9 aa, Homo Sapiens
SIVKPYLTL

SEQ ID NO: 142587 - protein, 9 aa, Homo Sapiens
SIYSRFVQL

SEQ ID NO: 142588 - protein, 9 aa, Homo Sapiens
SLINPSSSL

SEQ ID NO: 142589 - protein, 9 aa, Homo Sapiens
SNVYPSKPL

SEQ ID NO: 142590 - protein, 9 aa, Homo Sapiens
SQYPFPVTL

SEQ ID NO: 142591 - protein, 9 aa, Homo Sapiens
SSAPPLSEL

SEQ ID NO: 142592 - protein, 9 aa, Homo Sapiens
SSIDPGLSI

SEQ ID NO: 142593 - protein, 9 aa, Homo Sapiens
SSMLPVMAL

SEQ ID NO: 142594 - protein, 9 aa, Homo Sapiens
SSMYPPHPL

SEQ ID NO: 142595 - protein, 9 aa, Homo Sapiens
SSSAVFLII

SEQ ID NO: 142596 - protein, 9 aa, Homo Sapiens
SSSPAVLAL

SEQ ID NO: 142597 - protein, 9 aa, Homo Sapiens
SSSPVSVVL

SEQ ID NO: 142598 - protein, 9 aa, Homo Sapiens
SSTPIAPVF

SEQ ID NO: 142599 - protein, 9 aa, Homo Sapiens
SSTTVIPTL

SEQ ID NO: 142600 - protein, 9 aa, Homo Sapiens
SSVGALHAL

SEQ ID NO: 142601 - protein, 9 aa, Homo Sapiens
SSVGKVSVL

SEQ ID NO: 142602 - protein, 9 aa, Homo Sapiens
SSVHVIMYL

SEQ ID NO: 142603 - protein, 9 aa, Homo Sapiens
SSVMPGMMM

SEQ ID NO: 142604 - protein, 9 aa, Homo Sapiens
SSVPGVRLL

SEQ ID NO: 142605 - protein, 9 aa, Homo Sapiens
STDENFRYL

SEQ ID NO: 142606 - protein, 9 aa, Homo Sapiens
STFSPSLAL

SEQ ID NO: 142607 - protein, 9 aa, Homo Sapiens
STIDKVSVL

SEQ ID NO: 142608 - protein, 9 aa, Homo Sapiens
STIGIHPVC

SEQ ID NO: 142609 - protein, 9 aa, Homo Sapiens
STLNRFSAL

SEQ ID NO: 142610 - protein, 9 aa, Homo Sapiens
STLPALTAL

SEQ ID NO: 142611 - protein, 9 aa, Homo Sapiens
STPDHSFSL

SEQ ID NO: 142612 - protein, 9 aa, Homo Sapiens
SVAKESIPL

SEQ ID NO: 142613 - protein, 9 aa, Homo Sapiens
SVIEISRAL

SEQ ID NO: 142614 - protein, 9 aa, Homo Sapiens
SVIIPGMTL

SEQ ID NO: 142615 - protein, 9 aa, Homo Sapiens
SVIPPRTEL

SEQ ID NO: 142616 - protein, 9 aa, Homo Sapiens
SVISVVSYL

SEQ ID NO: 142617 - protein, 9 aa, Homo Sapiens
SVLDRPRAL

SEQ ID NO: 142618 - protein, 9 aa, Homo Sapiens
SVNGFISTL

SEQ ID NO: 142619 - protein, 9 aa, Homo Sapiens
SVVAVPLPL

SEQ ID NO: 142620 - protein, 9 aa, Homo Sapiens
SVVDVFAQL

SEQ ID NO: 142621 - protein, 9 aa, Homo Sapiens
SVVFHSTVI

SEQ ID NO: 142622 - protein, 9 aa, Homo Sapiens
TAAFPFAAL

SEQ ID NO: 142623 - protein, 9 aa, Homo Sapiens
TAAPTIGVL

SEQ ID NO: 142624 - protein, 9 aa, Homo Sapiens
TAAPVPTTL

SEQ ID NO: 142625 - protein, 9 aa, Homo Sapiens
TAAPVVPEL

SEQ ID NO: 142626 - protein, 9 aa, Homo Sapiens
TAASPTIAL

SEQ ID NO: 142627 - protein, 9 aa, Homo Sapiens
TAFHSSMAL

SEQ ID NO: 142628 - protein, 9 aa, Homo Sapiens
TAFPQRTEL

SEQ ID NO: 142629 - protein, 9 aa, Homo Sapiens
TAIAESPVI

SEQ ID NO: 142630 - protein, 9 aa, Homo Sapiens
TAIDWFHEW

SEQ ID NO: 142631 - protein, 9 aa, Homo Sapiens
TAIESTPTL

SEQ ID NO: 142632 - protein, 9 aa, Homo Sapiens
TAIIPNSQL

SEQ ID NO: 142633 - protein, 9 aa, Homo Sapiens
TAINHFFIW

SEQ ID NO: 142634 - protein, 9 aa, Homo Sapiens
TAIPISMVL

SEQ ID NO: 142635 - protein, 9 aa, Homo Sapiens
TAIPVTQEL

SEQ ID NO: 142636 - protein, 9 aa, Homo Sapiens
TAIRSGLEL

SEQ ID NO: 142637 - protein, 9 aa, Homo Sapiens
TAISFAPYL

SEQ ID NO: 142638 - protein, 9 aa, Homo Sapiens
TAISLFYEL

SEQ ID NO: 142639 - protein, 9 aa, Homo Sapiens
TAISRYMEL

SEQ ID NO: 142640 - protein, 9 aa, Homo Sapiens
TALGTFLFL

SEQ ID NO: 142641 - protein, 9 aa, Homo Sapiens
TALNLFFKL

SEQ ID NO: 142642 - protein, 9 aa, Homo Sapiens
TALPRIFSL

SEQ ID NO: 142643 - protein, 9 aa, Homo Sapiens
TALPSFTSL

SEQ ID NO: 142644 - protein, 9 aa, Homo Sapiens
TALSFFHML

SEQ ID NO: 142645 - protein, 9 aa, Homo Sapiens
TANKIFMVL

SEQ ID NO: 142646 - protein, 9 aa, Homo Sapiens
TASPFFRAL

SEQ ID NO: 142647 - protein, 9 aa, Homo Sapiens
TASPVAVSL

SEQ ID NO: 142648 - protein, 9 aa, Homo Sapiens
TASPVIKAV

SEQ ID NO: 142649 - protein, 9 aa, Homo Sapiens
TATFAISIL

SEQ ID NO: 142650 - protein, 9 aa, Homo Sapiens
TATPRDLVL

SEQ ID NO: 142651 - protein, 9 aa, Homo Sapiens
TAVAPNVAL

SEQ ID NO: 142652 - protein, 9 aa, Homo Sapiens
TAVENMPSL

SEQ ID NO: 142653 - protein, 9 aa, Homo Sapiens
TAVMPKVSL

SEQ ID NO: 142654 - protein, 9 aa, Homo Sapiens
TAVPTIFSL

SEQ ID NO: 142655 - protein, 9 aa, Homo Sapiens
TAVPYFSNL

SEQ ID NO: 142656 - protein, 9 aa, Homo Sapiens
TAYDNFVEL

SEQ ID NO: 142657 - protein, 9 aa, Homo Sapiens
TGIPGLEQL

SEQ ID NO: 142658 - protein, 9 aa, Homo Sapiens
TGIPVHLEL

SEQ ID NO: 142659 - protein, 9 aa, Homo Sapiens
TIDPIPHQL

SEQ ID NO: 142660 - protein, 9 aa, Homo Sapiens
TIDPNTRTL

SEQ ID NO: 142661 - protein, 9 aa, Homo Sapiens
TIIDKSKSV

SEQ ID NO: 142662 - protein, 9 aa, Homo Sapiens
TIIEATHVL

SEQ ID NO: 142663 - protein, 9 aa, Homo Sapiens
TIIPKVLAM

SEQ ID NO: 142664 - protein, 9 aa, Homo Sapiens
TIIRQNQAL

SEQ ID NO: 142665 - protein, 9 aa, Homo Sapiens
TIMPRGPTL

SEQ ID NO: 142666 - protein, 9 aa, Homo Sapiens
TITDIISAL

SEQ ID NO: 142667 - protein, 9 aa, Homo Sapiens
TIVDTGIGM

SEQ ID NO: 142668 - protein, 9 aa, Homo Sapiens
TIYDRFVHL

SEQ ID NO: 142669 - protein, 9 aa, Homo Sapiens
TIYHMFIAL

SEQ ID NO: 142670 - protein, 9 aa, Homo Sapiens
TSSPSILTL

SEQ ID NO: 142671 - protein, 9 aa, Homo Sapiens
TSVPVSAVF

SEQ ID NO: 142672 - protein, 9 aa, Homo Sapiens
TTIKPGLAL

SEQ ID NO: 142673 - protein, 9 aa, Homo Sapiens
TTMVPTAAL

SEQ ID NO: 142674 - protein, 9 aa, Homo Sapiens
TVIGAFWHL

SEQ ID NO: 142675 - protein, 9 aa, Homo Sapiens
TVIPHLMAL

SEQ ID NO: 142676 - protein, 9 aa, Homo Sapiens
TVYLRDIAL

SEQ ID NO: 142677 - protein, 9 aa, Homo Sapiens
TVYVSMIAL

SEQ ID NO: 142678 - protein, 9 aa, Homo Sapiens
VAAKKNVSI

SEQ ID NO: 142679 - protein, 9 aa, Homo Sapiens
VAAPASLSL

SEQ ID NO: 142680 - protein, 9 aa, Homo Sapiens
VAAPLGPLL

SEQ ID NO: 142681 - protein, 9 aa, Homo Sapiens
VADAIRTSL

SEQ ID NO: 142682 - protein, 9 aa, Homo Sapiens
VADPVYRTF

SEQ ID NO: 142683 - protein, 9 aa, Homo Sapiens
VADPYVVIM

SEQ ID NO: 142684 - protein, 9 aa, Homo Sapiens
VADTVYRAL

SEQ ID NO: 142685 - protein, 9 aa, Homo Sapiens
VADVRLYSL

SEQ ID NO: 142686 - protein, 9 aa, Homo Sapiens
VAFDKFWNM

SEQ ID NO: 142687 - protein, 9 aa, Homo Sapiens
VAFGPAFAL

SEQ ID NO: 142688 - protein, 9 aa, Homo Sapiens
VAFPSPAEL

SEQ ID NO: 142689 - protein, 9 aa, Homo Sapiens
VAFQHFQEL

SEQ ID NO: 142690 - protein, 9 aa, Homo Sapiens
VAFSPVTEL

SEQ ID NO: 142691 - protein, 9 aa, Homo Sapiens
VAFVGGIDL

SEQ ID NO: 142692 - protein, 9 aa, Homo Sapiens
VAIFAVDSL

SEQ ID NO: 142693 - protein, 9 aa, Homo Sapiens
VAIFPSPMM

SEQ ID NO: 142694 - protein, 9 aa, Homo Sapiens
VAIIARTDL

SEQ ID NO: 142695 - protein, 9 aa, Homo Sapiens
VAIKAGTTL

SEQ ID NO: 142696 - protein, 9 aa, Homo Sapiens
VAILRHPTL

SEQ ID NO: 142697 - protein, 9 aa, Homo Sapiens
VAIQAVLSL

SEQ ID NO: 142698 - protein, 9 aa, Homo Sapiens
VALDFEQEM

SEQ ID NO: 142699 - protein, 9 aa, Homo Sapiens
VALGNMYEL

SEQ ID NO: 142700 - protein, 9 aa, Homo Sapiens
VALLRVTPF

SEQ ID NO: 142701 - protein, 9 aa, Homo Sapiens
VALNAHTFL

SEQ ID NO: 142702 - protein, 9 aa, Homo Sapiens
VALPASGWL

SEQ ID NO: 142703 - protein, 9 aa, Homo Sapiens
VALPMVLVL

SEQ ID NO: 142704 - protein, 9 aa, Homo Sapiens
VALPPGLAV

SEQ ID NO: 142705 - protein, 9 aa, Homo Sapiens
VALPVVYSL

SEQ ID NO: 142706 - protein, 9 aa, Homo Sapiens
VALPVYLLI

SEQ ID NO: 142707 - protein, 9 aa, Homo Sapiens
VALVVGHEL

SEQ ID NO: 142708 - protein, 9 aa, Homo Sapiens
VAMTGEITL

SEQ ID NO: 142709 - protein, 9 aa, Homo Sapiens
VAMYGGLVL

SEQ ID NO: 142710 - protein, 9 aa, Homo Sapiens
VANGKLMIL

SEQ ID NO: 142711 - protein, 9 aa, Homo Sapiens
VANPEHMEM

SEQ ID NO: 142712 - protein, 9 aa, Homo Sapiens
VANPNSAIF

SEQ ID NO: 142713 - protein, 9 aa, Homo Sapiens
VANPVPASL

SEQ ID NO: 142714 - protein, 9 aa, Homo Sapiens
VANVSLLAL

SEQ ID NO: 142715 - protein, 9 aa, Homo Sapiens
VAQELPTTL

SEQ ID NO: 142716 - protein, 9 aa, Homo Sapiens
VAQFKFTVL

SEQ ID NO: 142717 - protein, 9 aa, Homo Sapiens
VAQGGWRSL

SEQ ID NO: 142718 - protein, 9 aa, Homo Sapiens
VAQTWFRFL

SEQ ID NO: 142719 - protein, 9 aa, Homo Sapiens
VASEIMAVL

SEQ ID NO: 142720 - protein, 9 aa, Homo Sapiens
VASEYPVIL

SEQ ID NO: 142721 - protein, 9 aa, Homo Sapiens
VASFPRTVL

SEQ ID NO: 142722 - protein, 9 aa, Homo Sapiens
VATAADLEL

SEQ ID NO: 142723 - protein, 9 aa, Homo Sapiens
VATAMARVL

SEQ ID NO: 142724 - protein, 9 aa, Homo Sapiens
VATDFFTVL

SEQ ID NO: 142725 - protein, 9 aa, Homo Sapiens
VATGVISTL

SEQ ID NO: 142726 - protein, 9 aa, Homo Sapiens
VATKIFQEL

SEQ ID NO: 142727 - protein, 9 aa, Homo Sapiens
VATLYGLSL

SEQ ID NO: 142728 - protein, 9 aa, Homo Sapiens
VATQVGIEW

SEQ ID NO: 142729 - protein, 9 aa, Homo Sapiens
VAVDGINAL

SEQ ID NO: 142730 - protein, 9 aa, Homo Sapiens
VAVDVNNML

SEQ ID NO: 142731 - protein, 9 aa, Homo Sapiens
VAVGSGLSW

SEQ ID NO: 142732 - protein, 9 aa, Homo Sapiens
VAVGVIKAV

SEQ ID NO: 142733 - protein, 9 aa, Homo Sapiens
VAVHVFSEF

SEQ ID NO: 142734 - protein, 9 aa, Homo Sapiens
VAVISGEAL

SEQ ID NO: 142735 - protein, 9 aa, Homo Sapiens
VAVMTVREL

SEQ ID NO: 142736 - protein, 9 aa, Homo Sapiens
VAVNKPAEF

SEQ ID NO: 142737 - protein, 9 aa, Homo Sapiens
VAVPGGVDL

SEQ ID NO: 142738 - protein, 9 aa, Homo Sapiens
VAVPTLNAL

SEQ ID NO: 142739 - protein, 9 aa, Homo Sapiens
VAVPVAVTF

SEQ ID NO: 142740 - protein, 9 aa, Homo Sapiens
VAVQHFSLL

SEQ ID NO: 142741 - protein, 9 aa, Homo Sapiens
VAVSPSLDL

SEQ ID NO: 142742 - protein, 9 aa, Homo Sapiens
VAYDNAVNL

SEQ ID NO: 142743 - protein, 9 aa, Homo Sapiens
VAYFGLTTL

SEQ ID NO: 142744 - protein, 9 aa, Homo Sapiens
VAYGKGTYF

SEQ ID NO: 142745 - protein, 9 aa, Homo Sapiens
VAYLQAHAL

SEQ ID NO: 142746 - protein, 9 aa, Homo Sapiens
VAYMNPIAM

SEQ ID NO: 142747 - protein, 9 aa, Homo Sapiens
VAYPGIPKL

SEQ ID NO: 142748 - protein, 9 aa, Homo Sapiens
VAYVSSVAL

SEQ ID NO: 142749 - protein, 9 aa, Homo Sapiens
VAYWRQAGL

SEQ ID NO: 142750 - protein, 9 aa, Homo Sapiens
VCNPIITKL

SEQ ID NO: 142751 - protein, 9 aa, Homo Sapiens
VGAEPLLPW

SEQ ID NO: 142752 - protein, 9 aa, Homo Sapiens
VGAPVGIAL

SEQ ID NO: 142753 - protein, 9 aa, Homo Sapiens
VGDPSVHLL

SEQ ID NO: 142754 - protein, 9 aa, Homo Sapiens
VGIKPSLEL

SEQ ID NO: 142755 - protein, 9 aa, Homo Sapiens
VGVPVGSAL

SEQ ID NO: 142756 - protein, 9 aa, Homo Sapiens
VIAPNPAQL

SEQ ID NO: 142757 - protein, 9 aa, Homo Sapiens
VIIEKTYSL

SEQ ID NO: 142758 - protein, 9 aa, Homo Sapiens
VIIGKTVTL

SEQ ID NO: 142759 - protein, 9 aa, Homo Sapiens
VIIGSTHVL

SEQ ID NO: 142760 - protein, 9 aa, Homo Sapiens
VIIPRYLTL

SEQ ID NO: 142761 - protein, 9 aa, Homo Sapiens
VIIWARLAL

SEQ ID NO: 142762 - protein, 9 aa, Homo Sapiens
VILEPMQEL

SEQ ID NO: 142763 - protein, 9 aa, Homo Sapiens
VIMGLSPIL

SEQ ID NO: 142764 - protein, 9 aa, Homo Sapiens
VIMPHNMYL

SEQ ID NO: 142765 - protein, 9 aa, Homo Sapiens
VINDWFKVL

SEQ ID NO: 142766 - protein, 9 aa, Homo Sapiens
VIVTPLTEL

SEQ ID NO: 142767 - protein, 9 aa, Homo Sapiens
VIYPARISL

SEQ ID NO: 142768 - protein, 9 aa, Homo Sapiens
VNNPHFLIM

SEQ ID NO: 142769 - protein, 9 aa, Homo Sapiens
VSDFGGRSL

SEQ ID NO: 142770 - protein, 9 aa, Homo Sapiens
VSFPYVIAL

SEQ ID NO: 142771 - protein, 9 aa, Homo Sapiens
VSHPRYLEL

SEQ ID NO: 142772 - protein, 9 aa, Homo Sapiens
VSIAPLLEL

SEQ ID NO: 142773 - protein, 9 aa, Homo Sapiens
VSIRTGLEL

SEQ ID NO: 142774 - protein, 9 aa, Homo Sapiens
VSMPVFQSL

SEQ ID NO: 142775 - protein, 9 aa, Homo Sapiens
VSSPTMPHL

SEQ ID NO: 142776 - protein, 9 aa, Homo Sapiens
VSTPQIVSL

SEQ ID NO: 142777 - protein, 9 aa, Homo Sapiens
VSVPYPSSL

SEQ ID NO: 142778 - protein, 9 aa, Homo Sapiens
VSYPLSLEL

SEQ ID NO: 142779 - protein, 9 aa, Homo Sapiens
VTDHNLHEL

SEQ ID NO: 142780 - protein, 9 aa, Homo Sapiens
VTIARAIEL

SEQ ID NO: 142781 - protein, 9 aa, Homo Sapiens
VTVPPGPSL

SEQ ID NO: 142782 - protein, 9 aa, Homo Sapiens
VTVQPSPYL

SEQ ID NO: 142783 - protein, 9 aa, Homo Sapiens
VTVRPGLAM

SEQ ID NO: 142784 - protein, 9 aa, Homo Sapiens
VVAPAGITL

SEQ ID NO: 142785 - protein, 9 aa, Homo Sapiens
VVAPAGVTL

SEQ ID NO: 142786 - protein, 9 aa, Homo Sapiens
VVAPPGVVV

SEQ ID NO: 142787 - protein, 9 aa, Homo Sapiens
VVIEPISEL

SEQ ID NO: 142788 - protein, 9 aa, Homo Sapiens
VVIGKMLIL

SEQ ID NO: 142789 - protein, 9 aa, Homo Sapiens
VVIGNIGAL

SEQ ID NO: 142790 - protein, 9 aa, Homo Sapiens
VVKPPGSSL

SEQ ID NO: 142791 - protein, 9 aa, Homo Sapiens
VVNGAFMVL

SEQ ID NO: 142792 - protein, 9 aa, Homo Sapiens
VVNGRVLEL

SEQ ID NO: 142793 - protein, 9 aa, Homo Sapiens
VVVAVGRAL

SEQ ID NO: 142794 - protein, 9 aa, Homo Sapiens
VVVDPIQSV

SEQ ID NO: 142795 - protein, 9 aa, Homo Sapiens
VVVQPYNSL

SEQ ID NO: 142796 - protein, 9 aa, Homo Sapiens
WADAMAKVL

SEQ ID NO: 142797 - protein, 9 aa, Homo Sapiens
WAEWGHREL

SEQ ID NO: 142798 - protein, 9 aa, Homo Sapiens
WAMDLRPEL

SEQ ID NO: 142799 - protein, 9 aa, Homo Sapiens
WAQPGGAAF

SEQ ID NO: 142800 - protein, 9 aa, Homo Sapiens
WASEVGPVL

SEQ ID NO: 142801 - protein, 9 aa, Homo Sapiens
WASPPGRWL

SEQ ID NO: 142802 - protein, 9 aa, Homo Sapiens
WAVSPETEL

SEQ ID NO: 142803 - protein, 9 aa, Homo Sapiens
WAVTGVSSL

SEQ ID NO: 142804 - protein, 9 aa, Homo Sapiens
WAYPRQVFI

SEQ ID NO: 142805 - protein, 9 aa, Homo Sapiens
WQNPHMLFL

SEQ ID NO: 142806 - protein, 9 aa, Homo Sapiens
WSQDLFRAL

SEQ ID NO: 142807 - protein, 9 aa, Homo Sapiens
YAADNQIYI

SEQ ID NO: 142808 - protein, 9 aa, Homo Sapiens
YAAGAKLVL

SEQ ID NO: 142809 - protein, 9 aa, Homo Sapiens
YAANPGQLF

SEQ ID NO: 142810 - protein, 9 aa, Homo Sapiens
YAAPHFFHL

SEQ ID NO: 142811 - protein, 9 aa, Homo Sapiens
YAAPWFLTL

SEQ ID NO: 142812 - protein, 9 aa, Homo Sapiens
YAAQAHLKL

SEQ ID NO: 142813 - protein, 9 aa, Homo Sapiens
YAASAIGYL

SEQ ID NO: 142814 - protein, 9 aa, Homo Sapiens
YAASDMLQL

SEQ ID NO: 142815 - protein, 9 aa, Homo Sapiens
YAAYPLTEV

SEQ ID NO: 142816 - protein, 9 aa, Homo Sapiens
YADPSILYI

SEQ ID NO: 142817 - protein, 9 aa, Homo Sapiens
YADVGGKQF

SEQ ID NO: 142818 - protein, 9 aa, Homo Sapiens
YADVIVHRL

SEQ ID NO: 142819 - protein, 9 aa, Homo Sapiens
YAEDRERFF

SEQ ID NO: 142820 - protein, 9 aa, Homo Sapiens
YAEEFRTYL

SEQ ID NO: 142821 - protein, 9 aa, Homo Sapiens
YAEIVHLTL

SEQ ID NO: 142822 - protein, 9 aa, Homo Sapiens
YAENAMRYI

SEQ ID NO: 142823 - protein, 9 aa, Homo Sapiens
YAETIAHIL

SEQ ID NO: 142824 - protein, 9 aa, Homo Sapiens
YAEVGRVLL

SEQ ID NO: 142825 - protein, 9 aa, Homo Sapiens
YAFDFARQS

SEQ ID NO: 142826 - protein, 9 aa, Homo Sapiens
YAFGGGCEL

SEQ ID NO: 142827 - protein, 9 aa, Homo Sapiens
YAFNHSADF

SEQ ID NO: 142828 - protein, 9 aa, Homo Sapiens
YAFPKAVSV

SEQ ID NO: 142829 - protein, 9 aa, Homo Sapiens
YAFPKAVTV

SEQ ID NO: 142830 - protein, 9 aa, Homo Sapiens
YAFPKSITV

SEQ ID NO: 142831 - protein, 9 aa, Homo Sapiens
YAFPLAHSL

SEQ ID NO: 142832 - protein, 9 aa, Homo Sapiens
YAFPVSNNL

SEQ ID NO: 142833 - protein, 9 aa, Homo Sapiens
YAFQDDRYL

SEQ ID NO: 142834 - protein, 9 aa, Homo Sapiens
YAFSGVEEL

SEQ ID NO: 142835 - protein, 9 aa, Homo Sapiens
YAFSPRNSL

SEQ ID NO: 142836 - protein, 9 aa, Homo Sapiens
YAFTALDAL

SEQ ID NO: 142837 - protein, 9 aa, Homo Sapiens
YAFVRPVIL

SEQ ID NO: 142838 - protein, 9 aa, Homo Sapiens
YAGDVSMFL

SEQ ID NO: 142839 - protein, 9 aa, Homo Sapiens
YAGYIPQAF

SEQ ID NO: 142840 - protein, 9 aa, Homo Sapiens
YAHLTPREL

SEQ ID NO: 142841 - protein, 9 aa, Homo Sapiens
YAHLTYVTL

SEQ ID NO: 142842 - protein, 9 aa, Homo Sapiens
YAIARFKFL

SEQ ID NO: 142843 - protein, 9 aa, Homo Sapiens
YAIDNPLHY

SEQ ID NO: 142844 - protein, 9 aa, Homo Sapiens
YAIEKVREI

SEQ ID NO: 142845 - protein, 9 aa, Homo Sapiens
YAIESQLQL

SEQ ID NO: 142846 - protein, 9 aa, Homo Sapiens
YAIEVDPVL

SEQ ID NO: 142847 - protein, 9 aa, Homo Sapiens
YAIFKSQDF

SEQ ID NO: 142848 - protein, 9 aa, Homo Sapiens
YAIGLVMRL

SEQ ID NO: 142849 - protein, 9 aa, Homo Sapiens
YAIGVSHPL

SEQ ID NO: 142850 - protein, 9 aa, Homo Sapiens
YAIHGVLEV

SEQ ID NO: 142851 - protein, 9 aa, Homo Sapiens
YAINFIHAT

SEQ ID NO: 142852 - protein, 9 aa, Homo Sapiens
YAINQPDVL

SEQ ID NO: 142853 - protein, 9 aa, Homo Sapiens
YAIPKFKHL

SEQ ID NO: 142854 - protein, 9 aa, Homo Sapiens
YAIRGVPSL

SEQ ID NO: 142855 - protein, 9 aa, Homo Sapiens
YAISKPEVL

SEQ ID NO: 142856 - protein, 9 aa, Homo Sapiens
YAISPGLDI

SEQ ID NO: 142857 - protein, 9 aa, Homo Sapiens
YAITTLHNL

SEQ ID NO: 142858 - protein, 9 aa, Homo Sapiens
YAKDDPLEF

SEQ ID NO: 142859 - protein, 9 aa, Homo Sapiens
YAKRPGIGL

SEQ ID NO: 142860 - protein, 9 aa, Homo Sapiens
YALDLSTFL

SEQ ID NO: 142861 - protein, 9 aa, Homo Sapiens
YALERLKVM

SEQ ID NO: 142862 - protein, 9 aa, Homo Sapiens
YALGALNHL

SEQ ID NO: 142863 - protein, 9 aa, Homo Sapiens
YALLGRTLL

SEQ ID NO: 142864 - protein, 9 aa, Homo Sapiens
YALNHTLSV

SEQ ID NO: 142865 - protein, 9 aa, Homo Sapiens
YALPAGLEV

SEQ ID NO: 142866 - protein, 9 aa, Homo Sapiens
YALPAGLSA

SEQ ID NO: 142867 - protein, 9 aa, Homo Sapiens
YALPKSLSV

SEQ ID NO: 142868 - protein, 9 aa, Homo Sapiens
YALTAIMKL

SEQ ID NO: 142869 - protein, 9 aa, Homo Sapiens
YALTSPLQL

SEQ ID NO: 142870 - protein, 9 aa, Homo Sapiens
YAMDELRSL

SEQ ID NO: 142871 - protein, 9 aa, Homo Sapiens
YAMDIVKGL

SEQ ID NO: 142872 - protein, 9 aa, Homo Sapiens
YAMISSPFM

SEQ ID NO: 142873 - protein, 9 aa, Homo Sapiens
YANAKIYKL

SEQ ID NO: 142874 - protein, 9 aa, Homo Sapiens
YANAVLQAL

SEQ ID NO: 142875 - protein, 9 aa, Homo Sapiens
YANDVTRVL

SEQ ID NO: 142876 - protein, 9 aa, Homo Sapiens
YANFNRIIL

SEQ ID NO: 142877 - protein, 9 aa, Homo Sapiens
YANSKAVTL

SEQ ID NO: 142878 - protein, 9 aa, Homo Sapiens
YANYYTREV

SEQ ID NO: 142879 - protein, 9 aa, Homo Sapiens
YAPYPSPVL

SEQ ID NO: 142880 - protein, 9 aa, Homo Sapiens
YAQIRTIAI

SEQ ID NO: 142881 - protein, 9 aa, Homo Sapiens
YAQLHSLTL

SEQ ID NO: 142882 - protein, 9 aa, Homo Sapiens
YASDYFDQL

SEQ ID NO: 142883 - protein, 9 aa, Homo Sapiens
YASGINVNL

SEQ ID NO: 142884 - protein, 9 aa, Homo Sapiens
YASLRIEEL

SEQ ID NO: 142885 - protein, 9 aa, Homo Sapiens
YASNITSVL

SEQ ID NO: 142886 - protein, 9 aa, Homo Sapiens
YASSPGMSL

SEQ ID NO: 142887 - protein, 9 aa, Homo Sapiens
YATIILSKM

SEQ ID NO: 142888 - protein, 9 aa, Homo Sapiens
YATLFAQAL

SEQ ID NO: 142889 - protein, 9 aa, Homo Sapiens
YAVELFEGL

SEQ ID NO: 142890 - protein, 9 aa, Homo Sapiens
YAVGGYTRL

SEQ ID NO: 142891 - protein, 9 aa, Homo Sapiens
YAVGIQQVL

SEQ ID NO: 142892 - protein, 9 aa, Homo Sapiens
YAVHEGLGL

SEQ ID NO: 142893 - protein, 9 aa, Homo Sapiens
YAVNSQFTM

SEQ ID NO: 142894 - protein, 9 aa, Homo Sapiens
YAVRDTIAL

SEQ ID NO: 142895 - protein, 9 aa, Homo Sapiens
YAVTGDVKM

SEQ ID NO: 142896 - protein, 9 aa, Homo Sapiens
YAYAAQNLL

SEQ ID NO: 142897 - protein, 9 aa, Homo Sapiens
YAYDGKDYI

SEQ ID NO: 142898 - protein, 9 aa, Homo Sapiens
YAYEKPHVV

SEQ ID NO: 142899 - protein, 9 aa, Homo Sapiens
YAYETKDAL

SEQ ID NO: 142900 - protein, 9 aa, Homo Sapiens
YAYFNFPEL

SEQ ID NO: 142901 - protein, 9 aa, Homo Sapiens
YAYGQYNMP

SEQ ID NO: 142902 - protein, 9 aa, Homo Sapiens
YAYLKAIVL

SEQ ID NO: 142903 - protein, 9 aa, Homo Sapiens
YAYLYIRML

SEQ ID NO: 142904 - protein, 9 aa, Homo Sapiens
YAYPGVLLI

SEQ ID NO: 142905 - protein, 9 aa, Homo Sapiens
YAYRDAVFL

SEQ ID NO: 142906 - protein, 9 aa, Homo Sapiens
YAYTGRLEL

SEQ ID NO: 142907 - protein, 9 aa, Homo Sapiens
YCIPVVQSL

SEQ ID NO: 142908 - protein, 9 aa, Homo Sapiens
YCTEIFDYL

SEQ ID NO: 142909 - protein, 9 aa, Homo Sapiens
YFNPHTVTL

SEQ ID NO: 142910 - protein, 9 aa, Homo Sapiens
YGDLGGPII

SEQ ID NO: 142911 - protein, 9 aa, Homo Sapiens
YGFQYPLAM

SEQ ID NO: 142912 - protein, 9 aa, Homo Sapiens
YGIEHALAL

SEQ ID NO: 142913 - protein, 9 aa, Homo Sapiens
YGINNIREL

SEQ ID NO: 142914 - protein, 9 aa, Homo Sapiens
YGITSPISL

SEQ ID NO: 142915 - protein, 9 aa, Homo Sapiens
YGLDLHPTI

SEQ ID NO: 142916 - protein, 9 aa, Homo Sapiens
YGNPNTLRL

SEQ ID NO: 142917 - protein, 9 aa, Homo Sapiens
YGSFVTRAL

SEQ ID NO: 142918 - protein, 9 aa, Homo Sapiens
YGSPGILEF

SEQ ID NO: 142919 - protein, 9 aa, Homo Sapiens
YGSPNALVL

SEQ ID NO: 142920 - protein, 9 aa, Homo Sapiens
YGVTVFKAL

SEQ ID NO: 142921 - protein, 9 aa, Homo Sapiens
YGYEHILTL

SEQ ID NO: 142922 - protein, 9 aa, Homo Sapiens
YGYSNPKIL

SEQ ID NO: 142923 - protein, 9 aa, Homo Sapiens
YIDDVFHAL

SEQ ID NO: 142924 - protein, 9 aa, Homo Sapiens
YIDEGRLVL

SEQ ID NO: 142925 - protein, 9 aa, Homo Sapiens
YIIDPQNGL

SEQ ID NO: 142926 - protein, 9 aa, Homo Sapiens
YIIIPKSSL

SEQ ID NO: 142927 - protein, 9 aa, Homo Sapiens
YIIPVVLFL

SEQ ID NO: 142928 - protein, 9 aa, Homo Sapiens
YIIVPPLTL

SEQ ID NO: 142929 - protein, 9 aa, Homo Sapiens
YILDPKQAL

SEQ ID NO: 142930 - protein, 9 aa, Homo Sapiens
YILGKFFAL

SEQ ID NO: 142931 - protein, 9 aa, Homo Sapiens
YILPFSEVL

SEQ ID NO: 142932 - protein, 9 aa, Homo Sapiens
YILPWESEL

SEQ ID NO: 142933 - protein, 9 aa, Homo Sapiens
YIMDWMDEM

SEQ ID NO: 142934 - protein, 9 aa, Homo Sapiens
YINPRAVQL

SEQ ID NO: 142935 - protein, 9 aa, Homo Sapiens
YISAKPLEM

SEQ ID NO: 142936 - protein, 9 aa, Homo Sapiens
YITAAYVEM

SEQ ID NO: 142937 - protein, 9 aa, Homo Sapiens
YITDFLARL

SEQ ID NO: 142938 - protein, 9 aa, Homo Sapiens
YITDLFQVL

SEQ ID NO: 142939 - protein, 9 aa, Homo Sapiens
YITGHVLVV

SEQ ID NO: 142940 - protein, 9 aa, Homo Sapiens
YIVDHTIIM

SEQ ID NO: 142941 - protein, 9 aa, Homo Sapiens
YIVKWPLSL

SEQ ID NO: 142942 - protein, 9 aa, Homo Sapiens
YIYPNIIAM

SEQ ID NO: 142943 - protein, 9 aa, Homo Sapiens
YLADIFTKL

SEQ ID NO: 142944 - protein, 9 aa, Homo Sapiens
YLADVTNAL

SEQ ID NO: 142945 - protein, 9 aa, Homo Sapiens
YLAPHVRTL

SEQ ID NO: 142946 - protein, 9 aa, Homo Sapiens
YLFERIKEL

SEQ ID NO: 142947 - protein, 9 aa, Homo Sapiens
YLIARVMLL

SEQ ID NO: 142948 - protein, 9 aa, Homo Sapiens
YLIEPDVEL

SEQ ID NO: 142949 - protein, 9 aa, Homo Sapiens
YLIGVHASL

SEQ ID NO: 142950 - protein, 9 aa, Homo Sapiens
YLIPFSSKL

SEQ ID NO: 142951 - protein, 9 aa, Homo Sapiens
YLLDHFLSM

SEQ ID NO: 142952 - protein, 9 aa, Homo Sapiens
YLLDLHSYL

SEQ ID NO: 142953 - protein, 9 aa, Homo Sapiens
YLLEKSRAI

SEQ ID NO: 142954 - protein, 9 aa, Homo Sapiens
YLLEKSRIV

SEQ ID NO: 142955 - protein, 9 aa, Homo Sapiens
YLLEKSRVI

SEQ ID NO: 142956 - protein, 9 aa, Homo Sapiens
YLLESVNKL

SEQ ID NO: 142957 - protein, 9 aa, Homo Sapiens
YLNETFSEL

SEQ ID NO: 142958 - protein, 9 aa, Homo Sapiens
YLNEWLQIL

SEQ ID NO: 142959 - protein, 9 aa, Homo Sapiens
YLQDEFRIL

SEQ ID NO: 142960 - protein, 9 aa, Homo Sapiens
YLQIHPQEL

SEQ ID NO: 142961 - protein, 9 aa, Homo Sapiens
YLTAEILEL

SEQ ID NO: 142962 - protein, 9 aa, Homo Sapiens
YLVPQARAL

SEQ ID NO: 142963 - protein, 9 aa, Homo Sapiens
YMDAPKAAL

SEQ ID NO: 142964 - protein, 9 aa, Homo Sapiens
YMIAHITGL

SEQ ID NO: 142965 - protein, 9 aa, Homo Sapiens
YMLEHVITL

SEQ ID NO: 142966 - protein, 9 aa, Homo Sapiens
YMYQLFRSL

SEQ ID NO: 142967 - protein, 9 aa, Homo Sapiens
YNIDSHLLL

SEQ ID NO: 142968 - protein, 9 aa, Homo Sapiens
YQEKGVRVL

SEQ ID NO: 142969 - protein, 9 aa, Homo Sapiens
YQEVGAKVL

SEQ ID NO: 142970 - protein, 9 aa, Homo Sapiens
YQIAVTKVL

SEQ ID NO: 142971 - protein, 9 aa, Homo Sapiens
YQIPTENSM

SEQ ID NO: 142972 - protein, 9 aa, Homo Sapiens
YQMEMMRSL

SEQ ID NO: 142973 - protein, 9 aa, Homo Sapiens
YQNPQITQL

SEQ ID NO: 142974 - protein, 9 aa, Homo Sapiens
YQQELEREL

SEQ ID NO: 142975 - protein, 9 aa, Homo Sapiens
YQVGVHYEL

SEQ ID NO: 142976 - protein, 9 aa, Homo Sapiens
YQYLLVTAL

SEQ ID NO: 142977 - protein, 9 aa, Homo Sapiens
YQYPRPLLI

SEQ ID NO: 142978 - protein, 9 aa, Homo Sapiens
YSADGHSIL

SEQ ID NO: 142979 - protein, 9 aa, Homo Sapiens
YSAEPLPEL

SEQ ID NO: 142980 - protein, 9 aa, Homo Sapiens
YSAPVIHVL

SEQ ID NO: 142981 - protein, 9 aa, Homo Sapiens
YSDDIPHAL

SEQ ID NO: 142982 - protein, 9 aa, Homo Sapiens
YSDDTLKQL

SEQ ID NO: 142983 - protein, 9 aa, Homo Sapiens
YSDFVVHEI

SEQ ID NO: 142984 - protein, 9 aa, Homo Sapiens
YSDPRFLNL

SEQ ID NO: 142985 - protein, 9 aa, Homo Sapiens
YSDSFPMEL

SEQ ID NO: 142986 - protein, 9 aa, Homo Sapiens
YSFDYPSDM

SEQ ID NO: 142987 - protein, 9 aa, Homo Sapiens
YSFHKFHYL

SEQ ID NO: 142988 - protein, 9 aa, Homo Sapiens
YSFYNQQTL

SEQ ID NO: 142989 - protein, 9 aa, Homo Sapiens
YSIAQFKYL

SEQ ID NO: 142990 - protein, 9 aa, Homo Sapiens
YSIGPNSKL

SEQ ID NO: 142991 - protein, 9 aa, Homo Sapiens
YSINMNVFL

SEQ ID NO: 142992 - protein, 9 aa, Homo Sapiens
YSIVGLSSL

SEQ ID NO: 142993 - protein, 9 aa, Homo Sapiens
YSIYVYKVL

SEQ ID NO: 142994 - protein, 9 aa, Homo Sapiens
YSKLPGVSL

SEQ ID NO: 142995 - protein, 9 aa, Homo Sapiens
YSLAAALTL

SEQ ID NO: 142996 - protein, 9 aa, Homo Sapiens
YSLDHISSL

SEQ ID NO: 142997 - protein, 9 aa, Homo Sapiens
YSLPNAPTL

SEQ ID NO: 142998 - protein, 9 aa, Homo Sapiens
YSLQPPSAL

SEQ ID NO: 142999 - protein, 9 aa, Homo Sapiens
YSMPISIEF

SEQ ID NO: 143000 - protein, 9 aa, Homo Sapiens
YSMPSTHAM

SEQ ID NO: 143001 - protein, 9 aa, Homo Sapiens
YSMPVHAAV

SEQ ID NO: 143002 - protein, 9 aa, Homo Sapiens
YSQSPALEL

SEQ ID NO: 143003 - protein, 9 aa, Homo Sapiens
YSSPFDPVL

SEQ ID NO: 143004 - protein, 9 aa, Homo Sapiens
YSTDENLIL

SEQ ID NO: 143005 - protein, 9 aa, Homo Sapiens
YSVPFYPTF

SEQ ID NO: 143006 - protein, 9 aa, Homo Sapiens
YSVRVSPQM

SEQ ID NO: 143007 - protein, 9 aa, Homo Sapiens
YSVYVYKVL

SEQ ID NO: 143008 - protein, 9 aa, Homo Sapiens
YSWVGRPLL

SEQ ID NO: 143009 - protein, 9 aa, Homo Sapiens
YSYDLSHSL

SEQ ID NO: 143010 - protein, 9 aa, Homo Sapiens
YSYFSPRTM

SEQ ID NO: 143011 - protein, 9 aa, Homo Sapiens
YTAFARLSL

SEQ ID NO: 143012 - protein, 9 aa, Homo Sapiens
YTFSEPFHL

SEQ ID NO: 143013 - protein, 9 aa, Homo Sapiens
YTIENPRHF

SEQ ID NO: 143014 - protein, 9 aa, Homo Sapiens
YTIHFIEEM

SEQ ID NO: 143015 - protein, 9 aa, Homo Sapiens
YTIMSPAVL

SEQ ID NO: 143016 - protein, 9 aa, Homo Sapiens
YTIPAHQNL

SEQ ID NO: 143017 - protein, 9 aa, Homo Sapiens
YTIPLAIKL

SEQ ID NO: 143018 - protein, 9 aa, Homo Sapiens
YTIPLSPVL

SEQ ID NO: 143019 - protein, 9 aa, Homo Sapiens
YTIPPGHQV

SEQ ID NO: 143020 - protein, 9 aa, Homo Sapiens
YTLINHRVL

SEQ ID NO: 143021 - protein, 9 aa, Homo Sapiens
YTLLHNPTL

SEQ ID NO: 143022 - protein, 9 aa, Homo Sapiens
YTMVYWHAL

SEQ ID NO: 143023 - protein, 9 aa, Homo Sapiens
YTNPSGIVL

SEQ ID NO: 143024 - protein, 9 aa, Homo Sapiens
YTSEVQAIL

SEQ ID NO: 143025 - protein, 9 aa, Homo Sapiens
YTSGTFRTV

SEQ ID NO: 143026 - protein, 9 aa, Homo Sapiens
YTSPVNPAV

SEQ ID NO: 143027 - protein, 9 aa, Homo Sapiens
YTTDFIFNL

SEQ ID NO: 143028 - protein, 9 aa, Homo Sapiens
YTTDFIYQL

SEQ ID NO: 143029 - protein, 9 aa, Homo Sapiens
YTTDRVMTV

SEQ ID NO: 143030 - protein, 9 aa, Homo Sapiens
YTVLTRIGL

SEQ ID NO: 143031 - protein, 9 aa, Homo Sapiens
YTVPAGMTV

SEQ ID NO: 143032 - protein, 9 aa, Homo Sapiens
YVAQAGLEL

SEQ ID NO: 143033 - protein, 9 aa, Homo Sapiens
YVDPVNKVL

SEQ ID NO: 143034 - protein, 9 aa, Homo Sapiens
YVENQFREF

SEQ ID NO: 143035 - protein, 9 aa, Homo Sapiens
YVFPGVTRL

SEQ ID NO: 143036 - protein, 9 aa, Homo Sapiens
YVHPFIFAL

SEQ ID NO: 143037 - protein, 9 aa, Homo Sapiens
YVIAYIRDL

SEQ ID NO: 143038 - protein, 9 aa, Homo Sapiens
YVIDPIKGL

SEQ ID NO: 143039 - protein, 9 aa, Homo Sapiens
YVINVTTHL

SEQ ID NO: 143040 - protein, 9 aa, Homo Sapiens
YVIPDWKVV

SEQ ID NO: 143041 - protein, 9 aa, Homo Sapiens
YVIQKFFEF

SEQ ID NO: 143042 - protein, 9 aa, Homo Sapiens
YVLEHNLHL

SEQ ID NO: 143043 - protein, 9 aa, Homo Sapiens
YVNLPTIAL

SEQ ID NO: 143044 - protein, 9 aa, Homo Sapiens
YVPDTTISL

SEQ ID NO: 143045 - protein, 9 aa, Homo Sapiens
YVQDPFAAL

SEQ ID NO: 143046 - protein, 9 aa, Homo Sapiens
YVQIPGMEI

SEQ ID NO: 143047 - protein, 9 aa, Homo Sapiens
YVSPRILTA

SEQ ID NO: 143048 - protein, 9 aa, Homo Sapiens
YVTSVILHI

SEQ ID NO: 143049 - protein, 9 aa, Homo Sapiens
YVVDDAAVL

SEQ ID NO: 143050 - protein, 9 aa, Homo Sapiens
YVVPGETAL

SEQ ID NO: 143051 - protein, 9 aa, Homo Sapiens
YVVPYMIHL

SEQ ID NO: 143052 - protein, 9 aa, Homo Sapiens
YVVPYTIHL

SEQ ID NO: 143053 - protein, 9 aa, Homo Sapiens
YVYERMTGL

SEQ ID NO: 143054 - protein, 9 aa, Homo Sapiens
YVYSGVETL

SEQ ID NO: 143055 - protein, 9 aa, Homo Sapiens
YVYSHFLQF

SEQ ID NO: 143056 - protein, 9 aa, Homo Sapiens
YYVDFFKTL

SEQ ID NO: 143057 - protein, 10 aa, Homo Sapiens
AAAPVPTTTL

SEQ ID NO: 143058 - protein, 10 aa, Homo Sapiens
AADPGLHETL

SEQ ID NO: 143059 - protein, 10 aa, Homo Sapiens
AAFEALGTAL

SEQ ID NO: 143060 - protein, 10 aa, Homo Sapiens
AAFPGASLYL

SEQ ID NO: 143061 - protein, 10 aa, Homo Sapiens
AAIDPRVQYL

SEQ ID NO: 143062 - protein, 10 aa, Homo Sapiens
AAIKPGTPLY

SEQ ID NO: 143063 - protein, 10 aa, Homo Sapiens
AAINPELLQL

SEQ ID NO: 143064 - protein, 10 aa, Homo Sapiens
AALWPIMTAL

SEQ ID NO: 143065 - protein, 10 aa, Homo Sapiens
AAYAFAPATL

SEQ ID NO: 143066 - protein, 10 aa, Homo Sapiens
AAYGFRLQSL

SEQ ID NO: 143067 - protein, 10 aa, Homo Sapiens
AEISMALGHL

SEQ ID NO: 143068 - protein, 10 aa, Homo Sapiens
ATPEQPVLDL

SEQ ID NO: 143069 - protein, 10 aa, Homo Sapiens
CAVNPKFVAL

SEQ ID NO: 143070 - protein, 10 aa, Homo Sapiens
CAVPPPNFEM

SEQ ID NO: 143071 - protein, 10 aa, Homo Sapiens
FAAPTTGNQI

SEQ ID NO: 143072 - protein, 10 aa, Homo Sapiens
FAASPSELHL

SEQ ID NO: 143073 - protein, 10 aa, Homo Sapiens
FAATADPAAL

SEQ ID NO: 143074 - protein, 10 aa, Homo Sapiens
FADDTYPRWV

SEQ ID NO: 143075 - protein, 10 aa, Homo Sapiens
FADPEVLRRL

SEQ ID NO: 143076 - protein, 10 aa, Homo Sapiens
FADPHSKRVF

SEQ ID NO: 143077 - protein, 10 aa, Homo Sapiens
FADPVDVNPF

SEQ ID NO: 143078 - protein, 10 aa, Homo Sapiens
FADSHELSEL

SEQ ID NO: 143079 - protein, 10 aa, Homo Sapiens
FAEALATHIL

SEQ ID NO: 143080 - protein, 10 aa, Homo Sapiens
FAEMLTGKTL

SEQ ID NO: 143081 - protein, 10 aa, Homo Sapiens
FAESGWRSAL

SEQ ID NO: 143082 - protein, 10 aa, Homo Sapiens
FAFESDLHSL

SEQ ID NO: 143083 - protein, 10 aa, Homo Sapiens
FAFSPDGKFL

SEQ ID NO: 143084 - protein, 10 aa, Homo Sapiens
FAFSPDGRHL

SEQ ID NO: 143085 - protein, 10 aa, Homo Sapiens
FAHVGQLTGM

SEQ ID NO: 143086 - protein, 10 aa, Homo Sapiens
FAIDSSHPWL

SEQ ID NO: 143087 - protein, 10 aa, Homo Sapiens
FAINIDNKDL

SEQ ID NO: 143088 - protein, 10 aa, Homo Sapiens
FAINSNNPWL

SEQ ID NO: 143089 - protein, 10 aa, Homo Sapiens
FAIPMIHAVL

SEQ ID NO: 143090 - protein, 10 aa, Homo Sapiens
FAIRGLAEAL

SEQ ID NO: 143091 - protein, 10 aa, Homo Sapiens
FAIRWGFIPL

SEQ ID NO: 143092 - protein, 10 aa, Homo Sapiens
FAITEPLVTF

SEQ ID NO: 143093 - protein, 10 aa, Homo Sapiens
FAIVASDTRL

SEQ ID NO: 143094 - protein, 10 aa, Homo Sapiens
FALDGLKQVM

SEQ ID NO: 143095 - protein, 10 aa, Homo Sapiens
FALGGNKQAL

SEQ ID NO: 143096 - protein, 10 aa, Homo Sapiens
FALGLPFLVL

SEQ ID NO: 143097 - protein, 10 aa, Homo Sapiens
FALPYVDHFL

SEQ ID NO: 143098 - protein, 10 aa, Homo Sapiens
FAMTGERVDL

SEQ ID NO: 143099 - protein, 10 aa, Homo Sapiens
FAPKMSEIIL

SEQ ID NO: 143100 - protein, 10 aa, Homo Sapiens
FAQQNSGHFL

SEQ ID NO: 143101 - protein, 10 aa, Homo Sapiens
FASPTSPPVL

SEQ ID NO: 143102 - protein, 10 aa, Homo Sapiens
FASTILHLVV

SEQ ID NO: 143103 - protein, 10 aa, Homo Sapiens
FATFPSSAFL

SEQ ID NO: 143104 - protein, 10 aa, Homo Sapiens
FATLTRPLAL

SEQ ID NO: 143105 - protein, 10 aa, Homo Sapiens
FAVDPQITSL

SEQ ID NO: 143106 - protein, 10 aa, Homo Sapiens
FAVEPQGPAL

SEQ ID NO: 143107 - protein, 10 aa, Homo Sapiens
FAVIGSTEEL

SEQ ID NO: 143108 - protein, 10 aa, Homo Sapiens
FAVSSKVTSM

SEQ ID NO: 143109 - protein, 10 aa, Homo Sapiens
FAVVNHQGTL

SEQ ID NO: 143110 - protein, 10 aa, Homo Sapiens
FAYGGHPYPF

SEQ ID NO: 143111 - protein, 10 aa, Homo Sapiens
FAYGQNKTAF

SEQ ID NO: 143112 - protein, 10 aa, Homo Sapiens
FAYPNRPDVL

SEQ ID NO: 143113 - protein, 10 aa, Homo Sapiens
FICPVVGLEM

SEQ ID NO: 143114 - protein, 10 aa, Homo Sapiens
FIMEGGAMVL

SEQ ID NO: 143115 - protein, 10 aa, Homo Sapiens
FINVPPQIAL

SEQ ID NO: 143116 - protein, 10 aa, Homo Sapiens
FIPEHTNLSL

SEQ ID NO: 143117 - protein, 10 aa, Homo Sapiens
FIVPTGKTGL

SEQ ID NO: 143118 - protein, 10 aa, Homo Sapiens
FIYPSNMQTM

SEQ ID NO: 143119 - protein, 10 aa, Homo Sapiens
FLESGGFRSL

SEQ ID NO: 143120 - protein, 10 aa, Homo Sapiens
FLIENPKTSL

SEQ ID NO: 143121 - protein, 10 aa, Homo Sapiens
FLPEFAGTQL

SEQ ID NO: 143122 - protein, 10 aa, Homo Sapiens
FLPTSLPPEL

SEQ ID NO: 143123 - protein, 10 aa, Homo Sapiens
FLSEHPNVTL

SEQ ID NO: 143124 - protein, 10 aa, Homo Sapiens
FLVNHDFSPL

SEQ ID NO: 143125 - protein, 10 aa, Homo Sapiens
FQLPYNGVVL

SEQ ID NO: 143126 - protein, 10 aa, Homo Sapiens
FQYPVRPASM

SEQ ID NO: 143127 - protein, 10 aa, Homo Sapiens
FSAPTPIQAL

SEQ ID NO: 143128 - protein, 10 aa, Homo Sapiens
FSDIQTGRVL

SEQ ID NO: 143129 - protein, 10 aa, Homo Sapiens
FSELSNPESL

SEQ ID NO: 143130 - protein, 10 aa, Homo Sapiens
FSFGGKLVTF

SEQ ID NO: 143131 - protein, 10 aa, Homo Sapiens
FSINAQRNAL

SEQ ID NO: 143132 - protein, 10 aa, Homo Sapiens
FSVPDVPKSM

SEQ ID NO: 143133 - protein, 10 aa, Homo Sapiens
FSVPPTEETL

SEQ ID NO: 143134 - protein, 10 aa, Homo Sapiens
FSYGFDGRGL

SEQ ID NO: 143135 - protein, 10 aa, Homo Sapiens
FSYQGRASSL

SEQ ID NO: 143136 - protein, 10 aa, Homo Sapiens
FTIPHTQEAF

SEQ ID NO: 143137 - protein, 10 aa, Homo Sapiens
FTLDPLYREL

SEQ ID NO: 143138 - protein, 10 aa, Homo Sapiens
FTMGGPAISM

SEQ ID NO: 143139 - protein, 10 aa, Homo Sapiens
FTQPSRLLSL

SEQ ID NO: 143140 - protein, 10 aa, Homo Sapiens
FVAPPGNISL

SEQ ID NO: 143141 - protein, 10 aa, Homo Sapiens
FVAPWNSLSL

SEQ ID NO: 143142 - protein, 10 aa, Homo Sapiens
FVDPNGKISL

SEQ ID NO: 143143 - protein, 10 aa, Homo Sapiens
FVLPATPPQL

SEQ ID NO: 143144 - protein, 10 aa, Homo Sapiens
FVMEGEPPKL

SEQ ID NO: 143145 - protein, 10 aa, Homo Sapiens
FVPPQGSPTM

SEQ ID NO: 143146 - protein, 10 aa, Homo Sapiens
GAIGGTPPAF

SEQ ID NO: 143147 - protein, 10 aa, Homo Sapiens
GAVLPSGNTL

SEQ ID NO: 143148 - protein, 10 aa, Homo Sapiens
HALPPSLIPL

SEQ ID NO: 143149 - protein, 10 aa, Homo Sapiens
HIYDNQGIEL

SEQ ID NO: 143150 - protein, 10 aa, Homo Sapiens
HYMPPPYASL

SEQ ID NO: 143151 - protein, 10 aa, Homo Sapiens
IADNHTPKEL

SEQ ID NO: 143152 - protein, 10 aa, Homo Sapiens
IAISPLLSSF

SEQ ID NO: 143153 - protein, 10 aa, Homo Sapiens
IAISRTPVLM

SEQ ID NO: 143154 - protein, 10 aa, Homo Sapiens
IAMENIHSEM

SEQ ID NO: 143155 - protein, 10 aa, Homo Sapiens
IAVDPRHLSL

SEQ ID NO: 143156 - protein, 10 aa, Homo Sapiens
IAVPASNSGL

SEQ ID NO: 143157 - protein, 10 aa, Homo Sapiens
IAVPAVLPSF

SEQ ID NO: 143158 - protein, 10 aa, Homo Sapiens
IAWKGDTLVL

SEQ ID NO: 143159 - protein, 10 aa, Homo Sapiens
IAWSPDDNYL

SEQ ID NO: 143160 - protein, 10 aa, Homo Sapiens
ISIEGNKMPL

SEQ ID NO: 143161 - protein, 10 aa, Homo Sapiens
ISNGELFQVL

SEQ ID NO: 143162 - protein, 10 aa, Homo Sapiens
ISVDSRSVSL

SEQ ID NO: 143163 - protein, 10 aa, Homo Sapiens
KAIGNAFAVL

SEQ ID NO: 143164 - protein, 10 aa, Homo Sapiens
KAVDPSSVAL

SEQ ID NO: 143165 - protein, 10 aa, Homo Sapiens
KAYTSQFVSL

SEQ ID NO: 143166 - protein, 10 aa, Homo Sapiens
KTPDFESTGL

SEQ ID NO: 143167 - protein, 10 aa, Homo Sapiens
LAAPGHPPVL

SEQ ID NO: 143168 - protein, 10 aa, Homo Sapiens
LAFDPSGQRL

SEQ ID NO: 143169 - protein, 10 aa, Homo Sapiens
LAFSNDGTTL

SEQ ID NO: 143170 - protein, 10 aa, Homo Sapiens
LAFSVTGTSL

SEQ ID NO: 143171 - protein, 10 aa, Homo Sapiens
LAHIYTELQL

SEQ ID NO: 143172 - protein, 10 aa, Homo Sapiens
LAINGSNLPR

SEQ ID NO: 143173 - protein, 10 aa, Homo Sapiens
LALPGKPPFL

SEQ ID NO: 143174 - protein, 10 aa, Homo Sapiens
LAMGVNLTSM

SEQ ID NO: 143175 - protein, 10 aa, Homo Sapiens
LASPLDPQAL

SEQ ID NO: 143176 - protein, 10 aa, Homo Sapiens
LATDFIQSLL

SEQ ID NO: 143177 - protein, 10 aa, Homo Sapiens
LAVDPNGAFL

SEQ ID NO: 143178 - protein, 10 aa, Homo Sapiens
LAVDPNGIYL

SEQ ID NO: 143179 - protein, 10 aa, Homo Sapiens
LAVEHDNISL

SEQ ID NO: 143180 - protein, 10 aa, Homo Sapiens
LAVHPSGVAL

SEQ ID NO: 143181 - protein, 10 aa, Homo Sapiens
LAYPARPAQL

SEQ ID NO: 143182 - protein, 10 aa, Homo Sapiens
LAYSGKLEEL

SEQ ID NO: 143183 - protein, 10 aa, Homo Sapiens
LGIPYAQPPL

SEQ ID NO: 143184 - protein, 10 aa, Homo Sapiens
LLDPNIYRTM

SEQ ID NO: 143185 - protein, 10 aa, Homo Sapiens
LLYPFAPLIL

SEQ ID NO: 143186 - protein, 10 aa, Homo Sapiens
LQPPKPLSSL

SEQ ID NO: 143187 - protein, 10 aa, Homo Sapiens
LSDVNVERVL

SEQ ID NO: 143188 - protein, 10 aa, Homo Sapiens
LSFETTEESL

SEQ ID NO: 143189 - protein, 10 aa, Homo Sapiens
LSSPFPSSSF

SEQ ID NO: 143190 - protein, 10 aa, Homo Sapiens
LSYPQTDVFL

SEQ ID NO: 143191 - protein, 10 aa, Homo Sapiens
LVHPNPPSVL

SEQ ID NO: 143192 - protein, 10 aa, Homo Sapiens
LVVEGQAVSL

SEQ ID NO: 143193 - protein, 10 aa, Homo Sapiens
MAALPFTKSL

SEQ ID NO: 143194 - protein, 10 aa, Homo Sapiens
MAIAPNVTVM

SEQ ID NO: 143195 - protein, 10 aa, Homo Sapiens
MAIDIPHIWL

SEQ ID NO: 143196 - protein, 10 aa, Homo Sapiens
MAYGASFLSF

SEQ ID NO: 143197 - protein, 10 aa, Homo Sapiens
MAYHGLTVPL

SEQ ID NO: 143198 - protein, 10 aa, Homo Sapiens
MFINIKSILW

SEQ ID NO: 143199 - protein, 10 aa, Homo Sapiens
MVPPVQVSPL

SEQ ID NO: 143200 - protein, 10 aa, Homo Sapiens
PELQPLAGSL

SEQ ID NO: 143201 - protein, 10 aa, Homo Sapiens
PEVKFNWYVD

SEQ ID NO: 143202 - protein, 10 aa, Homo Sapiens
PPPPQQERSK

SEQ ID NO: 143203 - protein, 10 aa, Homo Sapiens
QAIEPYITNF

SEQ ID NO: 143204 - protein, 10 aa, Homo Sapiens
RAMEGELGEL

SEQ ID NO: 143205 - protein, 10 aa, Homo Sapiens
SAAFPYGGVL

SEQ ID NO: 143206 - protein, 10 aa, Homo Sapiens
SAMDLPDVTL

SEQ ID NO: 143207 - protein, 10 aa, Homo Sapiens
SAVPGDLLTL

SEQ ID NO: 143208 - protein, 10 aa, Homo Sapiens
SFFENPILSF

SEQ ID NO: 143209 - protein, 10 aa, Homo Sapiens
SIIDPFGMPM

SEQ ID NO: 143210 - protein, 10 aa, Homo Sapiens
TAYPNRPMVL

SEQ ID NO: 143211 - protein, 10 aa, Homo Sapiens
VAAPPPKNSF

SEQ ID NO: 143212 - protein, 10 aa, Homo Sapiens
VADGIFKAEL

SEQ ID NO: 143213 - protein, 10 aa, Homo Sapiens
VAFLAMLLVL

SEQ ID NO: 143214 - protein, 10 aa, Homo Sapiens
VAFSPTGKYL

SEQ ID NO: 143215 - protein, 10 aa, Homo Sapiens
VALPGVAVSM

SEQ ID NO: 143216 - protein, 10 aa, Homo Sapiens
VAMNPTNTVF

SEQ ID NO: 143217 - protein, 10 aa, Homo Sapiens
VAMPGVPAFL

SEQ ID NO: 143218 - protein, 10 aa, Homo Sapiens
VAVPASLLGM

SEQ ID NO: 143219 - protein, 10 aa, Homo Sapiens
VAVVGDPIAL

SEQ ID NO: 143220 - protein, 10 aa, Homo Sapiens
VAYPRTGGTL

SEQ ID NO: 143221 - protein, 10 aa, Homo Sapiens
VAYSHDGAFL

SEQ ID NO: 143222 - protein, 10 aa, Homo Sapiens
VCAPPSRLTL

SEQ ID NO: 143223 - protein, 10 aa, Homo Sapiens
VGAPFTGSSL

SEQ ID NO: 143224 - protein, 10 aa, Homo Sapiens
VSIEPNFHSL

SEQ ID NO: 143225 - protein, 10 aa, Homo Sapiens
WADPTGTRKL

SEQ ID NO: 143226 - protein, 10 aa, Homo Sapiens
WAVEGTAVAL

SEQ ID NO: 143227 - protein, 10 aa, Homo Sapiens
YADPNFVRTF

SEQ ID NO: 143228 - protein, 10 aa, Homo Sapiens
YADPTKRLEL

SEQ ID NO: 143229 - protein, 10 aa, Homo Sapiens
YAFGRVFSGL

SEQ ID NO: 143230 - protein, 10 aa, Homo Sapiens
YAFNGTQRFL

SEQ ID NO: 143231 - protein, 10 aa, Homo Sapiens
YAFPKAVSVF

SEQ ID NO: 143232 - protein, 10 aa, Homo Sapiens
YAHPLETLIL

SEQ ID NO: 143233 - protein, 10 aa, Homo Sapiens
YAIENVETNL

SEQ ID NO: 143234 - protein, 10 aa, Homo Sapiens
YAIFDEGHML

SEQ ID NO: 143235 - protein, 10 aa, Homo Sapiens
YAIMPPLEQF

SEQ ID NO: 143236 - protein, 10 aa, Homo Sapiens
YALAARDVFL

SEQ ID NO: 143237 - protein, 10 aa, Homo Sapiens
YALCGFGGVL

SEQ ID NO: 143238 - protein, 10 aa, Homo Sapiens
YALDVRVNSL

SEQ ID NO: 143239 - protein, 10 aa, Homo Sapiens
YALGKDFVTL

SEQ ID NO: 143240 - protein, 10 aa, Homo Sapiens
YALPHAILRL

SEQ ID NO: 143241 - protein, 10 aa, Homo Sapiens
YALPHAIMRL

SEQ ID NO: 143242 - protein, 10 aa, Homo Sapiens
YAMASRDVFL

SEQ ID NO: 143243 - protein, 10 aa, Homo Sapiens
YAMRAFADAL

SEQ ID NO: 143244 - protein, 10 aa, Homo Sapiens
YASFIEDNEL

SEQ ID NO: 143245 - protein, 10 aa, Homo Sapiens
YATDVVEAFL

SEQ ID NO: 143246 - protein, 10 aa, Homo Sapiens
YAVDRAITHL

SEQ ID NO: 143247 - protein, 10 aa, Homo Sapiens
YAVEGRDLTL

SEQ ID NO: 143248 - protein, 10 aa, Homo Sapiens
YAVELVNDSL

SEQ ID NO: 143249 - protein, 10 aa, Homo Sapiens
YAVFNEDGSL

SEQ ID NO: 143250 - protein, 10 aa, Homo Sapiens
YAVPFIQPDL

SEQ ID NO: 143251 - protein, 10 aa, Homo Sapiens
YAVWFGGSML

SEQ ID NO: 143252 - protein, 10 aa, Homo Sapiens
YAYDGKDYIA

SEQ ID NO: 143253 - protein, 10 aa, Homo Sapiens
YCEPPTGVSL

SEQ ID NO: 143254 - protein, 10 aa, Homo Sapiens
YFIAPTGHSL

SEQ ID NO: 143255 - protein, 10 aa, Homo Sapiens
YFIPATGHSL

SEQ ID NO: 143256 - protein, 10 aa, Homo Sapiens
YFISPTGHSL

SEQ ID NO: 143257 - protein, 10 aa, Homo Sapiens
YFITPTGHSL

SEQ ID NO: 143258 - protein, 10 aa, Homo Sapiens
YIDEQFERYL

SEQ ID NO: 143259 - protein, 10 aa, Homo Sapiens
YIVMPNILVL

SEQ ID NO: 143260 - protein, 10 aa, Homo Sapiens
YLDPRITVAW

SEQ ID NO: 143261 - protein, 10 aa, Homo Sapiens
YLIQSVPAEL

SEQ ID NO: 143262 - protein, 10 aa, Homo Sapiens
YQDPSFHLSL

SEQ ID NO: 143263 - protein, 10 aa, Homo Sapiens
YSLFLPLHEL

SEQ ID NO: 143264 - protein, 10 aa, Homo Sapiens
YSWVGRPLLD

SEQ ID NO: 143265 - protein, 10 aa, Homo Sapiens
YTYESKMAFL

SEQ ID NO: 143266 - protein, 10 aa, Homo Sapiens
YVFDGKPPQL

SEQ ID NO: 143267 - protein, 10 aa, Homo Sapiens
YVIEPHSMEF

SEQ ID NO: 143268 - protein, 10 aa, Homo Sapiens
YVIGPKGNSL

SEQ ID NO: 143269 - protein, 10 aa, Homo Sapiens
YVIPHPVHAF

SEQ ID NO: 143270 - protein, 10 aa, Homo Sapiens
YVLDGSGHIL

SEQ ID NO: 143271 - protein, 11 aa, Homo Sapiens
AAAPAIMSYAE

SEQ ID NO: 143272 - protein, 11 aa, Homo Sapiens
AAAPPSPPFSF

SEQ ID NO: 143273 - protein, 11 aa, Homo Sapiens
AAFLAKDFNFL

SEQ ID NO: 143274 - protein, 11 aa, Homo Sapiens
AAFQPNQYQML

SEQ ID NO: 143275 - protein, 11 aa, Homo Sapiens
AAIDARIFHEL

SEQ ID NO: 143276 - protein, 11 aa, Homo Sapiens
AALPAELQREL

SEQ ID NO: 143277 - protein, 11 aa, Homo Sapiens
AALPDASPGNL

SEQ ID NO: 143278 - protein, 11 aa, Homo Sapiens
AAMASLGALAL

SEQ ID NO: 143279 - protein, 11 aa, Homo Sapiens
AAYYPSDVSSL

SEQ ID NO: 143280 - protein, 11 aa, Homo Sapiens
ATIDPDTISAL

SEQ ID NO: 143281 - protein, 11 aa, Homo Sapiens
DMNIAYALYLA

SEQ ID NO: 143282 - protein, 11 aa, Homo Sapiens
FAAVKDTILQL

SEQ ID NO: 143283 - protein, 11 aa, Homo Sapiens
FAEDTEAKNPF

SEQ ID NO: 143284 - protein, 11 aa, Homo Sapiens
FAFDSEGNYML

SEQ ID NO: 143285 - protein, 11 aa, Homo Sapiens
FAFEGIGDEDL

SEQ ID NO: 143286 - protein, 11 aa, Homo Sapiens
FAFESDLHSLL

SEQ ID NO: 143287 - protein, 11 aa, Homo Sapiens
FAFGENKMGQL

SEQ ID NO: 143288 - protein, 11 aa, Homo Sapiens
FAFQESPPRFL

SEQ ID NO: 143289 - protein, 11 aa, Homo Sapiens
FAHFPGLASEL

SEQ ID NO: 143290 - protein, 11 aa, Homo Sapiens
FAHGTAGLVFL

SEQ ID NO: 143291 - protein, 11 aa, Homo Sapiens
FAIADAAYKAM

SEQ ID NO: 143292 - protein, 11 aa, Homo Sapiens
FAINQEQKEAL

SEQ ID NO: 143293 - protein, 11 aa, Homo Sapiens
FAIYESLKKYL

SEQ ID NO: 143294 - protein, 11 aa, Homo Sapiens
FAKPVYPGQTL

SEQ ID NO: 143295 - protein, 11 aa, Homo Sapiens
FALAVRKGGAL

SEQ ID NO: 143296 - protein, 11 aa, Homo Sapiens
FALESGGGSIL

SEQ ID NO: 143297 - protein, 11 aa, Homo Sapiens
FALIPTALDAL

SEQ ID NO: 143298 - protein, 11 aa, Homo Sapiens
FALLTGPGSEL

SEQ ID NO: 143299 - protein, 11 aa, Homo Sapiens
FANTPKYSQVL

SEQ ID NO: 143300 - protein, 11 aa, Homo Sapiens
FAVADTVYRAL

SEQ ID NO: 143301 - protein, 11 aa, Homo Sapiens
FAVDNVGNRTL

SEQ ID NO: 143302 - protein, 11 aa, Homo Sapiens
FAVPIESDKTL

SEQ ID NO: 143303 - protein, 11 aa, Homo Sapiens
FAVPPALGSNL

SEQ ID NO: 143304 - protein, 11 aa, Homo Sapiens
FAVVATGETAL

SEQ ID NO: 143305 - protein, 11 aa, Homo Sapiens
FAWEPFRGLEL

SEQ ID NO: 143306 - protein, 11 aa, Homo Sapiens
FAYDGKDYLTL

SEQ ID NO: 143307 - protein, 11 aa, Homo Sapiens
FAYDPSNYEYL

SEQ ID NO: 143308 - protein, 11 aa, Homo Sapiens
FAYTGRTAQEL

SEQ ID NO: 143309 - protein, 11 aa, Homo Sapiens
FGISSVPTKGL

SEQ ID NO: 143310 - protein, 11 aa, Homo Sapiens
FILDPNQENVL

SEQ ID NO: 143311 - protein, 11 aa, Homo Sapiens
FIVPPPPEKSL

SEQ ID NO: 143312 - protein, 11 aa, Homo Sapiens
FLFDGSPTYVL

SEQ ID NO: 143313 - protein, 11 aa, Homo Sapiens
FLFKVRESGSL

SEQ ID NO: 143314 - protein, 11 aa, Homo Sapiens
FLLDPYKYMTL

SEQ ID NO: 143315 - protein, 11 aa, Homo Sapiens
FLWDVPSNWTL

SEQ ID NO: 143316 - protein, 11 aa, Homo Sapiens
FSDDPNVTKTL

SEQ ID NO: 143317 - protein, 11 aa, Homo Sapiens
FSDPTSKMRHL

SEQ ID NO: 143318 - protein, 11 aa, Homo Sapiens
FSIDVGYERFL

SEQ ID NO: 143319 - protein, 11 aa, Homo Sapiens
FSIMESPKEAL

SEQ ID NO: 143320 - protein, 11 aa, Homo Sapiens
FSLPENIQLSL

SEQ ID NO: 143321 - protein, 11 aa, Homo Sapiens
FSYESELFPTF

SEQ ID NO: 143322 - protein, 11 aa, Homo Sapiens
FTEPGAGLRAL

SEQ ID NO: 143323 - protein, 11 aa, Homo Sapiens
FTFSKDKLVAL

SEQ ID NO: 143324 - protein, 11 aa, Homo Sapiens
FYLPLDAIKQL

SEQ ID NO: 143325 - protein, 11 aa, Homo Sapiens
GFYPAEITLTW

SEQ ID NO: 143326 - protein, 11 aa, Homo Sapiens
GIHETTFNSIM

SEQ ID NO: 143327 - protein, 11 aa, Homo Sapiens
GVVDPRAISVL

SEQ ID NO: 143328 - protein, 11 aa, Homo Sapiens
HAFDSLSGISL

SEQ ID NO: 143329 - protein, 11 aa, Homo Sapiens
HAFGGLGSHAL

SEQ ID NO: 143330 - protein, 11 aa, Homo Sapiens
HAYDGKDYISL

SEQ ID NO: 143331 - protein, 11 aa, Homo Sapiens
HTIFASNTSSL

SEQ ID NO: 143332 - protein, 11 aa, Homo Sapiens
IAFDPRSAYYL

SEQ ID NO: 143333 - protein, 11 aa, Homo Sapiens
IAGPVLLILVH

SEQ ID NO: 143334 - protein, 11 aa, Homo Sapiens
IALDPDTMQAL

SEQ ID NO: 143335 - protein, 11 aa, Homo Sapiens
IECLPTSGHLS

SEQ ID NO: 143336 - protein, 11 aa, Homo Sapiens
IIHDPGRGAPL

SEQ ID NO: 143337 - protein, 11 aa, Homo Sapiens
LAIYHVIMSVL

SEQ ID NO: 143338 - protein, 11 aa, Homo Sapiens
LALDASQHSSL

SEQ ID NO: 143339 - protein, 11 aa, Homo Sapiens
LALKTGPTSGL

SEQ ID NO: 143340 - protein, 11 aa, Homo Sapiens
LARDPLAWENL

SEQ ID NO: 143341 - protein, 11 aa, Homo Sapiens
LAVDPNRAVPL

SEQ ID NO: 143342 - protein, 11 aa, Homo Sapiens
LAYLGAKPRSL

SEQ ID NO: 143343 - protein, 11 aa, Homo Sapiens
LSIEVNPNRPL

SEQ ID NO: 143344 - protein, 11 aa, Homo Sapiens
MAMSFDRYIAI

SEQ ID NO: 143345 - protein, 11 aa, Homo Sapiens
MSIYPSPTGVL

SEQ ID NO: 143346 - protein, 11 aa, Homo Sapiens
MSMEISIHRSL

SEQ ID NO: 143347 - protein, 11 aa, Homo Sapiens
PISLDLTFHLL

SEQ ID NO: 143348 - protein, 11 aa, Homo Sapiens
QAFSPSSLSSL

SEQ ID NO: 143349 - protein, 11 aa, Homo Sapiens
RAAPLDSIHSL

SEQ ID NO: 143350 - protein, 11 aa, Homo Sapiens
RAFEVSENGNL

SEQ ID NO: 143351 - protein, 11 aa, Homo Sapiens
SALRPSTSRSL

SEQ ID NO: 143352 - protein, 11 aa, Homo Sapiens
SIFFPSEGSNL

SEQ ID NO: 143353 - protein, 11 aa, Homo Sapiens
SIISPKVKMAL

SEQ ID NO: 143354 - protein, 11 aa, Homo Sapiens
TAIPVHDGYVL

SEQ ID NO: 143355 - protein, 11 aa, Homo Sapiens
TAISISDHTAL

SEQ ID NO: 143356 - protein, 11 aa, Homo Sapiens
TALDPDMIQAL

SEQ ID NO: 143357 - protein, 11 aa, Homo Sapiens
VAAPPTAVGSL

SEQ ID NO: 143358 - protein, 11 aa, Homo Sapiens
VAVDPSILARL

SEQ ID NO: 143359 - protein, 11 aa, Homo Sapiens
VAVFPKDHSSL

SEQ ID NO: 143360 - protein, 11 aa, Homo Sapiens
VAVHPSTVNPL

SEQ ID NO: 143361 - protein, 11 aa, Homo Sapiens
VAYPHDGKIFF

SEQ ID NO: 143362 - protein, 11 aa, Homo Sapiens
VAYRPISASVL

SEQ ID NO: 143363 - protein, 11 aa, Homo Sapiens
WALESDNNTAL

SEQ ID NO: 143364 - protein, 11 aa, Homo Sapiens
YADERLRINSL

SEQ ID NO: 143365 - protein, 11 aa, Homo Sapiens
YAFGQETNVPL

SEQ ID NO: 143366 - protein, 11 aa, Homo Sapiens
YAFQTEGKLYL

SEQ ID NO: 143367 - protein, 11 aa, Homo Sapiens
YAFQTGGKLYL

SEQ ID NO: 143368 - protein, 11 aa, Homo Sapiens
YAFRSAEPNAL

SEQ ID NO: 143369 - protein, 11 aa, Homo Sapiens
YAIEPGTPPLL

SEQ ID NO: 143370 - protein, 11 aa, Homo Sapiens
YAIGVSHPLSI

SEQ ID NO: 143371 - protein, 11 aa, Homo Sapiens
YAIRQSISKAL

SEQ ID NO: 143372 - protein, 11 aa, Homo Sapiens
YAISPGLDITF

SEQ ID NO: 143373 - protein, 11 aa, Homo Sapiens
YAKMGEMMLAL

SEQ ID NO: 143374 - protein, 11 aa, Homo Sapiens
YAMEQSIKSVL

SEQ ID NO: 143375 - protein, 11 aa, Homo Sapiens
YAMPTKTIEVL

SEQ ID NO: 143376 - protein, 11 aa, Homo Sapiens
YAVDAYFREAL

SEQ ID NO: 143377 - protein, 11 aa, Homo Sapiens
YAVDPAQLQAL

SEQ ID NO: 143378 - protein, 11 aa, Homo Sapiens
YAVPWQGTMTL

SEQ ID NO: 143379 - protein, 11 aa, Homo Sapiens
YAVTPLLEDAL

SEQ ID NO: 143380 - protein, 11 aa, Homo Sapiens
YAYDGKDYIAL

SEQ ID NO: 143381 - protein, 11 aa, Homo Sapiens
YAYGFEKPSAI

SEQ ID NO: 143382 - protein, 11 aa, Homo Sapiens
YAYPATAAAPM

SEQ ID NO: 143383 - protein, 11 aa, Homo Sapiens
YGAEALERMFL

SEQ ID NO: 143384 - protein, 11 aa, Homo Sapiens
YGLLPSHASYL

SEQ ID NO: 143385 - protein, 11 aa, Homo Sapiens
YIIGGSVINEL

SEQ ID NO: 143386 - protein, 11 aa, Homo Sapiens
YIMEPSIFNTL

SEQ ID NO: 143387 - protein, 11 aa, Homo Sapiens
YISVPKENSTL

SEQ ID NO: 143388 - protein, 11 aa, Homo Sapiens
YLHDQNPDAAL

SEQ ID NO: 143389 - protein, 11 aa, Homo Sapiens
YLIFTNEGRAL

SEQ ID NO: 143390 - protein, 11 aa, Homo Sapiens
YSHPVVSSVPL

SEQ ID NO: 143391 - protein, 11 aa, Homo Sapiens
YSLPTSFSGSF

SEQ ID NO: 143392 - protein, 11 aa, Homo Sapiens
YSYPAAVPQAL

SEQ ID NO: 143393 - protein, 11 aa, Homo Sapiens
YTIDPSNPMVL

SEQ ID NO: 143394 - protein, 11 aa, Homo Sapiens
YTLSPENLQSL

SEQ ID NO: 143395 - protein, 8 aa, Homo Sapiens
AFDALVTF

SEQ ID NO: 143396 - protein, 8 aa, Homo Sapiens
AFDEIVAL

SEQ ID NO: 143397 - protein, 8 aa, Homo Sapiens
AFDKHMNL

SEQ ID NO: 143398 - protein, 8 aa, Homo Sapiens
AFDMFNFL

SEQ ID NO: 143399 - protein, 8 aa, Homo Sapiens
AFDVEIHM

SEQ ID NO: 143400 - protein, 8 aa, Homo Sapiens
AFSWSSAF

SEQ ID NO: 143401 - protein, 8 aa, Homo Sapiens
ANDGFVRL

SEQ ID NO: 143402 - protein, 8 aa, Homo Sapiens
AYDIYSRL

SEQ ID NO: 143403 - protein, 8 aa, Homo Sapiens
AYDLEANL

SEQ ID NO: 143404 - protein, 8 aa, Homo Sapiens
AYDNFGVL

SEQ ID NO: 143405 - protein, 8 aa, Homo Sapiens
AYDVADMV

SEQ ID NO: 143406 - protein, 8 aa, Homo Sapiens
AYDVLIKM

SEQ ID NO: 143407 - protein, 8 aa, Homo Sapiens
AYDVTYSL

SEQ ID NO: 143408 - protein, 8 aa, Homo Sapiens
CYDALVHF

SEQ ID NO: 143409 - protein, 8 aa, Homo Sapiens
CYDNIHFM

SEQ ID NO: 143410 - protein, 8 aa, Homo Sapiens
DFDIPAEF

SEQ ID NO: 143411 - protein, 8 aa, Homo Sapiens
DFDLHSEL

SEQ ID NO: 143412 - protein, 8 aa, Homo Sapiens
DFRDGLKL

SEQ ID NO: 143413 - protein, 8 aa, Homo Sapiens
EADFPVYF

SEQ ID NO: 143414 - protein, 8 aa, Homo Sapiens
ESLIACKA

SEQ ID NO: 143415 - protein, 8 aa, Homo Sapiens
EVDMPVFF

SEQ ID NO: 143416 - protein, 8 aa, Homo Sapiens
FDPALLEF

SEQ ID NO: 143417 - protein, 8 aa, Homo Sapiens
FFDDIGYL

SEQ ID NO: 143418 - protein, 8 aa, Homo Sapiens
FFDDPMLL

SEQ ID NO: 143419 - protein, 8 aa, Homo Sapiens
FFDGAAVL

SEQ ID NO: 143420 - protein, 8 aa, Homo Sapiens
FFDHAAHL

SEQ ID NO: 143421 - protein, 8 aa, Homo Sapiens
FFDHSGTL

SEQ ID NO: 143422 - protein, 8 aa, Homo Sapiens
FFDIAHYL

SEQ ID NO: 143423 - protein, 8 aa, Homo Sapiens
FFDIASQI

SEQ ID NO: 143424 - protein, 8 aa, Homo Sapiens
FFDIFGRL

SEQ ID NO: 143425 - protein, 8 aa, Homo Sapiens
FFDLPDFL

SEQ ID NO: 143426 - protein, 8 aa, Homo Sapiens
FFDLPQQL

SEQ ID NO: 143427 - protein, 8 aa, Homo Sapiens
FFDRNLFF

SEQ ID NO: 143428 - protein, 8 aa, Homo Sapiens
FFEEFGKL

SEQ ID NO: 143429 - protein, 8 aa, Homo Sapiens
FFEIYNEL

SEQ ID NO: 143430 - protein, 8 aa, Homo Sapiens
FFESFGDL

SEQ ID NO: 143431 - protein, 8 aa, Homo Sapiens
FFSEYEKL

SEQ ID NO: 143432 - protein, 8 aa, Homo Sapiens
FFVPHGYL

SEQ ID NO: 143433 - protein, 8 aa, Homo Sapiens
FGDACVYL

SEQ ID NO: 143434 - protein, 8 aa, Homo Sapiens
FIDKPVCF

SEQ ID NO: 143435 - protein, 8 aa, Homo Sapiens
FLDEEVKL

SEQ ID NO: 143436 - protein, 8 aa, Homo Sapiens
FLDEYIFL

SEQ ID NO: 143437 - protein, 8 aa, Homo Sapiens
FLDKPTLL

SEQ ID NO: 143438 - protein, 8 aa, Homo Sapiens
FLDLEQHL

SEQ ID NO: 143439 - protein, 8 aa, Homo Sapiens
FLDVAGLL

SEQ ID NO: 143440 - protein, 8 aa, Homo Sapiens
FMDPASAL

SEQ ID NO: 143441 - protein, 8 aa, Homo Sapiens
FNDTFVHV

SEQ ID NO: 143442 - protein, 8 aa, Homo Sapiens
FQDAYVLL

SEQ ID NO: 143443 - protein, 8 aa, Homo Sapiens
FSDGAVSL

SEQ ID NO: 143444 - protein, 8 aa, Homo Sapiens
FSDVEAHF

SEQ ID NO: 143445 - protein, 8 aa, Homo Sapiens
FTDVEASL

SEQ ID NO: 143446 - protein, 8 aa, Homo Sapiens
FVDNHVEL

SEQ ID NO: 143447 - protein, 8 aa, Homo Sapiens
FVDQFVEL

SEQ ID NO: 143448 - protein, 8 aa, Homo Sapiens
FVDTEIRL

SEQ ID NO: 143449 - protein, 8 aa, Homo Sapiens
FWDGKIVL

SEQ ID NO: 143450 - protein, 8 aa, Homo Sapiens
FWDNVVYI

SEQ ID NO: 143451 - protein, 8 aa, Homo Sapiens
FYDDVTTL

SEQ ID NO: 143452 - protein, 8 aa, Homo Sapiens
FYDEVSRL

SEQ ID NO: 143453 - protein, 8 aa, Homo Sapiens
FYDFFRYV

SEQ ID NO: 143454 - protein, 8 aa, Homo Sapiens
FYDIVAEL

SEQ ID NO: 143455 - protein, 8 aa, Homo Sapiens
FYDKFILL

SEQ ID NO: 143456 - protein, 8 aa, Homo Sapiens
FYDPPRRL

SEQ ID NO: 143457 - protein, 8 aa, Homo Sapiens
FYDPTHAW

SEQ ID NO: 143458 - protein, 8 aa, Homo Sapiens
FYDRAEYL

SEQ ID NO: 143459 - protein, 8 aa, Homo Sapiens
FYDTFHTV

SEQ ID NO: 143460 - protein, 8 aa, Homo Sapiens
FYEGVVEL

SEQ ID NO: 143461 - protein, 8 aa, Homo Sapiens
FYQEHPDL

SEQ ID NO: 143462 - protein, 8 aa, Homo Sapiens
GFDDTVKF

SEQ ID NO: 143463 - protein, 8 aa, Homo Sapiens
GFDDVVRL

SEQ ID NO: 143464 - protein, 8 aa, Homo Sapiens
GKDIVWFL

SEQ ID NO: 143465 - protein, 8 aa, Homo Sapiens
GYDAVVLL

SEQ ID NO: 143466 - protein, 8 aa, Homo Sapiens
GYDGPIYM

SEQ ID NO: 143467 - protein, 8 aa, Homo Sapiens
HFDGLIFV

SEQ ID NO: 143468 - protein, 8 aa, Homo Sapiens
HFDHAVRM

SEQ ID NO: 143469 - protein, 8 aa, Homo Sapiens
HFDLAVEV

SEQ ID NO: 143470 - protein, 8 aa, Homo Sapiens
HFDLHEEM

SEQ ID NO: 143471 - protein, 8 aa, Homo Sapiens
HFDLPWYL

SEQ ID NO: 143472 - protein, 8 aa, Homo Sapiens
HFDMHGFL

SEQ ID NO: 143473 - protein, 8 aa, Homo Sapiens
HFDPEVYL

SEQ ID NO: 143474 - protein, 8 aa, Homo Sapiens
HFDPVIQL

SEQ ID NO: 143475 - protein, 8 aa, Homo Sapiens
HFDSVMQL

SEQ ID NO: 143476 - protein, 8 aa, Homo Sapiens
HFDTPVQF

SEQ ID NO: 143477 - protein, 8 aa, Homo Sapiens
HFDVTVKM

SEQ ID NO: 143478 - protein, 8 aa, Homo Sapiens
HLDRPVFL

SEQ ID NO: 143479 - protein, 8 aa, Homo Sapiens
HMDETVSF

SEQ ID NO: 143480 - protein, 8 aa, Homo Sapiens
HNDTWVLL

SEQ ID NO: 143481 - protein, 8 aa, Homo Sapiens
HVDVVVNF

SEQ ID NO: 143482 - protein, 8 aa, Homo Sapiens
HWDSEVFI

SEQ ID NO: 143483 - protein, 8 aa, Homo Sapiens
HWDVVTCL

SEQ ID NO: 143484 - protein, 8 aa, Homo Sapiens
HYDLNQLL

SEQ ID NO: 143485 - protein, 8 aa, Homo Sapiens
IADKVVFL

SEQ ID NO: 143486 - protein, 8 aa, Homo Sapiens
IFCVHGGL

SEQ ID NO: 143487 - protein, 8 aa, Homo Sapiens
IFDEAEKL

SEQ ID NO: 143488 - protein, 8 aa, Homo Sapiens
IFDEGHML

SEQ ID NO: 143489 - protein, 8 aa, Homo Sapiens
IFDEIHYM

SEQ ID NO: 143490 - protein, 8 aa, Homo Sapiens
IFDEINLM

SEQ ID NO: 143491 - protein, 8 aa, Homo Sapiens
IFDEVHYI

SEQ ID NO: 143492 - protein, 8 aa, Homo Sapiens
IFDIATEL

SEQ ID NO: 143493 - protein, 8 aa, Homo Sapiens
IFDIPGRL

SEQ ID NO: 143494 - protein, 8 aa, Homo Sapiens
IFDITNNL

SEQ ID NO: 143495 - protein, 8 aa, Homo Sapiens
IFDLSEVL

SEQ ID NO: 143496 - protein, 8 aa, Homo Sapiens
IFDLSNHL

SEQ ID NO: 143497 - protein, 8 aa, Homo Sapiens
IFDLSSEF

SEQ ID NO: 143498 - protein, 8 aa, Homo Sapiens
IFDLTSHL

SEQ ID NO: 143499 - protein, 8 aa, Homo Sapiens
IFDNFSNL

SEQ ID NO: 143500 - protein, 8 aa, Homo Sapiens
IFDNTTSL

SEQ ID NO: 143501 - protein, 8 aa, Homo Sapiens
IFDVGALL

SEQ ID NO: 143502 - protein, 8 aa, Homo Sapiens
IFDVGTRL

SEQ ID NO: 143503 - protein, 8 aa, Homo Sapiens
IFDVHTKI

SEQ ID NO: 143504 - protein, 8 aa, Homo Sapiens
IFEPFGKI

SEQ ID NO: 143505 - protein, 8 aa, Homo Sapiens
IFEPFGRI

SEQ ID NO: 143506 - protein, 8 aa, Homo Sapiens
IFSENDIF

SEQ ID NO: 143507 - protein, 8 aa, Homo Sapiens
IIAVDWLL

SEQ ID NO: 143508 - protein, 8 aa, Homo Sapiens
IIDDRVIL

SEQ ID NO: 143509 - protein, 8 aa, Homo Sapiens
IIDKEVSL

SEQ ID NO: 143510 - protein, 8 aa, Homo Sapiens
ILDEAVEL

SEQ ID NO: 143511 - protein, 8 aa, Homo Sapiens
INDERVFV

SEQ ID NO: 143512 - protein, 8 aa, Homo Sapiens
ISDFAVFL

SEQ ID NO: 143513 - protein, 8 aa, Homo Sapiens
ITDGQIFL

SEQ ID NO: 143514 - protein, 8 aa, Homo Sapiens
ITDLPIKL

SEQ ID NO: 143515 - protein, 8 aa, Homo Sapiens
ITDLYTDL

SEQ ID NO: 143516 - protein, 8 aa, Homo Sapiens
IVDEGALL

SEQ ID NO: 143517 - protein, 8 aa, Homo Sapiens
IVDRPVTL

SEQ ID NO: 143518 - protein, 8 aa, Homo Sapiens
IWDGLILL

SEQ ID NO: 143519 - protein, 8 aa, Homo Sapiens
IWDINAML

SEQ ID NO: 143520 - protein, 8 aa, Homo Sapiens
IYDALIYM

SEQ ID NO: 143521 - protein, 8 aa, Homo Sapiens
IYDEVVKL

SEQ ID NO: 143522 - protein, 8 aa, Homo Sapiens
IYDFIGEF

SEQ ID NO: 143523 - protein, 8 aa, Homo Sapiens
IYDGFDGF

SEQ ID NO: 143524 - protein, 8 aa, Homo Sapiens
IYDIFQKL

SEQ ID NO: 143525 - protein, 8 aa, Homo Sapiens
IYDIILDM

SEQ ID NO: 143526 - protein, 8 aa, Homo Sapiens
IYDIPEMF

SEQ ID NO: 143527 - protein, 8 aa, Homo Sapiens
IYDITNVL

SEQ ID NO: 143528 - protein, 8 aa, Homo Sapiens
IYDMSTVM

SEQ ID NO: 143529 - protein, 8 aa, Homo Sapiens
IYDNPNLI

SEQ ID NO: 143530 - protein, 8 aa, Homo Sapiens
IYDPFAGM

SEQ ID NO: 143531 - protein, 8 aa, Homo Sapiens
IYDRFGRL

SEQ ID NO: 143532 - protein, 8 aa, Homo Sapiens
IYDTHSLM

SEQ ID NO: 143533 - protein, 8 aa, Homo Sapiens
IYDVLIRL

SEQ ID NO: 143534 - protein, 8 aa, Homo Sapiens
IYDVSHNI

SEQ ID NO: 143535 - protein, 8 aa, Homo Sapiens
KFDEVVSL

SEQ ID NO: 143536 - protein, 8 aa, Homo Sapiens
KLDDTVYL

SEQ ID NO: 143537 - protein, 8 aa, Homo Sapiens
KLDVVVRF

SEQ ID NO: 143538 - protein, 8 aa, Homo Sapiens
KSDVEAIF

SEQ ID NO: 143539 - protein, 8 aa, Homo Sapiens
KVDMPITV

SEQ ID NO: 143540 - protein, 8 aa, Homo Sapiens
KVDQEVKL

SEQ ID NO: 143541 - protein, 8 aa, Homo Sapiens
LDTDFIVL

SEQ ID NO: 143542 - protein, 8 aa, Homo Sapiens
LFDAHQDL

SEQ ID NO: 143543 - protein, 8 aa, Homo Sapiens
LFDAHVEF

SEQ ID NO: 143544 - protein, 8 aa, Homo Sapiens
LFDAVIRL

SEQ ID NO: 143545 - protein, 8 aa, Homo Sapiens
LFDAVSSL

SEQ ID NO: 143546 - protein, 8 aa, Homo Sapiens
LFDDVGTF

SEQ ID NO: 143547 - protein, 8 aa, Homo Sapiens
LFDHVGCL

SEQ ID NO: 143548 - protein, 8 aa, Homo Sapiens
LFDNPRTF

SEQ ID NO: 143549 - protein, 8 aa, Homo Sapiens
LFDQANKL

SEQ ID NO: 143550 - protein, 8 aa, Homo Sapiens
LFDRQGFL

SEQ ID NO: 143551 - protein, 8 aa, Homo Sapiens
LFDRVVTL

SEQ ID NO: 143552 - protein, 8 aa, Homo Sapiens
LFDSLSTL

SEQ ID NO: 143553 - protein, 8 aa, Homo Sapiens
LFDSVIHL

SEQ ID NO: 143554 - protein, 8 aa, Homo Sapiens
LFDTAISL

SEQ ID NO: 143555 - protein, 8 aa, Homo Sapiens
LFDVHSIL

SEQ ID NO: 143556 - protein, 8 aa, Homo Sapiens
LFDVHSVL

SEQ ID NO: 143557 - protein, 8 aa, Homo Sapiens
LFDVHTTL

SEQ ID NO: 143558 - protein, 8 aa, Homo Sapiens
LFDVTGQV

SEQ ID NO: 143559 - protein, 8 aa, Homo Sapiens
LFDYEVRL

SEQ ID NO: 143560 - protein, 8 aa, Homo Sapiens
LFESPVYL

SEQ ID NO: 143561 - protein, 8 aa, Homo Sapiens
LFNVAHTL

SEQ ID NO: 143562 - protein, 8 aa, Homo Sapiens
LMDKVVRL

SEQ ID NO: 143563 - protein, 8 aa, Homo Sapiens
LYDGFQYL

SEQ ID NO: 143564 - protein, 8 aa, Homo Sapiens
LYDIANVL

SEQ ID NO: 143565 - protein, 8 aa, Homo Sapiens
LYDVSNIL

SEQ ID NO: 143566 - protein, 8 aa, Homo Sapiens
LYDVVSVL

SEQ ID NO: 143567 - protein, 8 aa, Homo Sapiens
MFDEPVLL

SEQ ID NO: 143568 - protein, 8 aa, Homo Sapiens
NFDATCLL

SEQ ID NO: 143569 - protein, 8 aa, Homo Sapiens
NFDDKVML

SEQ ID NO: 143570 - protein, 8 aa, Homo Sapiens
NFDLHQQL

SEQ ID NO: 143571 - protein, 8 aa, Homo Sapiens
NFDNPLGM

SEQ ID NO: 143572 - protein, 8 aa, Homo Sapiens
NFDNPVYL

SEQ ID NO: 143573 - protein, 8 aa, Homo Sapiens
NFDPTANL

SEQ ID NO: 143574 - protein, 8 aa, Homo Sapiens
NFDVATHV

SEQ ID NO: 143575 - protein, 8 aa, Homo Sapiens
NFMCHSML

SEQ ID NO: 143576 - protein, 8 aa, Homo Sapiens
NMDGPISL

SEQ ID NO: 143577 - protein, 8 aa, Homo Sapiens
NTDEMVEL

SEQ ID NO: 143578 - protein, 8 aa, Homo Sapiens
NYDRFHYL

SEQ ID NO: 143579 - protein, 8 aa, Homo Sapiens
NYDVNVIM

SEQ ID NO: 143580 - protein, 8 aa, Homo Sapiens
NYDYAVYL

SEQ ID NO: 143581 - protein, 8 aa, Homo Sapiens
QFDGGVVL

SEQ ID NO: 143582 - protein, 8 aa, Homo Sapiens
QFDGLVEL

SEQ ID NO: 143583 - protein, 8 aa, Homo Sapiens
QFDVATHL

SEQ ID NO: 143584 - protein, 8 aa, Homo Sapiens
RFDEATQL

SEQ ID NO: 143585 - protein, 8 aa, Homo Sapiens
RFDGYVFL

SEQ ID NO: 143586 - protein, 8 aa, Homo Sapiens
RFDNFSSL

SEQ ID NO: 143587 - protein, 8 aa, Homo Sapiens
RFDPFNFL

SEQ ID NO: 143588 - protein, 8 aa, Homo Sapiens
RFDTAFFL

SEQ ID NO: 143589 - protein, 8 aa, Homo Sapiens
RIDEPILL

SEQ ID NO: 143590 - protein, 8 aa, Homo Sapiens
RWDVSSFF

SEQ ID NO: 143591 - protein, 8 aa, Homo Sapiens
SFDAAVAL

SEQ ID NO: 143592 - protein, 8 aa, Homo Sapiens
SFDDIIVF

SEQ ID NO: 143593 - protein, 8 aa, Homo Sapiens
SFDFHFGF

SEQ ID NO: 143594 - protein, 8 aa, Homo Sapiens
SFDGIIAM

SEQ ID NO: 143595 - protein, 8 aa, Homo Sapiens
SFDGTIKV

SEQ ID NO: 143596 - protein, 8 aa, Homo Sapiens
SFDMAQVF

SEQ ID NO: 143597 - protein, 8 aa, Homo Sapiens
SFDPSRTF

SEQ ID NO: 143598 - protein, 8 aa, Homo Sapiens
SFDSTVRL

SEQ ID NO: 143599 - protein, 8 aa, Homo Sapiens
SFDVSQKF

SEQ ID NO: 143600 - protein, 8 aa, Homo Sapiens
SFDWTVKL

SEQ ID NO: 143601 - protein, 8 aa, Homo Sapiens
SLDEAVIM

SEQ ID NO: 143602 - protein, 8 aa, Homo Sapiens
SLDEVVLL

SEQ ID NO: 143603 - protein, 8 aa, Homo Sapiens
SLDSPVLL

SEQ ID NO: 143604 - protein, 8 aa, Homo Sapiens
SMDEKVEL

SEQ ID NO: 143605 - protein, 8 aa, Homo Sapiens
SWDKTVRL

SEQ ID NO: 143606 - protein, 8 aa, Homo Sapiens
SWDLVTCF

SEQ ID NO: 143607 - protein, 8 aa, Homo Sapiens
SWDQTVKL

SEQ ID NO: 143608 - protein, 8 aa, Homo Sapiens
SYDDTVKL

SEQ ID NO: 143609 - protein, 8 aa, Homo Sapiens
SYDIAACL

SEQ ID NO: 143610 - protein, 8 aa, Homo Sapiens
SYDVFSLL

SEQ ID NO: 143611 - protein, 8 aa, Homo Sapiens
SYDVIIRM

SEQ ID NO: 143612 - protein, 8 aa, Homo Sapiens
SYLDVYLI

SEQ ID NO: 143613 - protein, 8 aa, Homo Sapiens
TFDMFNFL

SEQ ID NO: 143614 - protein, 8 aa, Homo Sapiens
TFDPAALL

SEQ ID NO: 143615 - protein, 8 aa, Homo Sapiens
TFDPFCYL

SEQ ID NO: 143616 - protein, 8 aa, Homo Sapiens
TFDPFLYL

SEQ ID NO: 143617 - protein, 8 aa, Homo Sapiens
TFDPIAKM

SEQ ID NO: 143618 - protein, 8 aa, Homo Sapiens
TFDPVTKM

SEQ ID NO: 143619 - protein, 8 aa, Homo Sapiens
TFDSEVEL

SEQ ID NO: 143620 - protein, 8 aa, Homo Sapiens
TFDSTIHF

SEQ ID NO: 143621 - protein, 8 aa, Homo Sapiens
TFDVHLDL

SEQ ID NO: 143622 - protein, 8 aa, Homo Sapiens
TFDVYTKL

SEQ ID NO: 143623 - protein, 8 aa, Homo Sapiens
TFDYHQKL

SEQ ID NO: 143624 - protein, 8 aa, Homo Sapiens
TIDGVVFV

SEQ ID NO: 143625 - protein, 8 aa, Homo Sapiens
TLDSPAHL

SEQ ID NO: 143626 - protein, 8 aa, Homo Sapiens
TYDEVISF

SEQ ID NO: 143627 - protein, 8 aa, Homo Sapiens
TYDISQLF

SEQ ID NO: 143628 - protein, 8 aa, Homo Sapiens
VFDAFLNM

SEQ ID NO: 143629 - protein, 8 aa, Homo Sapiens
VFDALIYI

SEQ ID NO: 143630 - protein, 8 aa, Homo Sapiens
VFDDMINL

SEQ ID NO: 143631 - protein, 8 aa, Homo Sapiens
VFDEAVRV

SEQ ID NO: 143632 - protein, 8 aa, Homo Sapiens
VFDESLNF

SEQ ID NO: 143633 - protein, 8 aa, Homo Sapiens
VFDEVVQI

SEQ ID NO: 143634 - protein, 8 aa, Homo Sapiens
VFDINAEV

SEQ ID NO: 143635 - protein, 8 aa, Homo Sapiens
VFDLAQAL

SEQ ID NO: 143636 - protein, 8 aa, Homo Sapiens
VFDLAQTL

SEQ ID NO: 143637 - protein, 8 aa, Homo Sapiens
VFDLIQEL

SEQ ID NO: 143638 - protein, 8 aa, Homo Sapiens
VFDLPESL

SEQ ID NO: 143639 - protein, 8 aa, Homo Sapiens
VFDLSEKL

SEQ ID NO: 143640 - protein, 8 aa, Homo Sapiens
VFDLVRTL

SEQ ID NO: 143641 - protein, 8 aa, Homo Sapiens
VFDNLIQL

SEQ ID NO: 143642 - protein, 8 aa, Homo Sapiens
VFDNQLTI

SEQ ID NO: 143643 - protein, 8 aa, Homo Sapiens
VFDPHGTL

SEQ ID NO: 143644 - protein, 8 aa, Homo Sapiens
VFDPIGHF

SEQ ID NO: 143645 - protein, 8 aa, Homo Sapiens
VFDPVTKL

SEQ ID NO: 143646 - protein, 8 aa, Homo Sapiens
VFDQIIEL

SEQ ID NO: 143647 - protein, 8 aa, Homo Sapiens
VFDQYLNF

SEQ ID NO: 143648 - protein, 8 aa, Homo Sapiens
VFDRHKML

SEQ ID NO: 143649 - protein, 8 aa, Homo Sapiens
VFDRHVVL

SEQ ID NO: 143650 - protein, 8 aa, Homo Sapiens
VFDTSLQV

SEQ ID NO: 143651 - protein, 8 aa, Homo Sapiens
VFDTSQFF

SEQ ID NO: 143652 - protein, 8 aa, Homo Sapiens
VFDVGGLL

SEQ ID NO: 143653 - protein, 8 aa, Homo Sapiens
VFEYHNVL

SEQ ID NO: 143654 - protein, 8 aa, Homo Sapiens
VFFCHGEL

SEQ ID NO: 143655 - protein, 8 aa, Homo Sapiens
VFMTHLEF

SEQ ID NO: 143656 - protein, 8 aa, Homo Sapiens
VFSLSSEF

SEQ ID NO: 143657 - protein, 8 aa, Homo Sapiens
VIDAAVLL

SEQ ID NO: 143658 - protein, 8 aa, Homo Sapiens
VIDECVEM

SEQ ID NO: 143659 - protein, 8 aa, Homo Sapiens
VIDEPVRL

SEQ ID NO: 143660 - protein, 8 aa, Homo Sapiens
VLDAEVLL

SEQ ID NO: 143661 - protein, 8 aa, Homo Sapiens
VLDELVRP

SEQ ID NO: 143662 - protein, 8 aa, Homo Sapiens
VLDMHGFL

SEQ ID NO: 143663 - protein, 8 aa, Homo Sapiens
VLDVANHF

SEQ ID NO: 143664 - protein, 8 aa, Homo Sapiens
VLDVHAEL

SEQ ID NO: 143665 - protein, 8 aa, Homo Sapiens
VLDVSNSF

SEQ ID NO: 143666 - protein, 8 aa, Homo Sapiens
VMDDEVFM

SEQ ID NO: 143667 - protein, 8 aa, Homo Sapiens
VMDSPVHL

SEQ ID NO: 143668 - protein, 8 aa, Homo Sapiens
VTDDLVCL

SEQ ID NO: 143669 - protein, 8 aa, Homo Sapiens
VTDEPVYI

SEQ ID NO: 143670 - protein, 8 aa, Homo Sapiens
VVDEAVLV

SEQ ID NO: 143671 - protein, 8 aa, Homo Sapiens
VVDEEVFF

SEQ ID NO: 143672 - protein, 8 aa, Homo Sapiens
VVDNPIYL

SEQ ID NO: 143673 - protein, 8 aa, Homo Sapiens
VWDVGSHF

SEQ ID NO: 143674 - protein, 8 aa, Homo Sapiens
VWDYVEKI

SEQ ID NO: 143675 - protein, 8 aa, Homo Sapiens
VYDEFLLL

SEQ ID NO: 143676 - protein, 8 aa, Homo Sapiens
VYDGFSFI

SEQ ID NO: 143677 - protein, 8 aa, Homo Sapiens
VYDHQGIF

SEQ ID NO: 143678 - protein, 8 aa, Homo Sapiens
VYDIAAKF

SEQ ID NO: 143679 - protein, 8 aa, Homo Sapiens
VYDIAKHL

SEQ ID NO: 143680 - protein, 8 aa, Homo Sapiens
VYDIICNL

SEQ ID NO: 143681 - protein, 8 aa, Homo Sapiens
VYDISYLL

SEQ ID NO: 143682 - protein, 8 aa, Homo Sapiens
VYDIVNNL

SEQ ID NO: 143683 - protein, 8 aa, Homo Sapiens
VYDLYKTL

SEQ ID NO: 143684 - protein, 8 aa, Homo Sapiens
VYDNIGIL

SEQ ID NO: 143685 - protein, 8 aa, Homo Sapiens
VYDVAMKL

SEQ ID NO: 143686 - protein, 8 aa, Homo Sapiens
VYDVTLNF

SEQ ID NO: 143687 - protein, 8 aa, Homo Sapiens
VYDVTRFL

SEQ ID NO: 143688 - protein, 8 aa, Homo Sapiens
YADGESFL

SEQ ID NO: 143689 - protein, 8 aa, Homo Sapiens
YFDEHYEY

SEQ ID NO: 143690 - protein, 8 aa, Homo Sapiens
YFDEPVEL

SEQ ID NO: 143691 - protein, 8 aa, Homo Sapiens
YFDLPAGL

SEQ ID NO: 143692 - protein, 8 aa, Homo Sapiens
YFDLPGAL

SEQ ID NO: 143693 - protein, 8 aa, Homo Sapiens
YFDRAALF

SEQ ID NO: 143694 - protein, 8 aa, Homo Sapiens
YFDSYAHF

SEQ ID NO: 143695 - protein, 8 aa, Homo Sapiens
YFDVIEEI

SEQ ID NO: 143696 - protein, 8 aa, Homo Sapiens
YFDVPELI

SEQ ID NO: 143697 - protein, 8 aa, Homo Sapiens
YFDVVEEI

SEQ ID NO: 143698 - protein, 8 aa, Homo Sapiens
YFGEIALL

SEQ ID NO: 143699 - protein, 8 aa, Homo Sapiens
YFMQVAHL

SEQ ID NO: 143700 - protein, 8 aa, Homo Sapiens
YFNAPVYL

SEQ ID NO: 143701 - protein, 8 aa, Homo Sapiens
YLDELVEL

SEQ ID NO: 143702 - protein, 8 aa, Homo Sapiens
YMDTSHLF

SEQ ID NO: 143703 - protein, 8 aa, Homo Sapiens
YTDEAVVI

SEQ ID NO: 143704 - protein, 8 aa, Homo Sapiens
YTDELVEL

SEQ ID NO: 143705 - protein, 8 aa, Homo Sapiens
YTDFHIDF

SEQ ID NO: 143706 - protein, 8 aa, Homo Sapiens
YTDLEVRV

SEQ ID NO: 143707 - protein, 8 aa, Homo Sapiens
YTDNLVRV

SEQ ID NO: 143708 - protein, 8 aa, Homo Sapiens
YYDAIACL

SEQ ID NO: 143709 - protein, 8 aa, Homo Sapiens
YYDFLVEV

SEQ ID NO: 143710 - protein, 8 aa, Homo Sapiens
YYDGMIQL

SEQ ID NO: 143711 - protein, 8 aa, Homo Sapiens
YYDGVAKI

SEQ ID NO: 143712 - protein, 8 aa, Homo Sapiens
YYDIYLKV

SEQ ID NO: 143713 - protein, 8 aa, Homo Sapiens
YYDVAKQL

SEQ ID NO: 143714 - protein, 8 aa, Homo Sapiens
YYEVAGHL

SEQ ID NO: 143715 - protein, 9 aa, Homo Sapiens
AAPIRLLAA

SEQ ID NO: 143716 - protein, 9 aa, Homo Sapiens
AFADSSYLL

SEQ ID NO: 143717 - protein, 9 aa, Homo Sapiens
AFDASRTSF

SEQ ID NO: 143718 - protein, 9 aa, Homo Sapiens
AFDCMKNYL

SEQ ID NO: 143719 - protein, 9 aa, Homo Sapiens
AFDDAIAEL

SEQ ID NO: 143720 - protein, 9 aa, Homo Sapiens
AFDDVVKYF

SEQ ID NO: 143721 - protein, 9 aa, Homo Sapiens
AFDEAIAEL

SEQ ID NO: 143722 - protein, 9 aa, Homo Sapiens
AFDEKLFTF

SEQ ID NO: 143723 - protein, 9 aa, Homo Sapiens
AFDEYGRPF

SEQ ID NO: 143724 - protein, 9 aa, Homo Sapiens
AFDFAAREM

SEQ ID NO: 143725 - protein, 9 aa, Homo Sapiens
AFDFQDVTL

SEQ ID NO: 143726 - protein, 9 aa, Homo Sapiens
AFDHMKVCF

SEQ ID NO: 143727 - protein, 9 aa, Homo Sapiens
AFDIAEELV

SEQ ID NO: 143728 - protein, 9 aa, Homo Sapiens
AFDIAEKEL

SEQ ID NO: 143729 - protein, 9 aa, Homo Sapiens
AFDISKKEM

SEQ ID NO: 143730 - protein, 9 aa, Homo Sapiens
AFDITYVRL

SEQ ID NO: 143731 - protein, 9 aa, Homo Sapiens
AFDKPKVEL

SEQ ID NO: 143732 - protein, 9 aa, Homo Sapiens
AFDLDVVKL

SEQ ID NO: 143733 - protein, 9 aa, Homo Sapiens
AFDLIEHYF

SEQ ID NO: 143734 - protein, 9 aa, Homo Sapiens
AFDLKAAVL

SEQ ID NO: 143735 - protein, 9 aa, Homo Sapiens
AFDLSQVLF

SEQ ID NO: 143736 - protein, 9 aa, Homo Sapiens
AFDLTEQRY

SEQ ID NO: 143737 - protein, 9 aa, Homo Sapiens
AFDLTKTNM

SEQ ID NO: 143738 - protein, 9 aa, Homo Sapiens
AFDLVNIHL

SEQ ID NO: 143739 - protein, 9 aa, Homo Sapiens
AFDLYEQRY

SEQ ID NO: 143740 - protein, 9 aa, Homo Sapiens
AFDNMVTSM

SEQ ID NO: 143741 - protein, 9 aa, Homo Sapiens
AFDNVLNYI

SEQ ID NO: 143742 - protein, 9 aa, Homo Sapiens
AFDPAAAAF

SEQ ID NO: 143743 - protein, 9 aa, Homo Sapiens
AFDPELRIM

SEQ ID NO: 143744 - protein, 9 aa, Homo Sapiens
AFDPTSTLL

SEQ ID NO: 143745 - protein, 9 aa, Homo Sapiens
AFDPVLNRW

SEQ ID NO: 143746 - protein, 9 aa, Homo Sapiens
AFDRKVQFL

SEQ ID NO: 143747 - protein, 9 aa, Homo Sapiens
AFDSSSAVF

SEQ ID NO: 143748 - protein, 9 aa, Homo Sapiens
AFDSTLTHL

SEQ ID NO: 143749 - protein, 9 aa, Homo Sapiens
AFDVAEREF

SEQ ID NO: 143750 - protein, 9 aa, Homo Sapiens
AFDVHLNAF

SEQ ID NO: 143751 - protein, 9 aa, Homo Sapiens
AFDVVERSF

SEQ ID NO: 143752 - protein, 9 aa, Homo Sapiens
AFDYAYVVL

SEQ ID NO: 143753 - protein, 9 aa, Homo Sapiens
AFEDDAIQL

SEQ ID NO: 143754 - protein, 9 aa, Homo Sapiens
AFEDVAVNF

SEQ ID NO: 143755 - protein, 9 aa, Homo Sapiens
AFEDVAVYF

SEQ ID NO: 143756 - protein, 9 aa, Homo Sapiens
AFELHGVFL

SEQ ID NO: 143757 - protein, 9 aa, Homo Sapiens
AFEQLVVEL

SEQ ID NO: 143758 - protein, 9 aa, Homo Sapiens
AFESEPLFL

SEQ ID NO: 143759 - protein, 9 aa, Homo Sapiens
AFGLHLIDF

SEQ ID NO: 143760 - protein, 9 aa, Homo Sapiens
AFIEPPERM

SEQ ID NO: 143761 - protein, 9 aa, Homo Sapiens
AFLESVKKL

SEQ ID NO: 143762 - protein, 9 aa, Homo Sapiens
AFSLAEAKF

SEQ ID NO: 143763 - protein, 9 aa, Homo Sapiens
AFTSDPALL

SEQ ID NO: 143764 - protein, 9 aa, Homo Sapiens
AHDVDPIEL

SEQ ID NO: 143765 - protein, 9 aa, Homo Sapiens
ALDKATVLL

SEQ ID NO: 143766 - protein, 9 aa, Homo Sapiens
ALDVMVSTF

SEQ ID NO: 143767 - protein, 9 aa, Homo Sapiens
AMDLVKNHL

SEQ ID NO: 143768 - protein, 9 aa, Homo Sapiens
AMPGVPAFL

SEQ ID NO: 143769 - protein, 9 aa, Homo Sapiens
ATDEFASYF

SEQ ID NO: 143770 - protein, 9 aa, Homo Sapiens
ATDPFASVF

SEQ ID NO: 143771 - protein, 9 aa, Homo Sapiens
AVDAVIAEL

SEQ ID NO: 143772 - protein, 9 aa, Homo Sapiens
AVDPLLALL

SEQ ID NO: 143773 - protein, 9 aa, Homo Sapiens
AWDEADVRF

SEQ ID NO: 143774 - protein, 9 aa, Homo Sapiens
AWDEVGDEF

SEQ ID NO: 143775 - protein, 9 aa, Homo Sapiens
AWDIAIATM

SEQ ID NO: 143776 - protein, 9 aa, Homo Sapiens
AWDKEPVLV

SEQ ID NO: 143777 - protein, 9 aa, Homo Sapiens
AWDLYYHVF

SEQ ID NO: 143778 - protein, 9 aa, Homo Sapiens
AWDYVQAQV

SEQ ID NO: 143779 - protein, 9 aa, Homo Sapiens
AWEERETIL

SEQ ID NO: 143780 - protein, 9 aa, Homo Sapiens
AWWEWDTKF

SEQ ID NO: 143781 - protein, 9 aa, Homo Sapiens
AYDASLAML

SEQ ID NO: 143782 - protein, 9 aa, Homo Sapiens
AYDDKIYYF

SEQ ID NO: 143783 - protein, 9 aa, Homo Sapiens
AYDDLSPLL

SEQ ID NO: 143784 - protein, 9 aa, Homo Sapiens
AYDFLYNYL

SEQ ID NO: 143785 - protein, 9 aa, Homo Sapiens
AYDHSYVEL

SEQ ID NO: 143786 - protein, 9 aa, Homo Sapiens
AYDKAVASF

SEQ ID NO: 143787 - protein, 9 aa, Homo Sapiens
AYDLAKALL

SEQ ID NO: 143788 - protein, 9 aa, Homo Sapiens
AYDPTAPTL

SEQ ID NO: 143789 - protein, 9 aa, Homo Sapiens
AYDPYLIAM

SEQ ID NO: 143790 - protein, 9 aa, Homo Sapiens
AYDTLPVLI

SEQ ID NO: 143791 - protein, 9 aa, Homo Sapiens
AYDVSSFSF

SEQ ID NO: 143792 - protein, 9 aa, Homo Sapiens
AYDYMCMGF

SEQ ID NO: 143793 - protein, 9 aa, Homo Sapiens
AYEPLASFL

SEQ ID NO: 143794 - protein, 9 aa, Homo Sapiens
CADPRVPWV

SEQ ID NO: 143795 - protein, 9 aa, Homo Sapiens
CFDPKELRI

SEQ ID NO: 143796 - protein, 9 aa, Homo Sapiens
CFDPLLYFF

SEQ ID NO: 143797 - protein, 9 aa, Homo Sapiens
CFDQFVYKL

SEQ ID NO: 143798 - protein, 9 aa, Homo Sapiens
CFDTVTKEL

SEQ ID NO: 143799 - protein, 9 aa, Homo Sapiens
CFDVKDVQM

SEQ ID NO: 143800 - protein, 9 aa, Homo Sapiens
CFDVPTASV

SEQ ID NO: 143801 - protein, 9 aa, Homo Sapiens
CFNLFETGF

SEQ ID NO: 143802 - protein, 9 aa, Homo Sapiens
CFSLQETVF

SEQ ID NO: 143803 - protein, 9 aa, Homo Sapiens
CGDFPHLLV

SEQ ID NO: 143804 - protein, 9 aa, Homo Sapiens
CHDLTLAVL

SEQ ID NO: 143805 - protein, 9 aa, Homo Sapiens
CLDDTTVKF

SEQ ID NO: 143806 - protein, 9 aa, Homo Sapiens
CMDPFIYFF

SEQ ID NO: 143807 - protein, 9 aa, Homo Sapiens
CWDHRPVQI

SEQ ID NO: 143808 - protein, 9 aa, Homo Sapiens
CWQNYLDFH

SEQ ID NO: 143809 - protein, 9 aa, Homo Sapiens
CWQPVIDYI

SEQ ID NO: 143810 - protein, 9 aa, Homo Sapiens
CYDFDVHTM

SEQ ID NO: 143811 - protein, 9 aa, Homo Sapiens
CYDLAELLL

SEQ ID NO: 143812 - protein, 9 aa, Homo Sapiens
CYDLGAAYF

SEQ ID NO: 143813 - protein, 9 aa, Homo Sapiens
DFDGQVVQV

SEQ ID NO: 143814 - protein, 9 aa, Homo Sapiens
DFDLLNNSL

SEQ ID NO: 143815 - protein, 9 aa, Homo Sapiens
DFDLVDALL

SEQ ID NO: 143816 - protein, 9 aa, Homo Sapiens
DFDMTLSRF

SEQ ID NO: 143817 - protein, 9 aa, Homo Sapiens
DFDPALLEF

SEQ ID NO: 143818 - protein, 9 aa, Homo Sapiens
DFDSVSSIM

SEQ ID NO: 143819 - protein, 9 aa, Homo Sapiens
DFDVAVVTF

SEQ ID NO: 143820 - protein, 9 aa, Homo Sapiens
DWDLMERFM

SEQ ID NO: 143821 - protein, 9 aa, Homo Sapiens
DYDPLVVKL

SEQ ID NO: 143822 - protein, 9 aa, Homo Sapiens
DYDPQTVRL

SEQ ID NO: 143823 - protein, 9 aa, Homo Sapiens
DYVDSALLM

SEQ ID NO: 143824 - protein, 9 aa, Homo Sapiens
EFDEVSRIV

SEQ ID NO: 143825 - protein, 9 aa, Homo Sapiens
EFDGTKVFL

SEQ ID NO: 143826 - protein, 9 aa, Homo Sapiens
EFDIFTRLF

SEQ ID NO: 143827 - protein, 9 aa, Homo Sapiens
EFDKLVALL

SEQ ID NO: 143828 - protein, 9 aa, Homo Sapiens
EFDLLDVRF

SEQ ID NO: 143829 - protein, 9 aa, Homo Sapiens
EFDNAGAMM

SEQ ID NO: 143830 - protein, 9 aa, Homo Sapiens
EFDPIPVLI

SEQ ID NO: 143831 - protein, 9 aa, Homo Sapiens
EFDPLLREI

SEQ ID NO: 143832 - protein, 9 aa, Homo Sapiens
EFDPVMVIL

SEQ ID NO: 143833 - protein, 9 aa, Homo Sapiens
EFWLACEEF

SEQ ID NO: 143834 - protein, 9 aa, Homo Sapiens
EGFSLFVKI

SEQ ID NO: 143835 - protein, 9 aa, Homo Sapiens
EIGVLAKAF

SEQ ID NO: 143836 - protein, 9 aa, Homo Sapiens
EISANFEAL

SEQ ID NO: 143837 - protein, 9 aa, Homo Sapiens
EVSPEVVEI

SEQ ID NO: 143838 - protein, 9 aa, Homo Sapiens
EWDPLDVRF

SEQ ID NO: 143839 - protein, 9 aa, Homo Sapiens
EWDQVTVYL

SEQ ID NO: 143840 - protein, 9 aa, Homo Sapiens
EWDVLIAHF

SEQ ID NO: 143841 - protein, 9 aa, Homo Sapiens
EYDNAIITM

SEQ ID NO: 143842 - protein, 9 aa, Homo Sapiens
EYDPVIILI

SEQ ID NO: 143843 - protein, 9 aa, Homo Sapiens
FADFERHFL

SEQ ID NO: 143844 - protein, 9 aa, Homo Sapiens
FADLNLAEF

SEQ ID NO: 143845 - protein, 9 aa, Homo Sapiens
FADPIAANL

SEQ ID NO: 143846 - protein, 9 aa, Homo Sapiens
FFDAAKLMF

SEQ ID NO: 143847 - protein, 9 aa, Homo Sapiens
FFDACEVLL

SEQ ID NO: 143848 - protein, 9 aa, Homo Sapiens
FFDAIFTQL

SEQ ID NO: 143849 - protein, 9 aa, Homo Sapiens
FFDALDHVI

SEQ ID NO: 143850 - protein, 9 aa, Homo Sapiens
FFDAQEVLL

SEQ ID NO: 143851 - protein, 9 aa, Homo Sapiens
FFDDCIEKL

SEQ ID NO: 143852 - protein, 9 aa, Homo Sapiens
FFDDLLVVL

SEQ ID NO: 143853 - protein, 9 aa, Homo Sapiens
FFDDLSDSF

SEQ ID NO: 143854 - protein, 9 aa, Homo Sapiens
FFDEESYSL

SEQ ID NO: 143855 - protein, 9 aa, Homo Sapiens
FFDEGTINF

SEQ ID NO: 143856 - protein, 9 aa, Homo Sapiens
FFDEKLNSL

SEQ ID NO: 143857 - protein, 9 aa, Homo Sapiens
FFDEVVKQM

SEQ ID NO: 143858 - protein, 9 aa, Homo Sapiens
FFDGELTKV

SEQ ID NO: 143859 - protein, 9 aa, Homo Sapiens
FFDHASAAL

SEQ ID NO: 143860 - protein, 9 aa, Homo Sapiens
FFDHCLFTM

SEQ ID NO: 143861 - protein, 9 aa, Homo Sapiens
FFDHQDQVW

SEQ ID NO: 143862 - protein, 9 aa, Homo Sapiens
FFDHSGTLV

SEQ ID NO: 143863 - protein, 9 aa, Homo Sapiens
FFDHSTRIV

SEQ ID NO: 143864 - protein, 9 aa, Homo Sapiens
FFDIPVDNL

SEQ ID NO: 143865 - protein, 9 aa, Homo Sapiens
FFDLNDTKL

SEQ ID NO: 143866 - protein, 9 aa, Homo Sapiens
FFDMAYQGF

SEQ ID NO: 143867 - protein, 9 aa, Homo Sapiens
FFDNISSEL

SEQ ID NO: 143868 - protein, 9 aa, Homo Sapiens
FFDNLVYYI

SEQ ID NO: 143869 - protein, 9 aa, Homo Sapiens
FFDNRPGKL

SEQ ID NO: 143870 - protein, 9 aa, Homo Sapiens
FFDPAIRVL

SEQ ID NO: 143871 - protein, 9 aa, Homo Sapiens
FFDPDTNIV

SEQ ID NO: 143872 - protein, 9 aa, Homo Sapiens
FFDPHQSTF

SEQ ID NO: 143873 - protein, 9 aa, Homo Sapiens
FFDPSLLHL

SEQ ID NO: 143874 - protein, 9 aa, Homo Sapiens
FFDSAYQGF

SEQ ID NO: 143875 - protein, 9 aa, Homo Sapiens
FFDSVQVVF

SEQ ID NO: 143876 - protein, 9 aa, Homo Sapiens
FFDTELENL

SEQ ID NO: 143877 - protein, 9 aa, Homo Sapiens
FFDTNTSVL

SEQ ID NO: 143878 - protein, 9 aa, Homo Sapiens
FFDTSVPLM

SEQ ID NO: 143879 - protein, 9 aa, Homo Sapiens
FFDVLIKSM

SEQ ID NO: 143880 - protein, 9 aa, Homo Sapiens
FFDVTYRHF

SEQ ID NO: 143881 - protein, 9 aa, Homo Sapiens
FFDYSGRDL

SEQ ID NO: 143882 - protein, 9 aa, Homo Sapiens
FFEEHISSV

SEQ ID NO: 143883 - protein, 9 aa, Homo Sapiens
FFEGKCVEL

SEQ ID NO: 143884 - protein, 9 aa, Homo Sapiens
FFEPWVYSF

SEQ ID NO: 143885 - protein, 9 aa, Homo Sapiens
FFEVFDNSM

SEQ ID NO: 143886 - protein, 9 aa, Homo Sapiens
FFEVFTPVF

SEQ ID NO: 143887 - protein, 9 aa, Homo Sapiens
FFEVSPVSF

SEQ ID NO: 143888 - protein, 9 aa, Homo Sapiens
FFGTHETAF

SEQ ID NO: 143889 - protein, 9 aa, Homo Sapiens
FFHLVNSEM

SEQ ID NO: 143890 - protein, 9 aa, Homo Sapiens
FFIPDIEYL

SEQ ID NO: 143891 - protein, 9 aa, Homo Sapiens
FFKELIQEF

SEQ ID NO: 143892 - protein, 9 aa, Homo Sapiens
FFNLTVKEM

SEQ ID NO: 143893 - protein, 9 aa, Homo Sapiens
FFNQHIITF

SEQ ID NO: 143894 - protein, 9 aa, Homo Sapiens
FFNYKVVLL

SEQ ID NO: 143895 - protein, 9 aa, Homo Sapiens
FFPAFITLL

SEQ ID NO: 143896 - protein, 9 aa, Homo Sapiens
FFPEDPVKI

SEQ ID NO: 143897 - protein, 9 aa, Homo Sapiens
FFPFDPCVL

SEQ ID NO: 143898 - protein, 9 aa, Homo Sapiens
FFSEKIYKL

SEQ ID NO: 143899 - protein, 9 aa, Homo Sapiens
FFSEREASF

SEQ ID NO: 143900 - protein, 9 aa, Homo Sapiens
FFSPKVVSL

SEQ ID NO: 143901 - protein, 9 aa, Homo Sapiens
FFVENVSEL

SEQ ID NO: 143902 - protein, 9 aa, Homo Sapiens
FFYTHLINF

SEQ ID NO: 143903 - protein, 9 aa, Homo Sapiens
FHPARPFLL

SEQ ID NO: 143904 - protein, 9 aa, Homo Sapiens
FHYDYIDLL

SEQ ID NO: 143905 - protein, 9 aa, Homo Sapiens
FIDYNLYGM

SEQ ID NO: 143906 - protein, 9 aa, Homo Sapiens
FLDALIVSM

SEQ ID NO: 143907 - protein, 9 aa, Homo Sapiens
FLDDFIACV

SEQ ID NO: 143908 - protein, 9 aa, Homo Sapiens
FLDENVVSF

SEQ ID NO: 143909 - protein, 9 aa, Homo Sapiens
FLDEPTNHL

SEQ ID NO: 143910 - protein, 9 aa, Homo Sapiens
FLDFAPHYF

SEQ ID NO: 143911 - protein, 9 aa, Homo Sapiens
FLDLARNIF

SEQ ID NO: 143912 - protein, 9 aa, Homo Sapiens
FLDLSENLI

SEQ ID NO: 143913 - protein, 9 aa, Homo Sapiens
FLDLSIIRF

SEQ ID NO: 143914 - protein, 9 aa, Homo Sapiens
FLDLSSNQL

SEQ ID NO: 143915 - protein, 9 aa, Homo Sapiens
FLDLTEQEF

SEQ ID NO: 143916 - protein, 9 aa, Homo Sapiens
FLDSEVSEL

SEQ ID NO: 143917 - protein, 9 aa, Homo Sapiens
FLDSQTATF

SEQ ID NO: 143918 - protein, 9 aa, Homo Sapiens
FLDWPQGTF

SEQ ID NO: 143919 - protein, 9 aa, Homo Sapiens
FLPDHPIVL

SEQ ID NO: 143920 - protein, 9 aa, Homo Sapiens
FLPEAPAEL

SEQ ID NO: 143921 - protein, 9 aa, Homo Sapiens
FLPELPADL

SEQ ID NO: 143922 - protein, 9 aa, Homo Sapiens
FLPPFPAHL

SEQ ID NO: 143923 - protein, 9 aa, Homo Sapiens
FLYPFPLAL

SEQ ID NO: 143924 - protein, 9 aa, Homo Sapiens
FMDDKRVYI

SEQ ID NO: 143925 - protein, 9 aa, Homo Sapiens
FMDESTQCF

SEQ ID NO: 143926 - protein, 9 aa, Homo Sapiens
FMDFQMQRM

SEQ ID NO: 143927 - protein, 9 aa, Homo Sapiens
FSEEHPVLL

SEQ ID NO: 143928 - protein, 9 aa, Homo Sapiens
FSPFHASVL

SEQ ID NO: 143929 - protein, 9 aa, Homo Sapiens
FTDEESRVF

SEQ ID NO: 143930 - protein, 9 aa, Homo Sapiens
FTDFDPHHF

SEQ ID NO: 143931 - protein, 9 aa, Homo Sapiens
FTDVIGHYI

SEQ ID NO: 143932 - protein, 9 aa, Homo Sapiens
FTEDHYVEF

SEQ ID NO: 143933 - protein, 9 aa, Homo Sapiens
FTEKEWPLL

SEQ ID NO: 143934 - protein, 9 aa, Homo Sapiens
FVDDYTVRV

SEQ ID NO: 143935 - protein, 9 aa, Homo Sapiens
FWADKVASL

SEQ ID NO: 143936 - protein, 9 aa, Homo Sapiens
FWDDAVKEV

SEQ ID NO: 143937 - protein, 9 aa, Homo Sapiens
FWDGKIVLV

SEQ ID NO: 143938 - protein, 9 aa, Homo Sapiens
FWDKKVTHF

SEQ ID NO: 143939 - protein, 9 aa, Homo Sapiens
FWDPSVNLF

SEQ ID NO: 143940 - protein, 9 aa, Homo Sapiens
FWDYGRIAL

SEQ ID NO: 143941 - protein, 9 aa, Homo Sapiens
FWEQKPLLI

SEQ ID NO: 143942 - protein, 9 aa, Homo Sapiens
FWESSIVYL

SEQ ID NO: 143943 - protein, 9 aa, Homo Sapiens
FWPLIPQFV

SEQ ID NO: 143944 - protein, 9 aa, Homo Sapiens
FWPPYVELL

SEQ ID NO: 143945 - protein, 9 aa, Homo Sapiens
FYDDTYNTL

SEQ ID NO: 143946 - protein, 9 aa, Homo Sapiens
FYDECLRKY

SEQ ID NO: 143947 - protein, 9 aa, Homo Sapiens
FYDERIVVV

SEQ ID NO: 143948 - protein, 9 aa, Homo Sapiens
FYDGIKAIF

SEQ ID NO: 143949 - protein, 9 aa, Homo Sapiens
FYDGIKAIL

SEQ ID NO: 143950 - protein, 9 aa, Homo Sapiens
FYDGVVQTV

SEQ ID NO: 143951 - protein, 9 aa, Homo Sapiens
FYDPDTVEL

SEQ ID NO: 143952 - protein, 9 aa, Homo Sapiens
FYDPDVGNF

SEQ ID NO: 143953 - protein, 9 aa, Homo Sapiens
FYDPRSLDI

SEQ ID NO: 143954 - protein, 9 aa, Homo Sapiens
FYDQRQVLL

SEQ ID NO: 143955 - protein, 9 aa, Homo Sapiens
FYDSELFRM

SEQ ID NO: 143956 - protein, 9 aa, Homo Sapiens
FYDSQGIHF

SEQ ID NO: 143957 - protein, 9 aa, Homo Sapiens
FYDSQPTLI

SEQ ID NO: 143958 - protein, 9 aa, Homo Sapiens
FYDTKVTVM

SEQ ID NO: 143959 - protein, 9 aa, Homo Sapiens
FYDVQFKEL

SEQ ID NO: 143960 - protein, 9 aa, Homo Sapiens
FYDWDNTEL

SEQ ID NO: 143961 - protein, 9 aa, Homo Sapiens
FYEAAIPEM

SEQ ID NO: 143962 - protein, 9 aa, Homo Sapiens
FYEDNVLYM

SEQ ID NO: 143963 - protein, 9 aa, Homo Sapiens
FYEEKEVDL

SEQ ID NO: 143964 - protein, 9 aa, Homo Sapiens
FYEERALYL

SEQ ID NO: 143965 - protein, 9 aa, Homo Sapiens
FYEETKVKF

SEQ ID NO: 143966 - protein, 9 aa, Homo Sapiens
FYESLPPEM

SEQ ID NO: 143967 - protein, 9 aa, Homo Sapiens
FYETLPAEM

SEQ ID NO: 143968 - protein, 9 aa, Homo Sapiens
FYETLPVAI

SEQ ID NO: 143969 - protein, 9 aa, Homo Sapiens
FYEVVDARL

SEQ ID NO: 143970 - protein, 9 aa, Homo Sapiens
FYIESISYL

SEQ ID NO: 143971 - protein, 9 aa, Homo Sapiens
FYNERVVIM

SEQ ID NO: 143972 - protein, 9 aa, Homo Sapiens
FYNTSIEEM

SEQ ID NO: 143973 - protein, 9 aa, Homo Sapiens
FYPEEVSSM

SEQ ID NO: 143974 - protein, 9 aa, Homo Sapiens
FYPPDPAQL

SEQ ID NO: 143975 - protein, 9 aa, Homo Sapiens
FYPPKVELF

SEQ ID NO: 143976 - protein, 9 aa, Homo Sapiens
FYQCEVVRL

SEQ ID NO: 143977 - protein, 9 aa, Homo Sapiens
FYSNKEIFL

SEQ ID NO: 143978 - protein, 9 aa, Homo Sapiens
GFDAVTGEF

SEQ ID NO: 143979 - protein, 9 aa, Homo Sapiens
GFDERVTVM

SEQ ID NO: 143980 - protein, 9 aa, Homo Sapiens
GFDFSGAEI

SEQ ID NO: 143981 - protein, 9 aa, Homo Sapiens
GFDHHVVRV

SEQ ID NO: 143982 - protein, 9 aa, Homo Sapiens
GFDLQETLV

SEQ ID NO: 143983 - protein, 9 aa, Homo Sapiens
GFDLSEEKF

SEQ ID NO: 143984 - protein, 9 aa, Homo Sapiens
GMDVAASEF

SEQ ID NO: 143985 - protein, 9 aa, Homo Sapiens
GWDEALLTM

SEQ ID NO: 143986 - protein, 9 aa, Homo Sapiens
GWDVAELQL

SEQ ID NO: 143987 - protein, 9 aa, Homo Sapiens
GYDTRVTIL

SEQ ID NO: 143988 - protein, 9 aa, Homo Sapiens
GYDTRVTVL

SEQ ID NO: 143989 - protein, 9 aa, Homo Sapiens
HFDADGNYF

SEQ ID NO: 143990 - protein, 9 aa, Homo Sapiens
HFDASHVAL

SEQ ID NO: 143991 - protein, 9 aa, Homo Sapiens
HFDASLSTY

SEQ ID NO: 143992 - protein, 9 aa, Homo Sapiens
HFDDFVTNL

SEQ ID NO: 143993 - protein, 9 aa, Homo Sapiens
HFDDIGPSV

SEQ ID NO: 143994 - protein, 9 aa, Homo Sapiens
HFDDTVVCL

SEQ ID NO: 143995 - protein, 9 aa, Homo Sapiens
HFDETVNRY

SEQ ID NO: 143996 - protein, 9 aa, Homo Sapiens
HFDFIQSHI

SEQ ID NO: 143997 - protein, 9 aa, Homo Sapiens
HFDFQGCNF

SEQ ID NO: 143998 - protein, 9 aa, Homo Sapiens
HFDGFVVEV

SEQ ID NO: 143999 - protein, 9 aa, Homo Sapiens
HFDIVIRNL

SEQ ID NO: 144000 - protein, 9 aa, Homo Sapiens
HFDLASTTI

SEQ ID NO: 144001 - protein, 9 aa, Homo Sapiens
HFDLFLRFL

SEQ ID NO: 144002 - protein, 9 aa, Homo Sapiens
HFDLHEEML

SEQ ID NO: 144003 - protein, 9 aa, Homo Sapiens
HFDLLHEDV

SEQ ID NO: 144004 - protein, 9 aa, Homo Sapiens
HFDLNLRQF

SEQ ID NO: 144005 - protein, 9 aa, Homo Sapiens
HFDLSHGSA

SEQ ID NO: 144006 - protein, 9 aa, Homo Sapiens
HFDLSVIEL

SEQ ID NO: 144007 - protein, 9 aa, Homo Sapiens
HFDMNIISM

SEQ ID NO: 144008 - protein, 9 aa, Homo Sapiens
HFDNLFSKM

SEQ ID NO: 144009 - protein, 9 aa, Homo Sapiens
HFDPEAPFL

SEQ ID NO: 144010 - protein, 9 aa, Homo Sapiens
HFDPEVVQI

SEQ ID NO: 144011 - protein, 9 aa, Homo Sapiens
HFDQMFQRF

SEQ ID NO: 144012 - protein, 9 aa, Homo Sapiens
HFDSPPHLL

SEQ ID NO: 144013 - protein, 9 aa, Homo Sapiens
HFDSRSVIF

SEQ ID NO: 144014 - protein, 9 aa, Homo Sapiens
HFDSYITCV

SEQ ID NO: 144015 - protein, 9 aa, Homo Sapiens
HFDTIFEVF

SEQ ID NO: 144016 - protein, 9 aa, Homo Sapiens
HFDTPPHLF

SEQ ID NO: 144017 - protein, 9 aa, Homo Sapiens
HFDTPVQFL

SEQ ID NO: 144018 - protein, 9 aa, Homo Sapiens
HFDVQSMLF

SEQ ID NO: 144019 - protein, 9 aa, Homo Sapiens
HFDVVKCIL

SEQ ID NO: 144020 - protein, 9 aa, Homo Sapiens
HFDVVQLLV

SEQ ID NO: 144021 - protein, 9 aa, Homo Sapiens
HFDYQSLLM

SEQ ID NO: 144022 - protein, 9 aa, Homo Sapiens
HFDYSPAGL

SEQ ID NO: 144023 - protein, 9 aa, Homo Sapiens
HFEELETIM

SEQ ID NO: 144024 - protein, 9 aa, Homo Sapiens
HFHPSVALF

SEQ ID NO: 144025 - protein, 9 aa, Homo Sapiens
HFITPVSTL

SEQ ID NO: 144026 - protein, 9 aa, Homo Sapiens
HFNPTGSAF

SEQ ID NO: 144027 - protein, 9 aa, Homo Sapiens
HFNVTNTTF

SEQ ID NO: 144028 - protein, 9 aa, Homo Sapiens
HFPDMEIFL

SEQ ID NO: 144029 - protein, 9 aa, Homo Sapiens
HFPGLASEL

SEQ ID NO: 144030 - protein, 9 aa, Homo Sapiens
HFSELLDEF

SEQ ID NO: 144031 - protein, 9 aa, Homo Sapiens
HFSEQLLNL

SEQ ID NO: 144032 - protein, 9 aa, Homo Sapiens
HFWTWINHL

SEQ ID NO: 144033 - protein, 9 aa, Homo Sapiens
HFYEHLNQM

SEQ ID NO: 144034 - protein, 9 aa, Homo Sapiens
HFYYFVKEF

SEQ ID NO: 144035 - protein, 9 aa, Homo Sapiens
HGLIRKYGL

SEQ ID NO: 144036 - protein, 9 aa, Homo Sapiens
HIDVITAEM

SEQ ID NO: 144037 - protein, 9 aa, Homo Sapiens
HIIAGAGEL

SEQ ID NO: 144038 - protein, 9 aa, Homo Sapiens
HLDLIEAKF

SEQ ID NO: 144039 - protein, 9 aa, Homo Sapiens
HLDPGPIYM

SEQ ID NO: 144040 - protein, 9 aa, Homo Sapiens
HLPNKACFL

SEQ ID NO: 144041 - protein, 9 aa, Homo Sapiens
HLPPFFDCL

SEQ ID NO: 144042 - protein, 9 aa, Homo Sapiens
HMDTFIETF

SEQ ID NO: 144043 - protein, 9 aa, Homo Sapiens
HTDLPVSVF

SEQ ID NO: 144044 - protein, 9 aa, Homo Sapiens
HWDGNMSLV

SEQ ID NO: 144045 - protein, 9 aa, Homo Sapiens
HWDPDILCL

SEQ ID NO: 144046 - protein, 9 aa, Homo Sapiens
HWDPQEVTL

SEQ ID NO: 144047 - protein, 9 aa, Homo Sapiens
HWDVTEAVF

SEQ ID NO: 144048 - protein, 9 aa, Homo Sapiens
HWDWKIALL

SEQ ID NO: 144049 - protein, 9 aa, Homo Sapiens
HWFVWVTQM

SEQ ID NO: 144050 - protein, 9 aa, Homo Sapiens
HWVDLLDRF

SEQ ID NO: 144051 - protein, 9 aa, Homo Sapiens
HYDAICQYM

SEQ ID NO: 144052 - protein, 9 aa, Homo Sapiens
HYDAVEAEL

SEQ ID NO: 144053 - protein, 9 aa, Homo Sapiens
HYDCVQILL

SEQ ID NO: 144054 - protein, 9 aa, Homo Sapiens
HYDEQQNFF

SEQ ID NO: 144055 - protein, 9 aa, Homo Sapiens
HYDHVLIEL

SEQ ID NO: 144056 - protein, 9 aa, Homo Sapiens
HYDIPKISM

SEQ ID NO: 144057 - protein, 9 aa, Homo Sapiens
HYDLAFTDV

SEQ ID NO: 144058 - protein, 9 aa, Homo Sapiens
HYDLFIERF

SEQ ID NO: 144059 - protein, 9 aa, Homo Sapiens
HYDMNTASL

SEQ ID NO: 144060 - protein, 9 aa, Homo Sapiens
HYDPAELKL

SEQ ID NO: 144061 - protein, 9 aa, Homo Sapiens
HYDPATEEF

SEQ ID NO: 144062 - protein, 9 aa, Homo Sapiens
HYDPDYEFL

SEQ ID NO: 144063 - protein, 9 aa, Homo Sapiens
HYDPMIAKL

SEQ ID NO: 144064 - protein, 9 aa, Homo Sapiens
HYDRFVIFL

SEQ ID NO: 144065 - protein, 9 aa, Homo Sapiens
HYDVQSILF

SEQ ID NO: 144066 - protein, 9 aa, Homo Sapiens
HYEGAVVIL

SEQ ID NO: 144067 - protein, 9 aa, Homo Sapiens
HYIYPPAIV

SEQ ID NO: 144068 - protein, 9 aa, Homo Sapiens
HYWTWINHF

SEQ ID NO: 144069 - protein, 9 aa, Homo Sapiens
IADGLPVAV

SEQ ID NO: 144070 - protein, 9 aa, Homo Sapiens
IADLVVAVF

SEQ ID NO: 144071 - protein, 9 aa, Homo Sapiens
IADPNIAKL

SEQ ID NO: 144072 - protein, 9 aa, Homo Sapiens
IAPGVTHEL

SEQ ID NO: 144073 - protein, 9 aa, Homo Sapiens
ICDELIAKL

SEQ ID NO: 144074 - protein, 9 aa, Homo Sapiens
IFAPYVDIF

SEQ ID NO: 144075 - protein, 9 aa, Homo Sapiens
IFCESLRNF

SEQ ID NO: 144076 - protein, 9 aa, Homo Sapiens
IFDANESGF

SEQ ID NO: 144077 - protein, 9 aa, Homo Sapiens
IFDAVGFTF

SEQ ID NO: 144078 - protein, 9 aa, Homo Sapiens
IFDAVLKGV

SEQ ID NO: 144079 - protein, 9 aa, Homo Sapiens
IFDCVSQEY

SEQ ID NO: 144080 - protein, 9 aa, Homo Sapiens
IFDDPLNAF

SEQ ID NO: 144081 - protein, 9 aa, Homo Sapiens
IFDEAALEV

SEQ ID NO: 144082 - protein, 9 aa, Homo Sapiens
IFDEFRTVL

SEQ ID NO: 144083 - protein, 9 aa, Homo Sapiens
IFDEILVNA

SEQ ID NO: 144084 - protein, 9 aa, Homo Sapiens
IFDEMKKKF

SEQ ID NO: 144085 - protein, 9 aa, Homo Sapiens
IFDEVMGCF

SEQ ID NO: 144086 - protein, 9 aa, Homo Sapiens
IFDGFIVSL

SEQ ID NO: 144087 - protein, 9 aa, Homo Sapiens
IFDGLLEYL

SEQ ID NO: 144088 - protein, 9 aa, Homo Sapiens
IFDGNVAHI

SEQ ID NO: 144089 - protein, 9 aa, Homo Sapiens
IFDIIDREA

SEQ ID NO: 144090 - protein, 9 aa, Homo Sapiens
IFDIPGRLY

SEQ ID NO: 144091 - protein, 9 aa, Homo Sapiens
IFDKIHSLL

SEQ ID NO: 144092 - protein, 9 aa, Homo Sapiens
IFDLFLECM

SEQ ID NO: 144093 - protein, 9 aa, Homo Sapiens
IFDLGGGTF

SEQ ID NO: 144094 - protein, 9 aa, Homo Sapiens
IFDLMDAKA

SEQ ID NO: 144095 - protein, 9 aa, Homo Sapiens
IFDLPRTNI

SEQ ID NO: 144096 - protein, 9 aa, Homo Sapiens
IFDLQKTSL

SEQ ID NO: 144097 - protein, 9 aa, Homo Sapiens
IFDLQNKVL

SEQ ID NO: 144098 - protein, 9 aa, Homo Sapiens
IFDLSCMGF

SEQ ID NO: 144099 - protein, 9 aa, Homo Sapiens
IFDNCHELY

SEQ ID NO: 144100 - protein, 9 aa, Homo Sapiens
IFDNSDNRL

SEQ ID NO: 144101 - protein, 9 aa, Homo Sapiens
IFDNTFSRF

SEQ ID NO: 144102 - protein, 9 aa, Homo Sapiens
IFDNWIPLL

SEQ ID NO: 144103 - protein, 9 aa, Homo Sapiens
IFDPLEIIL

SEQ ID NO: 144104 - protein, 9 aa, Homo Sapiens
IFDPNILTI

SEQ ID NO: 144105 - protein, 9 aa, Homo Sapiens
IFDPSPEDI

SEQ ID NO: 144106 - protein, 9 aa, Homo Sapiens
IFDPTRECM

SEQ ID NO: 144107 - protein, 9 aa, Homo Sapiens
IFDPVKQQF

SEQ ID NO: 144108 - protein, 9 aa, Homo Sapiens
IFDQSGTYL

SEQ ID NO: 144109 - protein, 9 aa, Homo Sapiens
IFDRAVAAY

SEQ ID NO: 144110 - protein, 9 aa, Homo Sapiens
IFDRVLTEL

SEQ ID NO: 144111 - protein, 9 aa, Homo Sapiens
IFDSIIVTL

SEQ ID NO: 144112 - protein, 9 aa, Homo Sapiens
IFDSKTVSI

SEQ ID NO: 144113 - protein, 9 aa, Homo Sapiens
IFDSKVTEI

SEQ ID NO: 144114 - protein, 9 aa, Homo Sapiens
IFDSSDLSF

SEQ ID NO: 144115 - protein, 9 aa, Homo Sapiens
IFDSTAVLL

SEQ ID NO: 144116 - protein, 9 aa, Homo Sapiens
IFDVASIIL

SEQ ID NO: 144117 - protein, 9 aa, Homo Sapiens
IFDVHVHEV

SEQ ID NO: 144118 - protein, 9 aa, Homo Sapiens
IFDVLPNFF

SEQ ID NO: 144119 - protein, 9 aa, Homo Sapiens
IFDWLGRSL

SEQ ID NO: 144120 - protein, 9 aa, Homo Sapiens
IFDWVEANL

SEQ ID NO: 144121 - protein, 9 aa, Homo Sapiens
IFEDKTVKL

SEQ ID NO: 144122 - protein, 9 aa, Homo Sapiens
IFEVADTHL

SEQ ID NO: 144123 - protein, 9 aa, Homo Sapiens
IFHHFAPLL

SEQ ID NO: 144124 - protein, 9 aa, Homo Sapiens
IFMEDTACF

SEQ ID NO: 144125 - protein, 9 aa, Homo Sapiens
IFMLCTLVL

SEQ ID NO: 144126 - protein, 9 aa, Homo Sapiens
IFPEPVAFL

SEQ ID NO: 144127 - protein, 9 aa, Homo Sapiens
IFPNQTEEL

SEQ ID NO: 144128 - protein, 9 aa, Homo Sapiens
IFSEKPVFV

SEQ ID NO: 144129 - protein, 9 aa, Homo Sapiens
IFSPNVVNL

SEQ ID NO: 144130 - protein, 9 aa, Homo Sapiens
IFSPSVEDF

SEQ ID NO: 144131 - protein, 9 aa, Homo Sapiens
IFTPIVEHL

SEQ ID NO: 144132 - protein, 9 aa, Homo Sapiens
IFWFFREAF

SEQ ID NO: 144133 - protein, 9 aa, Homo Sapiens
IHDGLTVHL

SEQ ID NO: 144134 - protein, 9 aa, Homo Sapiens
IHDLLTIFV

SEQ ID NO: 144135 - protein, 9 aa, Homo Sapiens
IIDEQPLIF

SEQ ID NO: 144136 - protein, 9 aa, Homo Sapiens
ILDCQFSEF

SEQ ID NO: 144137 - protein, 9 aa, Homo Sapiens
ILDDTVQRF

SEQ ID NO: 144138 - protein, 9 aa, Homo Sapiens
ILDLVISCF

SEQ ID NO: 144139 - protein, 9 aa, Homo Sapiens
ILDNPVVQL

SEQ ID NO: 144140 - protein, 9 aa, Homo Sapiens
ILDNSPAFL

SEQ ID NO: 144141 - protein, 9 aa, Homo Sapiens
ILDPCIYRV

SEQ ID NO: 144142 - protein, 9 aa, Homo Sapiens
ILDPHVVLL

SEQ ID NO: 144143 - protein, 9 aa, Homo Sapiens
ILDRHLAIL

SEQ ID NO: 144144 - protein, 9 aa, Homo Sapiens
ILDVASLEV

SEQ ID NO: 144145 - protein, 9 aa, Homo Sapiens
ILDVIVRSF

SEQ ID NO: 144146 - protein, 9 aa, Homo Sapiens
ILPEYADIF

SEQ ID NO: 144147 - protein, 9 aa, Homo Sapiens
ILPGFIDFI

SEQ ID NO: 144148 - protein, 9 aa, Homo Sapiens
IMDATNILV

SEQ ID NO: 144149 - protein, 9 aa, Homo Sapiens
IMDVSLRSF

SEQ ID NO: 144150 - protein, 9 aa, Homo Sapiens
ISDEGIAYL

SEQ ID NO: 144151 - protein, 9 aa, Homo Sapiens
ISDHYPVEV

SEQ ID NO: 144152 - protein, 9 aa, Homo Sapiens
ITDFHPDTW

SEQ ID NO: 144153 - protein, 9 aa, Homo Sapiens
ITDHLIAML

SEQ ID NO: 144154 - protein, 9 aa, Homo Sapiens
ITDPDVVHI

SEQ ID NO: 144155 - protein, 9 aa, Homo Sapiens
ITDPEVVFV

SEQ ID NO: 144156 - protein, 9 aa, Homo Sapiens
ITDPRTVFV

SEQ ID NO: 144157 - protein, 9 aa, Homo Sapiens
ITDPSVIVM

SEQ ID NO: 144158 - protein, 9 aa, Homo Sapiens
ITDVQLAIF

SEQ ID NO: 144159 - protein, 9 aa, Homo Sapiens
ITSMLNPLI

SEQ ID NO: 144160 - protein, 9 aa, Homo Sapiens
IVDEAIYYF

SEQ ID NO: 144161 - protein, 9 aa, Homo Sapiens
IVDGAVVKF

SEQ ID NO: 144162 - protein, 9 aa, Homo Sapiens
IVDGRVYYI

SEQ ID NO: 144163 - protein, 9 aa, Homo Sapiens
IVDLPVHQL

SEQ ID NO: 144164 - protein, 9 aa, Homo Sapiens
IWDETPLYF

SEQ ID NO: 144165 - protein, 9 aa, Homo Sapiens
IWDFVSGSF

SEQ ID NO: 144166 - protein, 9 aa, Homo Sapiens
IWDLLKNAI

SEQ ID NO: 144167 - protein, 9 aa, Homo Sapiens
IWDLTTATL

SEQ ID NO: 144168 - protein, 9 aa, Homo Sapiens
IWDMGLELF

SEQ ID NO: 144169 - protein, 9 aa, Homo Sapiens
IWDPVLSVM

SEQ ID NO: 144170 - protein, 9 aa, Homo Sapiens
IWDRAITTL

SEQ ID NO: 144171 - protein, 9 aa, Homo Sapiens
IWDVSVNSV

SEQ ID NO: 144172 - protein, 9 aa, Homo Sapiens
IWDVTILEY

SEQ ID NO: 144173 - protein, 9 aa, Homo Sapiens
IWDWKTTKL

SEQ ID NO: 144174 - protein, 9 aa, Homo Sapiens
IWDYHVVLL

SEQ ID NO: 144175 - protein, 9 aa, Homo Sapiens
IWEEWPLLI

SEQ ID NO: 144176 - protein, 9 aa, Homo Sapiens
IWEPLAVKL

SEQ ID NO: 144177 - protein, 9 aa, Homo Sapiens
IWEQYTVTL

SEQ ID NO: 144178 - protein, 9 aa, Homo Sapiens
IWPLHPSLL

SEQ ID NO: 144179 - protein, 9 aa, Homo Sapiens
IWQAYLDYL

SEQ ID NO: 144180 - protein, 9 aa, Homo Sapiens
IYDDCIVTV

SEQ ID NO: 144181 - protein, 9 aa, Homo Sapiens
IYDDGITSL

SEQ ID NO: 144182 - protein, 9 aa, Homo Sapiens
IYDEAISSF

SEQ ID NO: 144183 - protein, 9 aa, Homo Sapiens
IYDEDEVLL

SEQ ID NO: 144184 - protein, 9 aa, Homo Sapiens
IYDEVVKLL

SEQ ID NO: 144185 - protein, 9 aa, Homo Sapiens
IYDFIGEFM

SEQ ID NO: 144186 - protein, 9 aa, Homo Sapiens
IYDFTDTVI

SEQ ID NO: 144187 - protein, 9 aa, Homo Sapiens
IYDIAWCQL

SEQ ID NO: 144188 - protein, 9 aa, Homo Sapiens
IYDICRRNL

SEQ ID NO: 144189 - protein, 9 aa, Homo Sapiens
IYDIMNELM

SEQ ID NO: 144190 - protein, 9 aa, Homo Sapiens
IYDIVRNSW

SEQ ID NO: 144191 - protein, 9 aa, Homo Sapiens
IYDKCITEL

SEQ ID NO: 144192 - protein, 9 aa, Homo Sapiens
IYDKFIAQL

SEQ ID NO: 144193 - protein, 9 aa, Homo Sapiens
IYDKTSVLF

SEQ ID NO: 144194 - protein, 9 aa, Homo Sapiens
IYDLATQTL

SEQ ID NO: 144195 - protein, 9 aa, Homo Sapiens
IYDLFQKSF

SEQ ID NO: 144196 - protein, 9 aa, Homo Sapiens
IYDLHESTY

SEQ ID NO: 144197 - protein, 9 aa, Homo Sapiens
IYDLLDTAM

SEQ ID NO: 144198 - protein, 9 aa, Homo Sapiens
IYDLVDRHL

SEQ ID NO: 144199 - protein, 9 aa, Homo Sapiens
IYDNAVQGL

SEQ ID NO: 144200 - protein, 9 aa, Homo Sapiens
IYDNQGIEL

SEQ ID NO: 144201 - protein, 9 aa, Homo Sapiens
IYDPNLAFL

SEQ ID NO: 144202 - protein, 9 aa, Homo Sapiens
IYDSVKVYF

SEQ ID NO: 144203 - protein, 9 aa, Homo Sapiens
IYDVNKNEW

SEQ ID NO: 144204 - protein, 9 aa, Homo Sapiens
IYDVQHANL

SEQ ID NO: 144205 - protein, 9 aa, Homo Sapiens
IYEEFLAAF

SEQ ID NO: 144206 - protein, 9 aa, Homo Sapiens
IYELAVASF

SEQ ID NO: 144207 - protein, 9 aa, Homo Sapiens
IYELMQTEF

SEQ ID NO: 144208 - protein, 9 aa, Homo Sapiens
IYEQKIAEL

SEQ ID NO: 144209 - protein, 9 aa, Homo Sapiens
IYEYVESRM

SEQ ID NO: 144210 - protein, 9 aa, Homo Sapiens
IYSSLPVEV

SEQ ID NO: 144211 - protein, 9 aa, Homo Sapiens
KADGVPVYL

SEQ ID NO: 144212 - protein, 9 aa, Homo Sapiens
KADSVVVLL

SEQ ID NO: 144213 - protein, 9 aa, Homo Sapiens
KAPEPLSSL

SEQ ID NO: 144214 - protein, 9 aa, Homo Sapiens
KFDADPVEL

SEQ ID NO: 144215 - protein, 9 aa, Homo Sapiens
KFDAELLEI

SEQ ID NO: 144216 - protein, 9 aa, Homo Sapiens
KFDALITTF

SEQ ID NO: 144217 - protein, 9 aa, Homo Sapiens
KFDDGAVFL

SEQ ID NO: 144218 - protein, 9 aa, Homo Sapiens
KFDDIRIYF

SEQ ID NO: 144219 - protein, 9 aa, Homo Sapiens
KFDFPVSYL

SEQ ID NO: 144220 - protein, 9 aa, Homo Sapiens
KFDIYTIAF

SEQ ID NO: 144221 - protein, 9 aa, Homo Sapiens
KFDLAARTL

SEQ ID NO: 144222 - protein, 9 aa, Homo Sapiens
KFDPMGKYF

SEQ ID NO: 144223 - protein, 9 aa, Homo Sapiens
KFDPVGEIL

SEQ ID NO: 144224 - protein, 9 aa, Homo Sapiens
KFDQVTVFL

SEQ ID NO: 144225 - protein, 9 aa, Homo Sapiens
KFDVQWIFV

SEQ ID NO: 144226 - protein, 9 aa, Homo Sapiens
KFDVSPVKI

SEQ ID NO: 144227 - protein, 9 aa, Homo Sapiens
KFDVTQCMF

SEQ ID NO: 144228 - protein, 9 aa, Homo Sapiens
KFDYVMQFL

SEQ ID NO: 144229 - protein, 9 aa, Homo Sapiens
KFEEWCIEM

SEQ ID NO: 144230 - protein, 9 aa, Homo Sapiens
KFPSPPAFI

SEQ ID NO: 144231 - protein, 9 aa, Homo Sapiens
KFPVKPADL

SEQ ID NO: 144232 - protein, 9 aa, Homo Sapiens
KFWDYLHEI

SEQ ID NO: 144233 - protein, 9 aa, Homo Sapiens
KFWDYLQEF

SEQ ID NO: 144234 - protein, 9 aa, Homo Sapiens
KFWQFLETV

SEQ ID NO: 144235 - protein, 9 aa, Homo Sapiens
KIEDYFPEF

SEQ ID NO: 144236 - protein, 9 aa, Homo Sapiens
KIVKWDRDM

SEQ ID NO: 144237 - protein, 9 aa, Homo Sapiens
KLDVALKEM

SEQ ID NO: 144238 - protein, 9 aa, Homo Sapiens
KLPGNISSL

SEQ ID NO: 144239 - protein, 9 aa, Homo Sapiens
KMDFTAARL

SEQ ID NO: 144240 - protein, 9 aa, Homo Sapiens
KSDPSIVRL

SEQ ID NO: 144241 - protein, 9 aa, Homo Sapiens
KTDVTVVRF

SEQ ID NO: 144242 - protein, 9 aa, Homo Sapiens
KWDALVIKL

SEQ ID NO: 144243 - protein, 9 aa, Homo Sapiens
KWDPTGNLL

SEQ ID NO: 144244 - protein, 9 aa, Homo Sapiens
KWPDRITLL

SEQ ID NO: 144245 - protein, 9 aa, Homo Sapiens
KWPETPLLL

SEQ ID NO: 144246 - protein, 9 aa, Homo Sapiens
KWSWYLDYL

SEQ ID NO: 144247 - protein, 9 aa, Homo Sapiens
KYDATMIEI

SEQ ID NO: 144248 - protein, 9 aa, Homo Sapiens
KYDLAIKDL

SEQ ID NO: 144249 - protein, 9 aa, Homo Sapiens
KYDNMAELF

SEQ ID NO: 144250 - protein, 9 aa, Homo Sapiens
KYDPNVYSI

SEQ ID NO: 144251 - protein, 9 aa, Homo Sapiens
KYDPSYIEF

SEQ ID NO: 144252 - protein, 9 aa, Homo Sapiens
KYDQLKVYL

SEQ ID NO: 144253 - protein, 9 aa, Homo Sapiens
KYDTALNLL

SEQ ID NO: 144254 - protein, 9 aa, Homo Sapiens
KYDYVGRLL

SEQ ID NO: 144255 - protein, 9 aa, Homo Sapiens
KYEDGIALL

SEQ ID NO: 144256 - protein, 9 aa, Homo Sapiens
KYFLWEEKF

SEQ ID NO: 144257 - protein, 9 aa, Homo Sapiens
KYFLWVVKF

SEQ ID NO: 144258 - protein, 9 aa, Homo Sapiens
LELFPAPIL

SEQ ID NO: 144259 - protein, 9 aa, Homo Sapiens
LFDAETVAL

SEQ ID NO: 144260 - protein, 9 aa, Homo Sapiens
LFDAFHAGF

SEQ ID NO: 144261 - protein, 9 aa, Homo Sapiens
LFDAFVSVL

SEQ ID NO: 144262 - protein, 9 aa, Homo Sapiens
LFDAISIAV

SEQ ID NO: 144263 - protein, 9 aa, Homo Sapiens
LFDANKAEL

SEQ ID NO: 144264 - protein, 9 aa, Homo Sapiens
LFDARTSLV

SEQ ID NO: 144265 - protein, 9 aa, Homo Sapiens
LFDASPTFF

SEQ ID NO: 144266 - protein, 9 aa, Homo Sapiens
LFDATLTQY

SEQ ID NO: 144267 - protein, 9 aa, Homo Sapiens
LFDAVSSLI

SEQ ID NO: 144268 - protein, 9 aa, Homo Sapiens
LFDCYVVVM

SEQ ID NO: 144269 - protein, 9 aa, Homo Sapiens
LFDDCTQQF

SEQ ID NO: 144270 - protein, 9 aa, Homo Sapiens
LFDDIDHNM

SEQ ID NO: 144271 - protein, 9 aa, Homo Sapiens
LFDDKAVEI

SEQ ID NO: 144272 - protein, 9 aa, Homo Sapiens
LFDDSEVKV

SEQ ID NO: 144273 - protein, 9 aa, Homo Sapiens
LFDEIDQAL

SEQ ID NO: 144274 - protein, 9 aa, Homo Sapiens
LFDEIRMTY

SEQ ID NO: 144275 - protein, 9 aa, Homo Sapiens
LFDGAEVVL

SEQ ID NO: 144276 - protein, 9 aa, Homo Sapiens
LFDGSPTYV

SEQ ID NO: 144277 - protein, 9 aa, Homo Sapiens
LFDHAVSKF

SEQ ID NO: 144278 - protein, 9 aa, Homo Sapiens
LFDHIAECL

SEQ ID NO: 144279 - protein, 9 aa, Homo Sapiens
LFDHVAECL

SEQ ID NO: 144280 - protein, 9 aa, Homo Sapiens
LFDHVTVRI

SEQ ID NO: 144281 - protein, 9 aa, Homo Sapiens
LFDHVVNRV

SEQ ID NO: 144282 - protein, 9 aa, Homo Sapiens
LFDIFLETV

SEQ ID NO: 144283 - protein, 9 aa, Homo Sapiens
LFDIFSQQV

SEQ ID NO: 144284 - protein, 9 aa, Homo Sapiens
LFDITGQDF

SEQ ID NO: 144285 - protein, 9 aa, Homo Sapiens
LFDKSINEF

SEQ ID NO: 144286 - protein, 9 aa, Homo Sapiens
LFDLAGITC

SEQ ID NO: 144287 - protein, 9 aa, Homo Sapiens
LFDLALRGL

SEQ ID NO: 144288 - protein, 9 aa, Homo Sapiens
LFDLCDRTF

SEQ ID NO: 144289 - protein, 9 aa, Homo Sapiens
LFDLFRGFF

SEQ ID NO: 144290 - protein, 9 aa, Homo Sapiens
LFDLGGQYL

SEQ ID NO: 144291 - protein, 9 aa, Homo Sapiens
LFDLIQSEL

SEQ ID NO: 144292 - protein, 9 aa, Homo Sapiens
LFDLPPALL

SEQ ID NO: 144293 - protein, 9 aa, Homo Sapiens
LFDLTPAKV

SEQ ID NO: 144294 - protein, 9 aa, Homo Sapiens
LFDLVCHEF

SEQ ID NO: 144295 - protein, 9 aa, Homo Sapiens
LFDLVCRTL

SEQ ID NO: 144296 - protein, 9 aa, Homo Sapiens
LFDNLIEFL

SEQ ID NO: 144297 - protein, 9 aa, Homo Sapiens
LFDPINLVF

SEQ ID NO: 144298 - protein, 9 aa, Homo Sapiens
LFDPMTGTF

SEQ ID NO: 144299 - protein, 9 aa, Homo Sapiens
LFDSLSQML

SEQ ID NO: 144300 - protein, 9 aa, Homo Sapiens
LFDSTLTAF

SEQ ID NO: 144301 - protein, 9 aa, Homo Sapiens
LFDTKPLIV

SEQ ID NO: 144302 - protein, 9 aa, Homo Sapiens
LFDTLVNFF

SEQ ID NO: 144303 - protein, 9 aa, Homo Sapiens
LFDTTNQLF

SEQ ID NO: 144304 - protein, 9 aa, Homo Sapiens
LFDVLHEPF

SEQ ID NO: 144305 - protein, 9 aa, Homo Sapiens
LFDVPVLNL

SEQ ID NO: 144306 - protein, 9 aa, Homo Sapiens
LFDVQILNY

SEQ ID NO: 144307 - protein, 9 aa, Homo Sapiens
LFDVQRNNI

SEQ ID NO: 144308 - protein, 9 aa, Homo Sapiens
LFDVSIMAV

SEQ ID NO: 144309 - protein, 9 aa, Homo Sapiens
LFDYTDTLV

SEQ ID NO: 144310 - protein, 9 aa, Homo Sapiens
LFEEAFAIF

SEQ ID NO: 144311 - protein, 9 aa, Homo Sapiens
LFEEVISKM

SEQ ID NO: 144312 - protein, 9 aa, Homo Sapiens
LFELNTPEF

SEQ ID NO: 144313 - protein, 9 aa, Homo Sapiens
LFEVISHSF

SEQ ID NO: 144314 - protein, 9 aa, Homo Sapiens
LFPEWPSYL

SEQ ID NO: 144315 - protein, 9 aa, Homo Sapiens
LFPGQVVIM

SEQ ID NO: 144316 - protein, 9 aa, Homo Sapiens
LFPLWPAEM

SEQ ID NO: 144317 - protein, 9 aa, Homo Sapiens
LFSSPPVIL

SEQ ID NO: 144318 - protein, 9 aa, Homo Sapiens
LHYPIDSLT

SEQ ID NO: 144319 - protein, 9 aa, Homo Sapiens
LLDEVLNVM

SEQ ID NO: 144320 - protein, 9 aa, Homo Sapiens
LLDGGVINL

SEQ ID NO: 144321 - protein, 9 aa, Homo Sapiens
LLDGKLVLL

SEQ ID NO: 144322 - protein, 9 aa, Homo Sapiens
LLDLALEGM

SEQ ID NO: 144323 - protein, 9 aa, Homo Sapiens
LLDPDTAVL

SEQ ID NO: 144324 - protein, 9 aa, Homo Sapiens
LLDPLMPEL

SEQ ID NO: 144325 - protein, 9 aa, Homo Sapiens
LLDPVPPVL

SEQ ID NO: 144326 - protein, 9 aa, Homo Sapiens
LLMDRVDEM

SEQ ID NO: 144327 - protein, 9 aa, Homo Sapiens
LLPDIISRL

SEQ ID NO: 144328 - protein, 9 aa, Homo Sapiens
LLPEEQVYL

SEQ ID NO: 144329 - protein, 9 aa, Homo Sapiens
LLPERPSYL

SEQ ID NO: 144330 - protein, 9 aa, Homo Sapiens
LLPPPMKEL

SEQ ID NO: 144331 - protein, 9 aa, Homo Sapiens
LLPSHASYL

SEQ ID NO: 144332 - protein, 9 aa, Homo Sapiens
LMDGRDAFL

SEQ ID NO: 144333 - protein, 9 aa, Homo Sapiens
LMDREVALL

SEQ ID NO: 144334 - protein, 9 aa, Homo Sapiens
LSFDPLLIT

SEQ ID NO: 144335 - protein, 9 aa, Homo Sapiens
LTDPAIVKV

SEQ ID NO: 144336 - protein, 9 aa, Homo Sapiens
LVDLEPGTM

SEQ ID NO: 144337 - protein, 9 aa, Homo Sapiens
LVTVYAFPF

SEQ ID NO: 144338 - protein, 9 aa, Homo Sapiens
LWDEVLSHL

SEQ ID NO: 144339 - protein, 9 aa, Homo Sapiens
LWDFQGSTM

SEQ ID NO: 144340 - protein, 9 aa, Homo Sapiens
LWDKIAAQL

SEQ ID NO: 144341 - protein, 9 aa, Homo Sapiens
LWDLQDRVL

SEQ ID NO: 144342 - protein, 9 aa, Homo Sapiens
LWDNAFSEM

SEQ ID NO: 144343 - protein, 9 aa, Homo Sapiens
LWDPVIELI

SEQ ID NO: 144344 - protein, 9 aa, Homo Sapiens
LWDSAVSHF

SEQ ID NO: 144345 - protein, 9 aa, Homo Sapiens
LWEPTPVKL

SEQ ID NO: 144346 - protein, 9 aa, Homo Sapiens
LWEYDPVKL

SEQ ID NO: 144347 - protein, 9 aa, Homo Sapiens
LWPEKTSFL

SEQ ID NO: 144348 - protein, 9 aa, Homo Sapiens
LYDCLEEHL

SEQ ID NO: 144349 - protein, 9 aa, Homo Sapiens
LYDEAIRHF

SEQ ID NO: 144350 - protein, 9 aa, Homo Sapiens
LYDEIKKYV

SEQ ID NO: 144351 - protein, 9 aa, Homo Sapiens
LYDFIHTSF

SEQ ID NO: 144352 - protein, 9 aa, Homo Sapiens
LYDHTTILF

SEQ ID NO: 144353 - protein, 9 aa, Homo Sapiens
LYDICFRTL

SEQ ID NO: 144354 - protein, 9 aa, Homo Sapiens
LYDIILKNF

SEQ ID NO: 144355 - protein, 9 aa, Homo Sapiens
LYDIVFKHF

SEQ ID NO: 144356 - protein, 9 aa, Homo Sapiens
LYDLAAVVV

SEQ ID NO: 144357 - protein, 9 aa, Homo Sapiens
LYDLLGNVW

SEQ ID NO: 144358 - protein, 9 aa, Homo Sapiens
LYDLLVNEI

SEQ ID NO: 144359 - protein, 9 aa, Homo Sapiens
LYDLSKVVL

SEQ ID NO: 144360 - protein, 9 aa, Homo Sapiens
LYDLTLEYL

SEQ ID NO: 144361 - protein, 9 aa, Homo Sapiens
LYDLVTEKM

SEQ ID NO: 144362 - protein, 9 aa, Homo Sapiens
LYDPCTVMF

SEQ ID NO: 144363 - protein, 9 aa, Homo Sapiens
LYDPVISKL

SEQ ID NO: 144364 - protein, 9 aa, Homo Sapiens
LYDTHITVL

SEQ ID NO: 144365 - protein, 9 aa, Homo Sapiens
LYDVLGIEL

SEQ ID NO: 144366 - protein, 9 aa, Homo Sapiens
LYDVPANSM

SEQ ID NO: 144367 - protein, 9 aa, Homo Sapiens
LYDVRTILL

SEQ ID NO: 144368 - protein, 9 aa, Homo Sapiens
LYDVTWEEM

SEQ ID NO: 144369 - protein, 9 aa, Homo Sapiens
LYDVVDVKY

SEQ ID NO: 144370 - protein, 9 aa, Homo Sapiens
LYQIYIDEL

SEQ ID NO: 144371 - protein, 9 aa, Homo Sapiens
LYQYYLDHL

SEQ ID NO: 144372 - protein, 9 aa, Homo Sapiens
MAPLKMLAL

SEQ ID NO: 144373 - protein, 9 aa, Homo Sapiens
MFDDIGRNF

SEQ ID NO: 144374 - protein, 9 aa, Homo Sapiens
MFDEKLVTV

SEQ ID NO: 144375 - protein, 9 aa, Homo Sapiens
MFDELRTWL

SEQ ID NO: 144376 - protein, 9 aa, Homo Sapiens
MFDELTATY

SEQ ID NO: 144377 - protein, 9 aa, Homo Sapiens
MFDHIPVGV

SEQ ID NO: 144378 - protein, 9 aa, Homo Sapiens
MFDIVGTHL

SEQ ID NO: 144379 - protein, 9 aa, Homo Sapiens
MFDKDVVML

SEQ ID NO: 144380 - protein, 9 aa, Homo Sapiens
MFDLAVDAL

SEQ ID NO: 144381 - protein, 9 aa, Homo Sapiens
MFDNALSTL

SEQ ID NO: 144382 - protein, 9 aa, Homo Sapiens
MFDQQEIQV

SEQ ID NO: 144383 - protein, 9 aa, Homo Sapiens
MFNPMYALF

SEQ ID NO: 144384 - protein, 9 aa, Homo Sapiens
MFSDFLQSF

SEQ ID NO: 144385 - protein, 9 aa, Homo Sapiens
MLDLAKIIF

SEQ ID NO: 144386 - protein, 9 aa, Homo Sapiens
MLDPLEVHL

SEQ ID NO: 144387 - protein, 9 aa, Homo Sapiens
MLPSEPVLL

SEQ ID NO: 144388 - protein, 9 aa, Homo Sapiens
MMDDAVLCM

SEQ ID NO: 144389 - protein, 9 aa, Homo Sapiens
MMDFFNAQM

SEQ ID NO: 144390 - protein, 9 aa, Homo Sapiens
MMDVAFVQF

SEQ ID NO: 144391 - protein, 9 aa, Homo Sapiens
MMDVSGVGF

SEQ ID NO: 144392 - protein, 9 aa, Homo Sapiens
MQDPMEVFV

SEQ ID NO: 144393 - protein, 9 aa, Homo Sapiens
MTDPEMVEV

SEQ ID NO: 144394 - protein, 9 aa, Homo Sapiens
MVDGKPVNL

SEQ ID NO: 144395 - protein, 9 aa, Homo Sapiens
MVDPAINLF

SEQ ID NO: 144396 - protein, 9 aa, Homo Sapiens
MVDPFHTLF

SEQ ID NO: 144397 - protein, 9 aa, Homo Sapiens
MVDSKPVNL

SEQ ID NO: 144398 - protein, 9 aa, Homo Sapiens
MWDCATELL

SEQ ID NO: 144399 - protein, 9 aa, Homo Sapiens
MWDPAAQAF

SEQ ID NO: 144400 - protein, 9 aa, Homo Sapiens
MWDQRLVKL

SEQ ID NO: 144401 - protein, 9 aa, Homo Sapiens
MWDQRLVRL

SEQ ID NO: 144402 - protein, 9 aa, Homo Sapiens
MWDTRIAKL

SEQ ID NO: 144403 - protein, 9 aa, Homo Sapiens
MWEDFITCL

SEQ ID NO: 144404 - protein, 9 aa, Homo Sapiens
MWPLVAALL

SEQ ID NO: 144405 - protein, 9 aa, Homo Sapiens
MYDSFWRQF

SEQ ID NO: 144406 - protein, 9 aa, Homo Sapiens
MYEEFLSKV

SEQ ID NO: 144407 - protein, 9 aa, Homo Sapiens
MYEQQVVKL

SEQ ID NO: 144408 - protein, 9 aa, Homo Sapiens
MYPGLPSRL

SEQ ID NO: 144409 - protein, 9 aa, Homo Sapiens
NADAIVVKL

SEQ ID NO: 144410 - protein, 9 aa, Homo Sapiens
NFDALISKI

SEQ ID NO: 144411 - protein, 9 aa, Homo Sapiens
NFDCFGDKL

SEQ ID NO: 144412 - protein, 9 aa, Homo Sapiens
NFDDIKNGL

SEQ ID NO: 144413 - protein, 9 aa, Homo Sapiens
NFDDYTVNL

SEQ ID NO: 144414 - protein, 9 aa, Homo Sapiens
NFDEALVDY

SEQ ID NO: 144415 - protein, 9 aa, Homo Sapiens
NFDEENAYF

SEQ ID NO: 144416 - protein, 9 aa, Homo Sapiens
NFDEFSKHL

SEQ ID NO: 144417 - protein, 9 aa, Homo Sapiens
NFDEILRVV

SEQ ID NO: 144418 - protein, 9 aa, Homo Sapiens
NFDEKPVII

SEQ ID NO: 144419 - protein, 9 aa, Homo Sapiens
NFDFTRSYL

SEQ ID NO: 144420 - protein, 9 aa, Homo Sapiens
NFDGKFANL

SEQ ID NO: 144421 - protein, 9 aa, Homo Sapiens
NFDKIGKEF

SEQ ID NO: 144422 - protein, 9 aa, Homo Sapiens
NFDKIRVWL

SEQ ID NO: 144423 - protein, 9 aa, Homo Sapiens
NFDMFVSHY

SEQ ID NO: 144424 - protein, 9 aa, Homo Sapiens
NFDMLYNHV

SEQ ID NO: 144425 - protein, 9 aa, Homo Sapiens
NFDMTSKFL

SEQ ID NO: 144426 - protein, 9 aa, Homo Sapiens
NFDNILNSF

SEQ ID NO: 144427 - protein, 9 aa, Homo Sapiens
NFDRFSEMM

SEQ ID NO: 144428 - protein, 9 aa, Homo Sapiens
NFDRLVSNL

SEQ ID NO: 144429 - protein, 9 aa, Homo Sapiens
NFDTIDQQF

SEQ ID NO: 144430 - protein, 9 aa, Homo Sapiens
NFDVLDLHF

SEQ ID NO: 144431 - protein, 9 aa, Homo Sapiens
NFDVLMVKL

SEQ ID NO: 144432 - protein, 9 aa, Homo Sapiens
NFDVTYNWI

SEQ ID NO: 144433 - protein, 9 aa, Homo Sapiens
NFDWLENCL

SEQ ID NO: 144434 - protein, 9 aa, Homo Sapiens
NFDYLRKEM

SEQ ID NO: 144435 - protein, 9 aa, Homo Sapiens
NFEAATESF

SEQ ID NO: 144436 - protein, 9 aa, Homo Sapiens
NFEDEPPLL

SEQ ID NO: 144437 - protein, 9 aa, Homo Sapiens
NFEPHESFF

SEQ ID NO: 144438 - protein, 9 aa, Homo Sapiens
NFEVAESDF

SEQ ID NO: 144439 - protein, 9 aa, Homo Sapiens
NFEVSTVIF

SEQ ID NO: 144440 - protein, 9 aa, Homo Sapiens
NFMLHLVSM

SEQ ID NO: 144441 - protein, 9 aa, Homo Sapiens
NFPEMATYL

SEQ ID NO: 144442 - protein, 9 aa, Homo Sapiens
NFPNTPVKM

SEQ ID NO: 144443 - protein, 9 aa, Homo Sapiens
NFVEETVYL

SEQ ID NO: 144444 - protein, 9 aa, Homo Sapiens
NFYPFLQRF

SEQ ID NO: 144445 - protein, 9 aa, Homo Sapiens
NFYVFPKPF

SEQ ID NO: 144446 - protein, 9 aa, Homo Sapiens
NHDMTLTEF

SEQ ID NO: 144447 - protein, 9 aa, Homo Sapiens
NLDLTERQV

SEQ ID NO: 144448 - protein, 9 aa, Homo Sapiens
NLDPLVYLL

SEQ ID NO: 144449 - protein, 9 aa, Homo Sapiens
NLDQPPAFF

SEQ ID NO: 144450 - protein, 9 aa, Homo Sapiens
NMDLMRADM

SEQ ID NO: 144451 - protein, 9 aa, Homo Sapiens
NTDEPPMVF

SEQ ID NO: 144452 - protein, 9 aa, Homo Sapiens
NWFVWVTQM

SEQ ID NO: 144453 - protein, 9 aa, Homo Sapiens
NYDAALRKI

SEQ ID NO: 144454 - protein, 9 aa, Homo Sapiens
NYDACLQHL

SEQ ID NO: 144455 - protein, 9 aa, Homo Sapiens
NYDDIRTEL

SEQ ID NO: 144456 - protein, 9 aa, Homo Sapiens
NYDEALRLL

SEQ ID NO: 144457 - protein, 9 aa, Homo Sapiens
NYDEFICTF

SEQ ID NO: 144458 - protein, 9 aa, Homo Sapiens
NYDEFPTMV

SEQ ID NO: 144459 - protein, 9 aa, Homo Sapiens
NYDEHISNF

SEQ ID NO: 144460 - protein, 9 aa, Homo Sapiens
NYDEMCFHI

SEQ ID NO: 144461 - protein, 9 aa, Homo Sapiens
NYDEMKDFI

SEQ ID NO: 144462 - protein, 9 aa, Homo Sapiens
NYDETISTL

SEQ ID NO: 144463 - protein, 9 aa, Homo Sapiens
NYDFGPIHM

SEQ ID NO: 144464 - protein, 9 aa, Homo Sapiens
NYDIAIAEL

SEQ ID NO: 144465 - protein, 9 aa, Homo Sapiens
NYDLALKYF

SEQ ID NO: 144466 - protein, 9 aa, Homo Sapiens
NYDLCSIFL

SEQ ID NO: 144467 - protein, 9 aa, Homo Sapiens
NYDPLPMWI

SEQ ID NO: 144468 - protein, 9 aa, Homo Sapiens
NYDVLANEI

SEQ ID NO: 144469 - protein, 9 aa, Homo Sapiens
NYDYAVYLL

SEQ ID NO: 144470 - protein, 9 aa, Homo Sapiens
NYDYLKGFL

SEQ ID NO: 144471 - protein, 9 aa, Homo Sapiens
NYEDVATFL

SEQ ID NO: 144472 - protein, 9 aa, Homo Sapiens
NYFLWTEKF

SEQ ID NO: 144473 - protein, 9 aa, Homo Sapiens
NYSDAIVWL

SEQ ID NO: 144474 - protein, 9 aa, Homo Sapiens
PFDLQSVIF

SEQ ID NO: 144475 - protein, 9 aa, Homo Sapiens
PIRLLAAAA

SEQ ID NO: 144476 - protein, 9 aa, Homo Sapiens
PLLSASIAL

SEQ ID NO: 144477 - protein, 9 aa, Homo Sapiens
QFDDVLIYL

SEQ ID NO: 144478 - protein, 9 aa, Homo Sapiens
QFDEFCKQM

SEQ ID NO: 144479 - protein, 9 aa, Homo Sapiens
QFDFVVRMM

SEQ ID NO: 144480 - protein, 9 aa, Homo Sapiens
QFDMTRNLF

SEQ ID NO: 144481 - protein, 9 aa, Homo Sapiens
QFDNFKRVF

SEQ ID NO: 144482 - protein, 9 aa, Homo Sapiens
QFDPQPLAM

SEQ ID NO: 144483 - protein, 9 aa, Homo Sapiens
QFDTDAVRL

SEQ ID NO: 144484 - protein, 9 aa, Homo Sapiens
QFDVQRKYF

SEQ ID NO: 144485 - protein, 9 aa, Homo Sapiens
QFHMQLNEM

SEQ ID NO: 144486 - protein, 9 aa, Homo Sapiens
QFPTPEAVL

SEQ ID NO: 144487 - protein, 9 aa, Homo Sapiens
QIPEIKQTL

SEQ ID NO: 144488 - protein, 9 aa, Homo Sapiens
QLDPLVVEL

SEQ ID NO: 144489 - protein, 9 aa, Homo Sapiens
QWDELLCQL

SEQ ID NO: 144490 - protein, 9 aa, Homo Sapiens
QWDLRLTAV

SEQ ID NO: 144491 - protein, 9 aa, Homo Sapiens
QWDLVENYL

SEQ ID NO: 144492 - protein, 9 aa, Homo Sapiens
QWDPMITTL

SEQ ID NO: 144493 - protein, 9 aa, Homo Sapiens
QYDEAVAQF

SEQ ID NO: 144494 - protein, 9 aa, Homo Sapiens
QYDMTLTSF

SEQ ID NO: 144495 - protein, 9 aa, Homo Sapiens
RFAARPVLL

SEQ ID NO: 144496 - protein, 9 aa, Homo Sapiens
RFDCAIVLL

SEQ ID NO: 144497 - protein, 9 aa, Homo Sapiens
RFDCSDRQF

SEQ ID NO: 144498 - protein, 9 aa, Homo Sapiens
RFDDGLVHL

SEQ ID NO: 144499 - protein, 9 aa, Homo Sapiens
RFDEAYIYM

SEQ ID NO: 144500 - protein, 9 aa, Homo Sapiens
RFDEGPVRL

SEQ ID NO: 144501 - protein, 9 aa, Homo Sapiens
RFDESMQVF

SEQ ID NO: 144502 - protein, 9 aa, Homo Sapiens
RFDGMLLAM

SEQ ID NO: 144503 - protein, 9 aa, Homo Sapiens
RFDGRVVLV

SEQ ID NO: 144504 - protein, 9 aa, Homo Sapiens
RFDGVTSML

SEQ ID NO: 144505 - protein, 9 aa, Homo Sapiens
RFDKEVALF

SEQ ID NO: 144506 - protein, 9 aa, Homo Sapiens
RFDLLKRIL

SEQ ID NO: 144507 - protein, 9 aa, Homo Sapiens
RFDMAVMFM

SEQ ID NO: 144508 - protein, 9 aa, Homo Sapiens
RFDNADRMF

SEQ ID NO: 144509 - protein, 9 aa, Homo Sapiens
RFDPLGHYL

SEQ ID NO: 144510 - protein, 9 aa, Homo Sapiens
RFDPTWESL

SEQ ID NO: 144511 - protein, 9 aa, Homo Sapiens
RFDPVRVDI

SEQ ID NO: 144512 - protein, 9 aa, Homo Sapiens
RFDSDVGEF

SEQ ID NO: 144513 - protein, 9 aa, Homo Sapiens
RFDVHDVTL

SEQ ID NO: 144514 - protein, 9 aa, Homo Sapiens
RFDVSLVYL

SEQ ID NO: 144515 - protein, 9 aa, Homo Sapiens
RFDYTNSEF

SEQ ID NO: 144516 - protein, 9 aa, Homo Sapiens
RFDYVPSFL

SEQ ID NO: 144517 - protein, 9 aa, Homo Sapiens
RFEEETVLL

SEQ ID NO: 144518 - protein, 9 aa, Homo Sapiens
RFMDLATYI

SEQ ID NO: 144519 - protein, 9 aa, Homo Sapiens
RFPDLTVEL

SEQ ID NO: 144520 - protein, 9 aa, Homo Sapiens
RFSDHVALL

SEQ ID NO: 144521 - protein, 9 aa, Homo Sapiens
RFWTWINHF

SEQ ID NO: 144522 - protein, 9 aa, Homo Sapiens
RFWYFVSQL

SEQ ID NO: 144523 - protein, 9 aa, Homo Sapiens
RLPNRPACL

SEQ ID NO: 144524 - protein, 9 aa, Homo Sapiens
RMPEKVTWM

SEQ ID NO: 144525 - protein, 9 aa, Homo Sapiens
RQDPFTVHM

SEQ ID NO: 144526 - protein, 9 aa, Homo Sapiens
RTDPIPIVV

SEQ ID NO: 144527 - protein, 9 aa, Homo Sapiens
RTDPVPVTI

SEQ ID NO: 144528 - protein, 9 aa, Homo Sapiens
RVYEFLDKL

SEQ ID NO: 144529 - protein, 9 aa, Homo Sapiens
RWDAIVAEV

SEQ ID NO: 144530 - protein, 9 aa, Homo Sapiens
RWDDSVTYI

SEQ ID NO: 144531 - protein, 9 aa, Homo Sapiens
RWDEAFRKF

SEQ ID NO: 144532 - protein, 9 aa, Homo Sapiens
RWEDTPLVI

SEQ ID NO: 144533 - protein, 9 aa, Homo Sapiens
RYDCVVLFL

SEQ ID NO: 144534 - protein, 9 aa, Homo Sapiens
RYDDMAAAM

SEQ ID NO: 144535 - protein, 9 aa, Homo Sapiens
RYDDMATCM

SEQ ID NO: 144536 - protein, 9 aa, Homo Sapiens
RYDEFLVHM

SEQ ID NO: 144537 - protein, 9 aa, Homo Sapiens
RYDEIKEEF

SEQ ID NO: 144538 - protein, 9 aa, Homo Sapiens
RYDEMVESM

SEQ ID NO: 144539 - protein, 9 aa, Homo Sapiens
RYDGQIAVF

SEQ ID NO: 144540 - protein, 9 aa, Homo Sapiens
RYDGQVAVF

SEQ ID NO: 144541 - protein, 9 aa, Homo Sapiens
RYDLGGLVM

SEQ ID NO: 144542 - protein, 9 aa, Homo Sapiens
RYDLSPITV

SEQ ID NO: 144543 - protein, 9 aa, Homo Sapiens
RYDNVTILF

SEQ ID NO: 144544 - protein, 9 aa, Homo Sapiens
RYPDRITLI

SEQ ID NO: 144545 - protein, 9 aa, Homo Sapiens
SADFPALVV

SEQ ID NO: 144546 - protein, 9 aa, Homo Sapiens
SADPNVVDL

SEQ ID NO: 144547 - protein, 9 aa, Homo Sapiens
SALPLLSAL

SEQ ID NO: 144548 - protein, 9 aa, Homo Sapiens
SAPKYIDYL

SEQ ID NO: 144549 - protein, 9 aa, Homo Sapiens
SFDAHLTEL

SEQ ID NO: 144550 - protein, 9 aa, Homo Sapiens
SFDAMFREA

SEQ ID NO: 144551 - protein, 9 aa, Homo Sapiens
SFDATTCIW

SEQ ID NO: 144552 - protein, 9 aa, Homo Sapiens
SFDAVLEAL

SEQ ID NO: 144553 - protein, 9 aa, Homo Sapiens
SFDCIQQTF

SEQ ID NO: 144554 - protein, 9 aa, Homo Sapiens
SFDDLIACV

SEQ ID NO: 144555 - protein, 9 aa, Homo Sapiens
SFDEFIKIF

SEQ ID NO: 144556 - protein, 9 aa, Homo Sapiens
SFDEIHQLF

SEQ ID NO: 144557 - protein, 9 aa, Homo Sapiens
SFDEMNAEL

SEQ ID NO: 144558 - protein, 9 aa, Homo Sapiens
SFDETCTRF

SEQ ID NO: 144559 - protein, 9 aa, Homo Sapiens
SFDETLTAL

SEQ ID NO: 144560 - protein, 9 aa, Homo Sapiens
SFDETVTHF

SEQ ID NO: 144561 - protein, 9 aa, Homo Sapiens
SFDEVEGVF

SEQ ID NO: 144562 - protein, 9 aa, Homo Sapiens
SFDEYSSEL

SEQ ID NO: 144563 - protein, 9 aa, Homo Sapiens
SFDGIIAMM

SEQ ID NO: 144564 - protein, 9 aa, Homo Sapiens
SFDGIYANM

SEQ ID NO: 144565 - protein, 9 aa, Homo Sapiens
SFDHVPALV

SEQ ID NO: 144566 - protein, 9 aa, Homo Sapiens
SFDIQLTSV

SEQ ID NO: 144567 - protein, 9 aa, Homo Sapiens
SFDITGRFL

SEQ ID NO: 144568 - protein, 9 aa, Homo Sapiens
SFDKLEAVV

SEQ ID NO: 144569 - protein, 9 aa, Homo Sapiens
SFDKSIRIF

SEQ ID NO: 144570 - protein, 9 aa, Homo Sapiens
SFDKTASVF

SEQ ID NO: 144571 - protein, 9 aa, Homo Sapiens
SFDLAIKGV

SEQ ID NO: 144572 - protein, 9 aa, Homo Sapiens
SFDLAKVLL

SEQ ID NO: 144573 - protein, 9 aa, Homo Sapiens
SFDLGRQFL

SEQ ID NO: 144574 - protein, 9 aa, Homo Sapiens
SFDLLPREF

SEQ ID NO: 144575 - protein, 9 aa, Homo Sapiens
SFDLLVKNL

SEQ ID NO: 144576 - protein, 9 aa, Homo Sapiens
SFDLNTIQI

SEQ ID NO: 144577 - protein, 9 aa, Homo Sapiens
SFDLVAQMI

SEQ ID NO: 144578 - protein, 9 aa, Homo Sapiens
SFDNIKNWI

SEQ ID NO: 144579 - protein, 9 aa, Homo Sapiens
SFDNIRNWI

SEQ ID NO: 144580 - protein, 9 aa, Homo Sapiens
SFDPKDIFL

SEQ ID NO: 144581 - protein, 9 aa, Homo Sapiens
SFDPLASFI

SEQ ID NO: 144582 - protein, 9 aa, Homo Sapiens
SFDPLLITL

SEQ ID NO: 144583 - protein, 9 aa, Homo Sapiens
SFDPNLSEL

SEQ ID NO: 144584 - protein, 9 aa, Homo Sapiens
SFDSALQSV

SEQ ID NO: 144585 - protein, 9 aa, Homo Sapiens
SFDSGIAGL

SEQ ID NO: 144586 - protein, 9 aa, Homo Sapiens
SFDSVPVSL

SEQ ID NO: 144587 - protein, 9 aa, Homo Sapiens
SFDTGFTSF

SEQ ID NO: 144588 - protein, 9 aa, Homo Sapiens
SFDTMQQEL

SEQ ID NO: 144589 - protein, 9 aa, Homo Sapiens
SFDVADRMF

SEQ ID NO: 144590 - protein, 9 aa, Homo Sapiens
SFDVFHRAF

SEQ ID NO: 144591 - protein, 9 aa, Homo Sapiens
SFDVGCNLF

SEQ ID NO: 144592 - protein, 9 aa, Homo Sapiens
SFDVTNKCL

SEQ ID NO: 144593 - protein, 9 aa, Homo Sapiens
SFDVTQSPF

SEQ ID NO: 144594 - protein, 9 aa, Homo Sapiens
SFDVVTKCV

SEQ ID NO: 144595 - protein, 9 aa, Homo Sapiens
SFDYSNTVM

SEQ ID NO: 144596 - protein, 9 aa, Homo Sapiens
SFEEKPVYI

SEQ ID NO: 144597 - protein, 9 aa, Homo Sapiens
SFPEHPAFL

SEQ ID NO: 144598 - protein, 9 aa, Homo Sapiens
SFPSEPVKL

SEQ ID NO: 144599 - protein, 9 aa, Homo Sapiens
SIPERPAQL

SEQ ID NO: 144600 - protein, 9 aa, Homo Sapiens
SLDAFMSEM

SEQ ID NO: 144601 - protein, 9 aa, Homo Sapiens
SLDDGWIRF

SEQ ID NO: 144602 - protein, 9 aa, Homo Sapiens
SLDPLPPYI

SEQ ID NO: 144603 - protein, 9 aa, Homo Sapiens
SLIEQTTAL

SEQ ID NO: 144604 - protein, 9 aa, Homo Sapiens
SLPDIPAHL

SEQ ID NO: 144605 - protein, 9 aa, Homo Sapiens
SLPNEIAYL

SEQ ID NO: 144606 - protein, 9 aa, Homo Sapiens
SMDEALEKF

SEQ ID NO: 144607 - protein, 9 aa, Homo Sapiens
SMDPLPVFL

SEQ ID NO: 144608 - protein, 9 aa, Homo Sapiens
SQISFIDYF

SEQ ID NO: 144609 - protein, 9 aa, Homo Sapiens
SVDLQTRIM

SEQ ID NO: 144610 - protein, 9 aa, Homo Sapiens
SVDVTNTTF

SEQ ID NO: 144611 - protein, 9 aa, Homo Sapiens
SVPVSLQTL

SEQ ID NO: 144612 - protein, 9 aa, Homo Sapiens
SWDEAVQAL

SEQ ID NO: 144613 - protein, 9 aa, Homo Sapiens
SWDEHVFEL

SEQ ID NO: 144614 - protein, 9 aa, Homo Sapiens
SWDGRYALV

SEQ ID NO: 144615 - protein, 9 aa, Homo Sapiens
SWDIVVQRV

SEQ ID NO: 144616 - protein, 9 aa, Homo Sapiens
SWDKILALV

SEQ ID NO: 144617 - protein, 9 aa, Homo Sapiens
SWDLPGSHV

SEQ ID NO: 144618 - protein, 9 aa, Homo Sapiens
SWDSRDVVL

SEQ ID NO: 144619 - protein, 9 aa, Homo Sapiens
SWEDAAILL

SEQ ID NO: 144620 - protein, 9 aa, Homo Sapiens
SWPTKIIYL

SEQ ID NO: 144621 - protein, 9 aa, Homo Sapiens
SYDEAILHL

SEQ ID NO: 144622 - protein, 9 aa, Homo Sapiens
SYDEAILRL

SEQ ID NO: 144623 - protein, 9 aa, Homo Sapiens
SYDFFSGEF

SEQ ID NO: 144624 - protein, 9 aa, Homo Sapiens
SYDGRAYVI

SEQ ID NO: 144625 - protein, 9 aa, Homo Sapiens
SYDHVELTF

SEQ ID NO: 144626 - protein, 9 aa, Homo Sapiens
SYDHVIYSL

SEQ ID NO: 144627 - protein, 9 aa, Homo Sapiens
SYDLAIKAI

SEQ ID NO: 144628 - protein, 9 aa, Homo Sapiens
SYDLANRDF

SEQ ID NO: 144629 - protein, 9 aa, Homo Sapiens
SYDLFVNSF

SEQ ID NO: 144630 - protein, 9 aa, Homo Sapiens
SYDNVLIKW

SEQ ID NO: 144631 - protein, 9 aa, Homo Sapiens
SYDPLRIYL

SEQ ID NO: 144632 - protein, 9 aa, Homo Sapiens
SYDPLVIYL

SEQ ID NO: 144633 - protein, 9 aa, Homo Sapiens
SYDPVTNTW

SEQ ID NO: 144634 - protein, 9 aa, Homo Sapiens
SYDSKLVWF

SEQ ID NO: 144635 - protein, 9 aa, Homo Sapiens
SYDSVLALV

SEQ ID NO: 144636 - protein, 9 aa, Homo Sapiens
SYDTFVVRV

SEQ ID NO: 144637 - protein, 9 aa, Homo Sapiens
SYDTHWITM

SEQ ID NO: 144638 - protein, 9 aa, Homo Sapiens
SYDTTCIGL

SEQ ID NO: 144639 - protein, 9 aa, Homo Sapiens
SYDTWVSRV

SEQ ID NO: 144640 - protein, 9 aa, Homo Sapiens
SYDVFQLEF

SEQ ID NO: 144641 - protein, 9 aa, Homo Sapiens
SYDVRIENF

SEQ ID NO: 144642 - protein, 9 aa, Homo Sapiens
SYDWFPAEL

SEQ ID NO: 144643 - protein, 9 aa, Homo Sapiens
SYEDRVTFL

SEQ ID NO: 144644 - protein, 9 aa, Homo Sapiens
SYEYPEYFL

SEQ ID NO: 144645 - protein, 9 aa, Homo Sapiens
SYIELPAYL

SEQ ID NO: 144646 - protein, 9 aa, Homo Sapiens
SYMEVPTYL

SEQ ID NO: 144647 - protein, 9 aa, Homo Sapiens
SYMPVIDVF

SEQ ID NO: 144648 - protein, 9 aa, Homo Sapiens
SYNLFSREF

SEQ ID NO: 144649 - protein, 9 aa, Homo Sapiens
SYWEWLPLL

SEQ ID NO: 144650 - protein, 9 aa, Homo Sapiens
TFDAGLQAF

SEQ ID NO: 144651 - protein, 9 aa, Homo Sapiens
TFDAHLTEL

SEQ ID NO: 144652 - protein, 9 aa, Homo Sapiens
TFDAQIVII

SEQ ID NO: 144653 - protein, 9 aa, Homo Sapiens
TFDASRTTF

SEQ ID NO: 144654 - protein, 9 aa, Homo Sapiens
TFDDIVHSF

SEQ ID NO: 144655 - protein, 9 aa, Homo Sapiens
TFDDLLNRL

SEQ ID NO: 144656 - protein, 9 aa, Homo Sapiens
TFDDLPARF

SEQ ID NO: 144657 - protein, 9 aa, Homo Sapiens
TFDDVAVHF

SEQ ID NO: 144658 - protein, 9 aa, Homo Sapiens
TFDDVAVTF

SEQ ID NO: 144659 - protein, 9 aa, Homo Sapiens
TFDDVAVYF

SEQ ID NO: 144660 - protein, 9 aa, Homo Sapiens
TFDEIASGF

SEQ ID NO: 144661 - protein, 9 aa, Homo Sapiens
TFDEIVCKI

SEQ ID NO: 144662 - protein, 9 aa, Homo Sapiens
TFDETVSTY

SEQ ID NO: 144663 - protein, 9 aa, Homo Sapiens
TFDEVLELM

SEQ ID NO: 144664 - protein, 9 aa, Homo Sapiens
TFDFQNDFL

SEQ ID NO: 144665 - protein, 9 aa, Homo Sapiens
TFDFVHNVM

SEQ ID NO: 144666 - protein, 9 aa, Homo Sapiens
TFDIASDAF

SEQ ID NO: 144667 - protein, 9 aa, Homo Sapiens
TFDIEAVTL

SEQ ID NO: 144668 - protein, 9 aa, Homo Sapiens
TFDISILEI

SEQ ID NO: 144669 - protein, 9 aa, Homo Sapiens
TFDLAAPTV

SEQ ID NO: 144670 - protein, 9 aa, Homo Sapiens
TFDLLFVTL

SEQ ID NO: 144671 - protein, 9 aa, Homo Sapiens
TFDLLRNSY

SEQ ID NO: 144672 - protein, 9 aa, Homo Sapiens
TFDLMQILL

SEQ ID NO: 144673 - protein, 9 aa, Homo Sapiens
TFDLQMKFV

SEQ ID NO: 144674 - protein, 9 aa, Homo Sapiens
TFDLQRIGF

SEQ ID NO: 144675 - protein, 9 aa, Homo Sapiens
TFDLTVVSY

SEQ ID NO: 144676 - protein, 9 aa, Homo Sapiens
TFDNEIVMM

SEQ ID NO: 144677 - protein, 9 aa, Homo Sapiens
TFDNIYLHV

SEQ ID NO: 144678 - protein, 9 aa, Homo Sapiens
TFDNVTSYL

SEQ ID NO: 144679 - protein, 9 aa, Homo Sapiens
TFDPIHQWL

SEQ ID NO: 144680 - protein, 9 aa, Homo Sapiens
TFDPMTRQI

SEQ ID NO: 144681 - protein, 9 aa, Homo Sapiens
TFDPQRQTV

SEQ ID NO: 144682 - protein, 9 aa, Homo Sapiens
TFDPSLAYY

SEQ ID NO: 144683 - protein, 9 aa, Homo Sapiens
TFDPVTKML

SEQ ID NO: 144684 - protein, 9 aa, Homo Sapiens
TFDPVTKVL

SEQ ID NO: 144685 - protein, 9 aa, Homo Sapiens
TFDQKIVEW

SEQ ID NO: 144686 - protein, 9 aa, Homo Sapiens
TFDRSVTLL

SEQ ID NO: 144687 - protein, 9 aa, Homo Sapiens
TFDSEVELM

SEQ ID NO: 144688 - protein, 9 aa, Homo Sapiens
TFDSSCHFF

SEQ ID NO: 144689 - protein, 9 aa, Homo Sapiens
TFDSSGAFL

SEQ ID NO: 144690 - protein, 9 aa, Homo Sapiens
TFDSTIHFY

SEQ ID NO: 144691 - protein, 9 aa, Homo Sapiens
TFDTTFSHF

SEQ ID NO: 144692 - protein, 9 aa, Homo Sapiens
TFDVAPSRL

SEQ ID NO: 144693 - protein, 9 aa, Homo Sapiens
TFDVSILTI

SEQ ID NO: 144694 - protein, 9 aa, Homo Sapiens
TFEDFVAII

SEQ ID NO: 144695 - protein, 9 aa, Homo Sapiens
TFEDVAIDF

SEQ ID NO: 144696 - protein, 9 aa, Homo Sapiens
TFEDVAVHF

SEQ ID NO: 144697 - protein, 9 aa, Homo Sapiens
TFEDVAVHL

SEQ ID NO: 144698 - protein, 9 aa, Homo Sapiens
TFEDVAVLF

SEQ ID NO: 144699 - protein, 9 aa, Homo Sapiens
TFEDVAVLL

SEQ ID NO: 144700 - protein, 9 aa, Homo Sapiens
TFEDVAVYF

SEQ ID NO: 144701 - protein, 9 aa, Homo Sapiens
TFESLVAKL

SEQ ID NO: 144702 - protein, 9 aa, Homo Sapiens
TFPNNPVEL

SEQ ID NO: 144703 - protein, 9 aa, Homo Sapiens
TFPQNPVEL

SEQ ID NO: 144704 - protein, 9 aa, Homo Sapiens
TFQPYLDTL

SEQ ID NO: 144705 - protein, 9 aa, Homo Sapiens
TFVSPEVFL

SEQ ID NO: 144706 - protein, 9 aa, Homo Sapiens
TFWLLLRQF

SEQ ID NO: 144707 - protein, 9 aa, Homo Sapiens
TIPITPAFL

SEQ ID NO: 144708 - protein, 9 aa, Homo Sapiens
TLDELPAML

SEQ ID NO: 144709 - protein, 9 aa, Homo Sapiens
TLDVGGLVF

SEQ ID NO: 144710 - protein, 9 aa, Homo Sapiens
TMDIHLNEM

SEQ ID NO: 144711 - protein, 9 aa, Homo Sapiens
TPEGYYMFI

SEQ ID NO: 144712 - protein, 9 aa, Homo Sapiens
TSEPSRDSF

SEQ ID NO: 144713 - protein, 9 aa, Homo Sapiens
TVDFLSLDL

SEQ ID NO: 144714 - protein, 9 aa, Homo Sapiens
TVEEVFLNL

SEQ ID NO: 144715 - protein, 9 aa, Homo Sapiens
TVPVRLSSL

SEQ ID NO: 144716 - protein, 9 aa, Homo Sapiens
TWDCMKTQL

SEQ ID NO: 144717 - protein, 9 aa, Homo Sapiens
TWDDAFATF

SEQ ID NO: 144718 - protein, 9 aa, Homo Sapiens
TWDELGEAL

SEQ ID NO: 144719 - protein, 9 aa, Homo Sapiens
TWDELVEHL

SEQ ID NO: 144720 - protein, 9 aa, Homo Sapiens
TWDEYNIQM

SEQ ID NO: 144721 - protein, 9 aa, Homo Sapiens
TWDLTGLLL

SEQ ID NO: 144722 - protein, 9 aa, Homo Sapiens
TWDPALAQI

SEQ ID NO: 144723 - protein, 9 aa, Homo Sapiens
TWDPLGQYV

SEQ ID NO: 144724 - protein, 9 aa, Homo Sapiens
TWDRTPVSM

SEQ ID NO: 144725 - protein, 9 aa, Homo Sapiens
TWDYTNPNL

SEQ ID NO: 144726 - protein, 9 aa, Homo Sapiens
TWDYVAPFL

SEQ ID NO: 144727 - protein, 9 aa, Homo Sapiens
TWEAQPVKV

SEQ ID NO: 144728 - protein, 9 aa, Homo Sapiens
TWPDKVVCV

SEQ ID NO: 144729 - protein, 9 aa, Homo Sapiens
TWYLDESTL

SEQ ID NO: 144730 - protein, 9 aa, Homo Sapiens
TYDDFRNVL

SEQ ID NO: 144731 - protein, 9 aa, Homo Sapiens
TYDEIGVMF

SEQ ID NO: 144732 - protein, 9 aa, Homo Sapiens
TYDEVKARL

SEQ ID NO: 144733 - protein, 9 aa, Homo Sapiens
TYDIGHVLL

SEQ ID NO: 144734 - protein, 9 aa, Homo Sapiens
TYDIVITTY

SEQ ID NO: 144735 - protein, 9 aa, Homo Sapiens
TYDLIANIV

SEQ ID NO: 144736 - protein, 9 aa, Homo Sapiens
TYDLMSSAY

SEQ ID NO: 144737 - protein, 9 aa, Homo Sapiens
TYDLPGNFL

SEQ ID NO: 144738 - protein, 9 aa, Homo Sapiens
TYDLQESNV

SEQ ID NO: 144739 - protein, 9 aa, Homo Sapiens
TYDPETQEF

SEQ ID NO: 144740 - protein, 9 aa, Homo Sapiens
TYDPWIGKL

SEQ ID NO: 144741 - protein, 9 aa, Homo Sapiens
TYDYAKTIL

SEQ ID NO: 144742 - protein, 9 aa, Homo Sapiens
TYDYGGFTM

SEQ ID NO: 144743 - protein, 9 aa, Homo Sapiens
TYEGKPIFL

SEQ ID NO: 144744 - protein, 9 aa, Homo Sapiens
TYYLWVKSV

SEQ ID NO: 144745 - protein, 9 aa, Homo Sapiens
VADDTPVLL

SEQ ID NO: 144746 - protein, 9 aa, Homo Sapiens
VADGYPVRL

SEQ ID NO: 144747 - protein, 9 aa, Homo Sapiens
VADLAESIM

SEQ ID NO: 144748 - protein, 9 aa, Homo Sapiens
VADLQLIDF

SEQ ID NO: 144749 - protein, 9 aa, Homo Sapiens
VADLVGFLL

SEQ ID NO: 144750 - protein, 9 aa, Homo Sapiens
VADPIIYVL

SEQ ID NO: 144751 - protein, 9 aa, Homo Sapiens
VADPVEAVL

SEQ ID NO: 144752 - protein, 9 aa, Homo Sapiens
VADPYVVIM

SEQ ID NO: 144753 - protein, 9 aa, Homo Sapiens
VFDAFLNMM

SEQ ID NO: 144754 - protein, 9 aa, Homo Sapiens
VFDARELEL

SEQ ID NO: 144755 - protein, 9 aa, Homo Sapiens
VFDASSIQY

SEQ ID NO: 144756 - protein, 9 aa, Homo Sapiens
VFDCMELVM

SEQ ID NO: 144757 - protein, 9 aa, Homo Sapiens
VFDCVVTSL

SEQ ID NO: 144758 - protein, 9 aa, Homo Sapiens
VFDDIETNM

SEQ ID NO: 144759 - protein, 9 aa, Homo Sapiens
VFDDMINLL

SEQ ID NO: 144760 - protein, 9 aa, Homo Sapiens
VFDDSGSIF

SEQ ID NO: 144761 - protein, 9 aa, Homo Sapiens
VFDDTITEM

SEQ ID NO: 144762 - protein, 9 aa, Homo Sapiens
VFDDTLGSF

SEQ ID NO: 144763 - protein, 9 aa, Homo Sapiens
VFDEADRLF

SEQ ID NO: 144764 - protein, 9 aa, Homo Sapiens
VFDEADRMF

SEQ ID NO: 144765 - protein, 9 aa, Homo Sapiens
VFDEAIIAI

SEQ ID NO: 144766 - protein, 9 aa, Homo Sapiens
VFDEAILAA

SEQ ID NO: 144767 - protein, 9 aa, Homo Sapiens
VFDEAIRAV

SEQ ID NO: 144768 - protein, 9 aa, Homo Sapiens
VFDESLSMF

SEQ ID NO: 144769 - protein, 9 aa, Homo Sapiens
VFDESTRKI

SEQ ID NO: 144770 - protein, 9 aa, Homo Sapiens
VFDEVVQIF

SEQ ID NO: 144771 - protein, 9 aa, Homo Sapiens
VFDEWVSKL

SEQ ID NO: 144772 - protein, 9 aa, Homo Sapiens
VFDFAGEEV

SEQ ID NO: 144773 - protein, 9 aa, Homo Sapiens
VFDFCEHDL

SEQ ID NO: 144774 - protein, 9 aa, Homo Sapiens
VFDGCPLKI

SEQ ID NO: 144775 - protein, 9 aa, Homo Sapiens
VFDGKPPQL

SEQ ID NO: 144776 - protein, 9 aa, Homo Sapiens
VFDHPWETV

SEQ ID NO: 144777 - protein, 9 aa, Homo Sapiens
VFDIGVRVV

SEQ ID NO: 144778 - protein, 9 aa, Homo Sapiens
VFDIVIHRF

SEQ ID NO: 144779 - protein, 9 aa, Homo Sapiens
VFDKMSSLL

SEQ ID NO: 144780 - protein, 9 aa, Homo Sapiens
VFDKTLAEL

SEQ ID NO: 144781 - protein, 9 aa, Homo Sapiens
VFDKVKVKI

SEQ ID NO: 144782 - protein, 9 aa, Homo Sapiens
VFDLGGGTF

SEQ ID NO: 144783 - protein, 9 aa, Homo Sapiens
VFDLIQELF

SEQ ID NO: 144784 - protein, 9 aa, Homo Sapiens
VFDLQWLEL

SEQ ID NO: 144785 - protein, 9 aa, Homo Sapiens
VFDLQWMEV

SEQ ID NO: 144786 - protein, 9 aa, Homo Sapiens
VFDLTKEIF

SEQ ID NO: 144787 - protein, 9 aa, Homo Sapiens
VFDMVVAHI

SEQ ID NO: 144788 - protein, 9 aa, Homo Sapiens
VFDNKVLTI

SEQ ID NO: 144789 - protein, 9 aa, Homo Sapiens
VFDNLIISL

SEQ ID NO: 144790 - protein, 9 aa, Homo Sapiens
VFDNSIKTF

SEQ ID NO: 144791 - protein, 9 aa, Homo Sapiens
VFDNTPAAL

SEQ ID NO: 144792 - protein, 9 aa, Homo Sapiens
VFDNVKDFF

SEQ ID NO: 144793 - protein, 9 aa, Homo Sapiens
VFDNYAVTV

SEQ ID NO: 144794 - protein, 9 aa, Homo Sapiens
VFDPALNLF

SEQ ID NO: 144795 - protein, 9 aa, Homo Sapiens
VFDPIANCW

SEQ ID NO: 144796 - protein, 9 aa, Homo Sapiens
VFDPIGHFT

SEQ ID NO: 144797 - protein, 9 aa, Homo Sapiens
VFDPKVFTF

SEQ ID NO: 144798 - protein, 9 aa, Homo Sapiens
VFDPVPVGV

SEQ ID NO: 144799 - protein, 9 aa, Homo Sapiens
VFDPVQKTL

SEQ ID NO: 144800 - protein, 9 aa, Homo Sapiens
VFDPVTKLW

SEQ ID NO: 144801 - protein, 9 aa, Homo Sapiens
VFDQPQEYF

SEQ ID NO: 144802 - protein, 9 aa, Homo Sapiens
VFDRMKVAL

SEQ ID NO: 144803 - protein, 9 aa, Homo Sapiens
VFDSVNARL

SEQ ID NO: 144804 - protein, 9 aa, Homo Sapiens
VFDTAIAHL

SEQ ID NO: 144805 - protein, 9 aa, Homo Sapiens
VFDTPEEAF

SEQ ID NO: 144806 - protein, 9 aa, Homo Sapiens
VFDTSIAQL

SEQ ID NO: 144807 - protein, 9 aa, Homo Sapiens
VFDTYMLFF

SEQ ID NO: 144808 - protein, 9 aa, Homo Sapiens
VFDVESREL

SEQ ID NO: 144809 - protein, 9 aa, Homo Sapiens
VFDVGGLLE

SEQ ID NO: 144810 - protein, 9 aa, Homo Sapiens
VFDVIIRCF

SEQ ID NO: 144811 - protein, 9 aa, Homo Sapiens
VFDVSHNAV

SEQ ID NO: 144812 - protein, 9 aa, Homo Sapiens
VFDWIEANL

SEQ ID NO: 144813 - protein, 9 aa, Homo Sapiens
VFDYSINSV

SEQ ID NO: 144814 - protein, 9 aa, Homo Sapiens
VFEDLSVTL

SEQ ID NO: 144815 - protein, 9 aa, Homo Sapiens
VFEDVAIHF

SEQ ID NO: 144816 - protein, 9 aa, Homo Sapiens
VFEDVAVYF

SEQ ID NO: 144817 - protein, 9 aa, Homo Sapiens
VFEHDSVEL

SEQ ID NO: 144818 - protein, 9 aa, Homo Sapiens
VFENIVAVL

SEQ ID NO: 144819 - protein, 9 aa, Homo Sapiens
VFEPSWAEF

SEQ ID NO: 144820 - protein, 9 aa, Homo Sapiens
VFEPSWEEF

SEQ ID NO: 144821 - protein, 9 aa, Homo Sapiens
VFEPTIVKV

SEQ ID NO: 144822 - protein, 9 aa, Homo Sapiens
VFETLEARM

SEQ ID NO: 144823 - protein, 9 aa, Homo Sapiens
VFEVSLADL

SEQ ID NO: 144824 - protein, 9 aa, Homo Sapiens
VFFLFDHQM

SEQ ID NO: 144825 - protein, 9 aa, Homo Sapiens
VFHCQSAVM

SEQ ID NO: 144826 - protein, 9 aa, Homo Sapiens
VFMDKPEEF

SEQ ID NO: 144827 - protein, 9 aa, Homo Sapiens
VFPDKEVML

SEQ ID NO: 144828 - protein, 9 aa, Homo Sapiens
VFPKEPVEL

SEQ ID NO: 144829 - protein, 9 aa, Homo Sapiens
VFPNNVVFV

SEQ ID NO: 144830 - protein, 9 aa, Homo Sapiens
VFPTTEVLL

SEQ ID NO: 144831 - protein, 9 aa, Homo Sapiens
VFQPSLAVF

SEQ ID NO: 144832 - protein, 9 aa, Homo Sapiens
VFSEMEANF

SEQ ID NO: 144833 - protein, 9 aa, Homo Sapiens
VFSTVVIHF

SEQ ID NO: 144834 - protein, 9 aa, Homo Sapiens
VFVDDLNMP

SEQ ID NO: 144835 - protein, 9 aa, Homo Sapiens
VFYPFVDLI

SEQ ID NO: 144836 - protein, 9 aa, Homo Sapiens
VGDGYVVHL

SEQ ID NO: 144837 - protein, 9 aa, Homo Sapiens
VIDEQPLMF

SEQ ID NO: 144838 - protein, 9 aa, Homo Sapiens
VIPTNVPEL

SEQ ID NO: 144839 - protein, 9 aa, Homo Sapiens
VLDDKLVFV

SEQ ID NO: 144840 - protein, 9 aa, Homo Sapiens
VLDEQLNEF

SEQ ID NO: 144841 - protein, 9 aa, Homo Sapiens
VLDGKIVAL

SEQ ID NO: 144842 - protein, 9 aa, Homo Sapiens
VLDLAETMV

SEQ ID NO: 144843 - protein, 9 aa, Homo Sapiens
VLDLMKVDM

SEQ ID NO: 144844 - protein, 9 aa, Homo Sapiens
VLDNPTPEM

SEQ ID NO: 144845 - protein, 9 aa, Homo Sapiens
VLDPESVEL

SEQ ID NO: 144846 - protein, 9 aa, Homo Sapiens
VLDQVEARL

SEQ ID NO: 144847 - protein, 9 aa, Homo Sapiens
VLDVVERSL

SEQ ID NO: 144848 - protein, 9 aa, Homo Sapiens
VLPNDPVFL

SEQ ID NO: 144849 - protein, 9 aa, Homo Sapiens
VMDLSIVRL

SEQ ID NO: 144850 - protein, 9 aa, Homo Sapiens
VMDSKIVQV

SEQ ID NO: 144851 - protein, 9 aa, Homo Sapiens
VMDVAFVQF

SEQ ID NO: 144852 - protein, 9 aa, Homo Sapiens
VMDVQYNKF

SEQ ID NO: 144853 - protein, 9 aa, Homo Sapiens
VMDVVVKSV

SEQ ID NO: 144854 - protein, 9 aa, Homo Sapiens
VSDHFPVEF

SEQ ID NO: 144855 - protein, 9 aa, Homo Sapiens
VSDPVTVHF

SEQ ID NO: 144856 - protein, 9 aa, Homo Sapiens
VTDDLVCLV

SEQ ID NO: 144857 - protein, 9 aa, Homo Sapiens
VTDGKEVLL

SEQ ID NO: 144858 - protein, 9 aa, Homo Sapiens
VTDPRVVDL

SEQ ID NO: 144859 - protein, 9 aa, Homo Sapiens
VTDVGQILL

SEQ ID NO: 144860 - protein, 9 aa, Homo Sapiens
VTEEFGVHL

SEQ ID NO: 144861 - protein, 9 aa, Homo Sapiens
VVDAIPVFL

SEQ ID NO: 144862 - protein, 9 aa, Homo Sapiens
VVPDHPVLL

SEQ ID NO: 144863 - protein, 9 aa, Homo Sapiens
VWDEVSGQW

SEQ ID NO: 144864 - protein, 9 aa, Homo Sapiens
VWDHGGRIF

SEQ ID NO: 144865 - protein, 9 aa, Homo Sapiens
VWDHQGVEL

SEQ ID NO: 144866 - protein, 9 aa, Homo Sapiens
VWDIVGTEL

SEQ ID NO: 144867 - protein, 9 aa, Homo Sapiens
VWDLHNQTL

SEQ ID NO: 144868 - protein, 9 aa, Homo Sapiens
VWDLRNMGY

SEQ ID NO: 144869 - protein, 9 aa, Homo Sapiens
VWDRFLSTM

SEQ ID NO: 144870 - protein, 9 aa, Homo Sapiens
VWDTKEVQM

SEQ ID NO: 144871 - protein, 9 aa, Homo Sapiens
VWDVIGRSL

SEQ ID NO: 144872 - protein, 9 aa, Homo Sapiens
VWDVPVEEF

SEQ ID NO: 144873 - protein, 9 aa, Homo Sapiens
VWDYAGDNY

SEQ ID NO: 144874 - protein, 9 aa, Homo Sapiens
VWEEMKTTL

SEQ ID NO: 144875 - protein, 9 aa, Homo Sapiens
VWEETIILL

SEQ ID NO: 144876 - protein, 9 aa, Homo Sapiens
VWELLPTTL

SEQ ID NO: 144877 - protein, 9 aa, Homo Sapiens
VWPLLPALL

SEQ ID NO: 144878 - protein, 9 aa, Homo Sapiens
VWPLPPAVL

SEQ ID NO: 144879 - protein, 9 aa, Homo Sapiens
VWPLQIILL

SEQ ID NO: 144880 - protein, 9 aa, Homo Sapiens
VWPSEPSRV

SEQ ID NO: 144881 - protein, 9 aa, Homo Sapiens
VWTELLDVL

SEQ ID NO: 144882 - protein, 9 aa, Homo Sapiens
VYDALNVLM

SEQ ID NO: 144883 - protein, 9 aa, Homo Sapiens
VYDELRQCI

SEQ ID NO: 144884 - protein, 9 aa, Homo Sapiens
VYDFVGLLV

SEQ ID NO: 144885 - protein, 9 aa, Homo Sapiens
VYDGKIYTL

SEQ ID NO: 144886 - protein, 9 aa, Homo Sapiens
VYDIAQVNL

SEQ ID NO: 144887 - protein, 9 aa, Homo Sapiens
VYDLGGGTF

SEQ ID NO: 144888 - protein, 9 aa, Homo Sapiens
VYDLLHCLV

SEQ ID NO: 144889 - protein, 9 aa, Homo Sapiens
VYDLLKNHL

SEQ ID NO: 144890 - protein, 9 aa, Homo Sapiens
VYDLLKTNL

SEQ ID NO: 144891 - protein, 9 aa, Homo Sapiens
VYDLSIRGF

SEQ ID NO: 144892 - protein, 9 aa, Homo Sapiens
VYDLSKGLA

SEQ ID NO: 144893 - protein, 9 aa, Homo Sapiens
VYDMNLREM

SEQ ID NO: 144894 - protein, 9 aa, Homo Sapiens
VYDPATETW

SEQ ID NO: 144895 - protein, 9 aa, Homo Sapiens
VYDPLFSQL

SEQ ID NO: 144896 - protein, 9 aa, Homo Sapiens
VYDPSLKTL

SEQ ID NO: 144897 - protein, 9 aa, Homo Sapiens
VYDQVVEDL

SEQ ID NO: 144898 - protein, 9 aa, Homo Sapiens
VYDSPLCRL

SEQ ID NO: 144899 - protein, 9 aa, Homo Sapiens
VYDTNPAKF

SEQ ID NO: 144900 - protein, 9 aa, Homo Sapiens
VYDTVFKHF

SEQ ID NO: 144901 - protein, 9 aa, Homo Sapiens
VYDVRQAYV

SEQ ID NO: 144902 - protein, 9 aa, Homo Sapiens
VYDVTPPEL

SEQ ID NO: 144903 - protein, 9 aa, Homo Sapiens
VYDVVEEKL

SEQ ID NO: 144904 - protein, 9 aa, Homo Sapiens
VYDVVELKF

SEQ ID NO: 144905 - protein, 9 aa, Homo Sapiens
VYQEMPAQL

SEQ ID NO: 144906 - protein, 9 aa, Homo Sapiens
WFDGKLVTV

SEQ ID NO: 144907 - protein, 9 aa, Homo Sapiens
WFDNQIHEA

SEQ ID NO: 144908 - protein, 9 aa, Homo Sapiens
WFDPAIFTI

SEQ ID NO: 144909 - protein, 9 aa, Homo Sapiens
WFDYNCIHV

SEQ ID NO: 144910 - protein, 9 aa, Homo Sapiens
WFEAQVVRV

SEQ ID NO: 144911 - protein, 9 aa, Homo Sapiens
WYDPKVTRV

SEQ ID NO: 144912 - protein, 9 aa, Homo Sapiens
WYDPNASLL

SEQ ID NO: 144913 - protein, 9 aa, Homo Sapiens
YCDERITEL

SEQ ID NO: 144914 - protein, 9 aa, Homo Sapiens
YFDAIPVTM

SEQ ID NO: 144915 - protein, 9 aa, Homo Sapiens
YFDALYNIM

SEQ ID NO: 144916 - protein, 9 aa, Homo Sapiens
YFDDALEDF

SEQ ID NO: 144917 - protein, 9 aa, Homo Sapiens
YFDDCMQLL

SEQ ID NO: 144918 - protein, 9 aa, Homo Sapiens
YFDDLKGEM

SEQ ID NO: 144919 - protein, 9 aa, Homo Sapiens
YFDDSNVSL

SEQ ID NO: 144920 - protein, 9 aa, Homo Sapiens
YFDEILNKL

SEQ ID NO: 144921 - protein, 9 aa, Homo Sapiens
YFDEKELEL

SEQ ID NO: 144922 - protein, 9 aa, Homo Sapiens
YFDEPVELR

SEQ ID NO: 144923 - protein, 9 aa, Homo Sapiens
YFDESFFHF

SEQ ID NO: 144924 - protein, 9 aa, Homo Sapiens
YFDGDLSKV

SEQ ID NO: 144925 - protein, 9 aa, Homo Sapiens
YFDKELIQL

SEQ ID NO: 144926 - protein, 9 aa, Homo Sapiens
YFDLAADVL

SEQ ID NO: 144927 - protein, 9 aa, Homo Sapiens
YFDLLGELM

SEQ ID NO: 144928 - protein, 9 aa, Homo Sapiens
YFDLPGALL

SEQ ID NO: 144929 - protein, 9 aa, Homo Sapiens
YFDLQTHVI

SEQ ID NO: 144930 - protein, 9 aa, Homo Sapiens
YFDLTCQLL

SEQ ID NO: 144931 - protein, 9 aa, Homo Sapiens
YFDMGAAVL

SEQ ID NO: 144932 - protein, 9 aa, Homo Sapiens
YFDNILNSF

SEQ ID NO: 144933 - protein, 9 aa, Homo Sapiens
YFDPANGKF

SEQ ID NO: 144934 - protein, 9 aa, Homo Sapiens
YFDPQYFEF

SEQ ID NO: 144935 - protein, 9 aa, Homo Sapiens
YFDPTIVSV

SEQ ID NO: 144936 - protein, 9 aa, Homo Sapiens
YFDQVLVNI

SEQ ID NO: 144937 - protein, 9 aa, Homo Sapiens
YFDSGDYNM

SEQ ID NO: 144938 - protein, 9 aa, Homo Sapiens
YFDTVPVAA

SEQ ID NO: 144939 - protein, 9 aa, Homo Sapiens
YFDVEPFVF

SEQ ID NO: 144940 - protein, 9 aa, Homo Sapiens
YFDVGLHNF

SEQ ID NO: 144941 - protein, 9 aa, Homo Sapiens
YFDVSHEHL

SEQ ID NO: 144942 - protein, 9 aa, Homo Sapiens
YFDWGPGEM

SEQ ID NO: 144943 - protein, 9 aa, Homo Sapiens
YFEAMFRSF

SEQ ID NO: 144944 - protein, 9 aa, Homo Sapiens
YFEDKLTEI

SEQ ID NO: 144945 - protein, 9 aa, Homo Sapiens
YFEDVANAM

SEQ ID NO: 144946 - protein, 9 aa, Homo Sapiens
YFEELITML

SEQ ID NO: 144947 - protein, 9 aa, Homo Sapiens
YFEGKQVSV

SEQ ID NO: 144948 - protein, 9 aa, Homo Sapiens
YFEGSIYEI

SEQ ID NO: 144949 - protein, 9 aa, Homo Sapiens
YFELVQHEY

SEQ ID NO: 144950 - protein, 9 aa, Homo Sapiens
YFENLLSHF

SEQ ID NO: 144951 - protein, 9 aa, Homo Sapiens
YFESVRTFV

SEQ ID NO: 144952 - protein, 9 aa, Homo Sapiens
YFEYFGPDF

SEQ ID NO: 144953 - protein, 9 aa, Homo Sapiens
YFFTWDTEY

SEQ ID NO: 144954 - protein, 9 aa, Homo Sapiens
YFHEALRAF

SEQ ID NO: 144955 - protein, 9 aa, Homo Sapiens
YFIKPPVYV

SEQ ID NO: 144956 - protein, 9 aa, Homo Sapiens
YFISHVLAF

SEQ ID NO: 144957 - protein, 9 aa, Homo Sapiens
YFLPDTAHF

SEQ ID NO: 144958 - protein, 9 aa, Homo Sapiens
YFPDKVALL

SEQ ID NO: 144959 - protein, 9 aa, Homo Sapiens
YFPEEIAKL

SEQ ID NO: 144960 - protein, 9 aa, Homo Sapiens
YFPEFLDML

SEQ ID NO: 144961 - protein, 9 aa, Homo Sapiens
YFPELIANF

SEQ ID NO: 144962 - protein, 9 aa, Homo Sapiens
YFPKKISEL

SEQ ID NO: 144963 - protein, 9 aa, Homo Sapiens
YFPPGIVEV

SEQ ID NO: 144964 - protein, 9 aa, Homo Sapiens
YFPTKPMFV

SEQ ID NO: 144965 - protein, 9 aa, Homo Sapiens
YFWEALNNF

SEQ ID NO: 144966 - protein, 9 aa, Homo Sapiens
YFWEYSEQL

SEQ ID NO: 144967 - protein, 9 aa, Homo Sapiens
YGDCHPVFF

SEQ ID NO: 144968 - protein, 9 aa, Homo Sapiens
YHDKNIVLL

SEQ ID NO: 144969 - protein, 9 aa, Homo Sapiens
YIDDLVVIL

SEQ ID NO: 144970 - protein, 9 aa, Homo Sapiens
YIDLPPPRL

SEQ ID NO: 144971 - protein, 9 aa, Homo Sapiens
YLDEYIARM

SEQ ID NO: 144972 - protein, 9 aa, Homo Sapiens
YLDLILNDF

SEQ ID NO: 144973 - protein, 9 aa, Homo Sapiens
YLDNGVVFV

SEQ ID NO: 144974 - protein, 9 aa, Homo Sapiens
YLPDFLDYF

SEQ ID NO: 144975 - protein, 9 aa, Homo Sapiens
YMDLASRLV

SEQ ID NO: 144976 - protein, 9 aa, Homo Sapiens
YMDTLNIFM

SEQ ID NO: 144977 - protein, 9 aa, Homo Sapiens
YMDYAQARF

SEQ ID NO: 144978 - protein, 9 aa, Homo Sapiens
YVDDGLISL

SEQ ID NO: 144979 - protein, 9 aa, Homo Sapiens
YVPDSPALL

SEQ ID NO: 144980 - protein, 9 aa, Homo Sapiens
YVQDYEDFM

SEQ ID NO: 144981 - protein, 9 aa, Homo Sapiens
YWDCSVCTF

SEQ ID NO: 144982 - protein, 9 aa, Homo Sapiens
YWEEEPAEV

SEQ ID NO: 144983 - protein, 9 aa, Homo Sapiens
YWENKIVRI

SEQ ID NO: 144984 - protein, 9 aa, Homo Sapiens
YWEPAEVFL

SEQ ID NO: 144985 - protein, 9 aa, Homo Sapiens
YYAYLPAKL

SEQ ID NO: 144986 - protein, 9 aa, Homo Sapiens
YYDDYRVQL

SEQ ID NO: 144987 - protein, 9 aa, Homo Sapiens
YYDEIAVPF

SEQ ID NO: 144988 - protein, 9 aa, Homo Sapiens
YYDEIINAL

SEQ ID NO: 144989 - protein, 9 aa, Homo Sapiens
YYDEKVVKL

SEQ ID NO: 144990 - protein, 9 aa, Homo Sapiens
YYDGKVMKL

SEQ ID NO: 144991 - protein, 9 aa, Homo Sapiens
YYDIHRSYL

SEQ ID NO: 144992 - protein, 9 aa, Homo Sapiens
YYDKHFTEF

SEQ ID NO: 144993 - protein, 9 aa, Homo Sapiens
YYDLQEVLL

SEQ ID NO: 144994 - protein, 9 aa, Homo Sapiens
YYDLQGHLF

SEQ ID NO: 144995 - protein, 9 aa, Homo Sapiens
YYDLVKAFM

SEQ ID NO: 144996 - protein, 9 aa, Homo Sapiens
YYDLVRTEI

SEQ ID NO: 144997 - protein, 9 aa, Homo Sapiens
YYDMMDLKV

SEQ ID NO: 144998 - protein, 9 aa, Homo Sapiens
YYDPDYSFL

SEQ ID NO: 144999 - protein, 9 aa, Homo Sapiens
YYDPKHVIF

SEQ ID NO: 145000 - protein, 9 aa, Homo Sapiens
YYDPMISKL

SEQ ID NO: 145001 - protein, 9 aa, Homo Sapiens
YYDVAKILI

SEQ ID NO: 145002 - protein, 9 aa, Homo Sapiens
YYDVAKQLL

SEQ ID NO: 145003 - protein, 9 aa, Homo Sapiens
YYDVEPFLF

SEQ ID NO: 145004 - protein, 9 aa, Homo Sapiens
YYDVPIATL

SEQ ID NO: 145005 - protein, 9 aa, Homo Sapiens
YYDYEIERF

SEQ ID NO: 145006 - protein, 9 aa, Homo Sapiens
YYEEFPINL

SEQ ID NO: 145007 - protein, 9 aa, Homo Sapiens
YYEEQHPEL

SEQ ID NO: 145008 - protein, 9 aa, Homo Sapiens
YYEERTCIL

SEQ ID NO: 145009 - protein, 9 aa, Homo Sapiens
YYELAQVLL

SEQ ID NO: 145010 - protein, 9 aa, Homo Sapiens
YYEVHKELF

SEQ ID NO: 145011 - protein, 9 aa, Homo Sapiens
YYPAFLDMV

SEQ ID NO: 145012 - protein, 9 aa, Homo Sapiens
YYSPSCREF

SEQ ID NO: 145013 - protein, 9 aa, Homo Sapiens
YYTEFPTVL

SEQ ID NO: 145014 - protein, 10 aa, Homo Sapiens
AFDGRPSVAM

SEQ ID NO: 145015 - protein, 10 aa, Homo Sapiens
AFDLVNIHLF

SEQ ID NO: 145016 - protein, 10 aa, Homo Sapiens
AFDSSSAVFL

SEQ ID NO: 145017 - protein, 10 aa, Homo Sapiens
AFDVVERSFL

SEQ ID NO: 145018 - protein, 10 aa, Homo Sapiens
AFYDWDNTEL

SEQ ID NO: 145019 - protein, 10 aa, Homo Sapiens
AWDIFQPLLF

SEQ ID NO: 145020 - protein, 10 aa, Homo Sapiens
AYDDKIYYFF

SEQ ID NO: 145021 - protein, 10 aa, Homo Sapiens
AYDGKDYIAL

SEQ ID NO: 145022 - protein, 10 aa, Homo Sapiens
AYDLASREWL

SEQ ID NO: 145023 - protein, 10 aa, Homo Sapiens
AYDPTAPTLF

SEQ ID NO: 145024 - protein, 10 aa, Homo Sapiens
AYDVPNPVFL

SEQ ID NO: 145025 - protein, 10 aa, Homo Sapiens
AYDVSSFSFF

SEQ ID NO: 145026 - protein, 10 aa, Homo Sapiens
CWDPSPQAYF

SEQ ID NO: 145027 - protein, 10 aa, Homo Sapiens
DFDPALLEFL

SEQ ID NO: 145028 - protein, 10 aa, Homo Sapiens
EAIFDAGTLG

SEQ ID NO: 145029 - protein, 10 aa, Homo Sapiens
EASFDGTFLW

SEQ ID NO: 145030 - protein, 10 aa, Homo Sapiens
EISYAKYGSF

SEQ ID NO: 145031 - protein, 10 aa, Homo Sapiens
FFDAGAAEFL

SEQ ID NO: 145032 - protein, 10 aa, Homo Sapiens
FFDATDRVSF

SEQ ID NO: 145033 - protein, 10 aa, Homo Sapiens
FFDDVGAVTL

SEQ ID NO: 145034 - protein, 10 aa, Homo Sapiens
FFDEMADPDL

SEQ ID NO: 145035 - protein, 10 aa, Homo Sapiens
FFDPNTHENL

SEQ ID NO: 145036 - protein, 10 aa, Homo Sapiens
FFDPSLLHLL

SEQ ID NO: 145037 - protein, 10 aa, Homo Sapiens
FFDSQGQVLL

SEQ ID NO: 145038 - protein, 10 aa, Homo Sapiens
FFDTLPSSEF

SEQ ID NO: 145039 - protein, 10 aa, Homo Sapiens
FFDTNTSVLM

SEQ ID NO: 145040 - protein, 10 aa, Homo Sapiens
FFDVLPVHKF

SEQ ID NO: 145041 - protein, 10 aa, Homo Sapiens
FFDYNYGQYF

SEQ ID NO: 145042 - protein, 10 aa, Homo Sapiens
FFEDEKPALL

SEQ ID NO: 145043 - protein, 10 aa, Homo Sapiens
FFGTHETAFL

SEQ ID NO: 145044 - protein, 10 aa, Homo Sapiens
FLPEAPAELL

SEQ ID NO: 145045 - protein, 10 aa, Homo Sapiens
FMEAIAPPLL

SEQ ID NO: 145046 - protein, 10 aa, Homo Sapiens
FPFDVTKVEV

SEQ ID NO: 145047 - protein, 10 aa, Homo Sapiens
FTDEESRVFL

SEQ ID NO: 145048 - protein, 10 aa, Homo Sapiens
FWDQQEPVIV

SEQ ID NO: 145049 - protein, 10 aa, Homo Sapiens
FWPPYVELLL

SEQ ID NO: 145050 - protein, 10 aa, Homo Sapiens
FYDDREFIYL

SEQ ID NO: 145051 - protein, 10 aa, Homo Sapiens
FYDFFRYVEM

SEQ ID NO: 145052 - protein, 10 aa, Homo Sapiens
FYDLYGGEKF

SEQ ID NO: 145053 - protein, 10 aa, Homo Sapiens
FYDNKGITYL

SEQ ID NO: 145054 - protein, 10 aa, Homo Sapiens
FYDPDTVELM

SEQ ID NO: 145055 - protein, 10 aa, Homo Sapiens
FYDPTAGVVM

SEQ ID NO: 145056 - protein, 10 aa, Homo Sapiens
GPPPPPGKPQ

SEQ ID NO: 145057 - protein, 10 aa, Homo Sapiens
GSFDETCTRF

SEQ ID NO: 145058 - protein, 10 aa, Homo Sapiens
GSFDVADRMF

SEQ ID NO: 145059 - protein, 10 aa, Homo Sapiens
HFDASLSTYF

SEQ ID NO: 145060 - protein, 10 aa, Homo Sapiens
HFDDTVVCLD

SEQ ID NO: 145061 - protein, 10 aa, Homo Sapiens
HFDLASSIFV

SEQ ID NO: 145062 - protein, 10 aa, Homo Sapiens
HFDMNIISML

SEQ ID NO: 145063 - protein, 10 aa, Homo Sapiens
HFDVALGRMV

SEQ ID NO: 145064 - protein, 10 aa, Homo Sapiens
HWDIADATVL

SEQ ID NO: 145065 - protein, 10 aa, Homo Sapiens
HWDPVNGYFF

SEQ ID NO: 145066 - protein, 10 aa, Homo Sapiens
HWDVTEAVFH

SEQ ID NO: 145067 - protein, 10 aa, Homo Sapiens
HYDPATEEFI

SEQ ID NO: 145068 - protein, 10 aa, Homo Sapiens
HYMPPPYASL

SEQ ID NO: 145069 - protein, 10 aa, Homo Sapiens
IFDLQSNTVL

SEQ ID NO: 145070 - protein, 10 aa, Homo Sapiens
IFDRYGEEGL

SEQ ID NO: 145071 - protein, 10 aa, Homo Sapiens
IFDVVDGTYV

SEQ ID NO: 145072 - protein, 10 aa, Homo Sapiens
IGDFSKGYLF

SEQ ID NO: 145073 - protein, 10 aa, Homo Sapiens
ISDFGLATVF

SEQ ID NO: 145074 - protein, 10 aa, Homo Sapiens
IWPEKVLDIL

SEQ ID NO: 145075 - protein, 10 aa, Homo Sapiens
IYDDQGHIHL

SEQ ID NO: 145076 - protein, 10 aa, Homo Sapiens
IYDEAISSFF

SEQ ID NO: 145077 - protein, 10 aa, Homo Sapiens
IYDIYGKRGL

SEQ ID NO: 145078 - protein, 10 aa, Homo Sapiens
IYIQIEHSAI

SEQ ID NO: 145079 - protein, 10 aa, Homo Sapiens
KFDEVLVNHF

SEQ ID NO: 145080 - protein, 10 aa, Homo Sapiens
KFDLAARTLL

SEQ ID NO: 145081 - protein, 10 aa, Homo Sapiens
KFDNIGMNAM

SEQ ID NO: 145082 - protein, 10 aa, Homo Sapiens
KWEWPNPVLL

SEQ ID NO: 145083 - protein, 10 aa, Homo Sapiens
KYDPEEPIYF

SEQ ID NO: 145084 - protein, 10 aa, Homo Sapiens
LFDANKAELF

SEQ ID NO: 145085 - protein, 10 aa, Homo Sapiens
LFDISGRAPL

SEQ ID NO: 145086 - protein, 10 aa, Homo Sapiens
LFDLGVAYGI

SEQ ID NO: 145087 - protein, 10 aa, Homo Sapiens
LFDLTPAKVL

SEQ ID NO: 145088 - protein, 10 aa, Homo Sapiens
LFDPCNSVEF

SEQ ID NO: 145089 - protein, 10 aa, Homo Sapiens
LFDRPMHVKM

SEQ ID NO: 145090 - protein, 10 aa, Homo Sapiens
LFDVLHEPFL

SEQ ID NO: 145091 - protein, 10 aa, Homo Sapiens
LTDMSRPVEL

SEQ ID NO: 145092 - protein, 10 aa, Homo Sapiens
LWDDKGPAKI

SEQ ID NO: 145093 - protein, 10 aa, Homo Sapiens
LWDSAVSHFF

SEQ ID NO: 145094 - protein, 10 aa, Homo Sapiens
LYDELRNLLL

SEQ ID NO: 145095 - protein, 10 aa, Homo Sapiens
LYDLLRNTNF

SEQ ID NO: 145096 - protein, 10 aa, Homo Sapiens
LYDLVTEKMF

SEQ ID NO: 145097 - protein, 10 aa, Homo Sapiens
LYDPCTVMFF

SEQ ID NO: 145098 - protein, 10 aa, Homo Sapiens
LYDQLATICP

SEQ ID NO: 145099 - protein, 10 aa, Homo Sapiens
LYMIPVGAFI

SEQ ID NO: 145100 - protein, 10 aa, Homo Sapiens
LYPEVPPEEF

SEQ ID NO: 145101 - protein, 10 aa, Homo Sapiens
MFDDIGRNFL

SEQ ID NO: 145102 - protein, 10 aa, Homo Sapiens
MFDLTTRLIL

SEQ ID NO: 145103 - protein, 10 aa, Homo Sapiens
MFDVASGRLM

SEQ ID NO: 145104 - protein, 10 aa, Homo Sapiens
MFDVTNATTF

SEQ ID NO: 145105 - protein, 10 aa, Homo Sapiens
NFDEALVDYF

SEQ ID NO: 145106 - protein, 10 aa, Homo Sapiens
NFDPHYPIIL

SEQ ID NO: 145107 - protein, 10 aa, Homo Sapiens
NYDLHDTVSF

SEQ ID NO: 145108 - protein, 10 aa, Homo Sapiens
PASSSLPAFL

SEQ ID NO: 145109 - protein, 10 aa, Homo Sapiens
QFDEGLPPIL

SEQ ID NO: 145110 - protein, 10 aa, Homo Sapiens
QWEDLTPLTF

SEQ ID NO: 145111 - protein, 10 aa, Homo Sapiens
QYDEAISDYF

SEQ ID NO: 145112 - protein, 10 aa, Homo Sapiens
RFDDPGLMLM

SEQ ID NO: 145113 - protein, 10 aa, Homo Sapiens
RFDEISFVNF

SEQ ID NO: 145114 - protein, 10 aa, Homo Sapiens
RFDPLGHYLL

SEQ ID NO: 145115 - protein, 10 aa, Homo Sapiens
RFDSNNVVLI

SEQ ID NO: 145116 - protein, 10 aa, Homo Sapiens
SAPGYLPTSL

SEQ ID NO: 145117 - protein, 10 aa, Homo Sapiens
SFDETVTHFI

SEQ ID NO: 145118 - protein, 10 aa, Homo Sapiens
SFDIGDQPVF

SEQ ID NO: 145119 - protein, 10 aa, Homo Sapiens
SFDKGPFATF

SEQ ID NO: 145120 - protein, 10 aa, Homo Sapiens
SLPAGDALYL

SEQ ID NO: 145121 - protein, 10 aa, Homo Sapiens
SWDDSSDSYW

SEQ ID NO: 145122 - protein, 10 aa, Homo Sapiens
SYDPTIENTF

SEQ ID NO: 145123 - protein, 10 aa, Homo Sapiens
SYDPVLNPVL

SEQ ID NO: 145124 - protein, 10 aa, Homo Sapiens
SYDVLHLVEF

SEQ ID NO: 145125 - protein, 10 aa, Homo Sapiens
TACVDIPQLL

SEQ ID NO: 145126 - protein, 10 aa, Homo Sapiens
TFDAGAGIAL

SEQ ID NO: 145127 - protein, 10 aa, Homo Sapiens
TFDETVSTYV

SEQ ID NO: 145128 - protein, 10 aa, Homo Sapiens
TFDILQDLEF

SEQ ID NO: 145129 - protein, 10 aa, Homo Sapiens
TWDYVAPFLE

SEQ ID NO: 145130 - protein, 10 aa, Homo Sapiens
TYDDRAYSSF

SEQ ID NO: 145131 - protein, 10 aa, Homo Sapiens
TYDLMSSAYL

SEQ ID NO: 145132 - protein, 10 aa, Homo Sapiens
TYDTSFLDFL

SEQ ID NO: 145133 - protein, 10 aa, Homo Sapiens
TYDYGGFTMM

SEQ ID NO: 145134 - protein, 10 aa, Homo Sapiens
VFDAMFNGGM

SEQ ID NO: 145135 - protein, 10 aa, Homo Sapiens
VFDASSIQYF

SEQ ID NO: 145136 - protein, 10 aa, Homo Sapiens
VFDDGRYVYL

SEQ ID NO: 145137 - protein, 10 aa, Homo Sapiens
VFDEADRMFD

SEQ ID NO: 145138 - protein, 10 aa, Homo Sapiens
VFDEAILAAL

SEQ ID NO: 145139 - protein, 10 aa, Homo Sapiens
VFDEAIRAVL

SEQ ID NO: 145140 - protein, 10 aa, Homo Sapiens
VFDETGHFVL

SEQ ID NO: 145141 - protein, 10 aa, Homo Sapiens
VFDFPDLNRF

SEQ ID NO: 145142 - protein, 10 aa, Homo Sapiens
VFDLNDESKW

SEQ ID NO: 145143 - protein, 10 aa, Homo Sapiens
VFDLTDLDVL

SEQ ID NO: 145144 - protein, 10 aa, Homo Sapiens
VFDMAGEIGF

SEQ ID NO: 145145 - protein, 10 aa, Homo Sapiens
VFDMGAEVGF

SEQ ID NO: 145146 - protein, 10 aa, Homo Sapiens
VFDPVQKTLL

SEQ ID NO: 145147 - protein, 10 aa, Homo Sapiens
VFDQPQEYFM

SEQ ID NO: 145148 - protein, 10 aa, Homo Sapiens
VFDTAIAHLF

SEQ ID NO: 145149 - protein, 10 aa, Homo Sapiens
VFDTSIAQLF

SEQ ID NO: 145150 - protein, 10 aa, Homo Sapiens
VFDTTFQSHL

SEQ ID NO: 145151 - protein, 10 aa, Homo Sapiens
VFDVFLVEGY

SEQ ID NO: 145152 - protein, 10 aa, Homo Sapiens
VFDVGGLLED

SEQ ID NO: 145153 - protein, 10 aa, Homo Sapiens
VFDVLDGEEM

SEQ ID NO: 145154 - protein, 10 aa, Homo Sapiens
VFDVTAPNTF

SEQ ID NO: 145155 - protein, 10 aa, Homo Sapiens
VFDVTERTAL

SEQ ID NO: 145156 - protein, 10 aa, Homo Sapiens
VFDVTKGSKF

SEQ ID NO: 145157 - protein, 10 aa, Homo Sapiens
VTDEFLSDFL

SEQ ID NO: 145158 - protein, 10 aa, Homo Sapiens
VTDEPVYIDL

SEQ ID NO: 145159 - protein, 10 aa, Homo Sapiens
VWDIFQPLLF

SEQ ID NO: 145160 - protein, 10 aa, Homo Sapiens
VWDLAQQVVL

SEQ ID NO: 145161 - protein, 10 aa, Homo Sapiens
VWDYAGDNYV

SEQ ID NO: 145162 - protein, 10 aa, Homo Sapiens
VYDDGKYVYV

SEQ ID NO: 145163 - protein, 10 aa, Homo Sapiens
VYDDMAFRYL

SEQ ID NO: 145164 - protein, 10 aa, Homo Sapiens
VYDGEHLGSF

SEQ ID NO: 145165 - protein, 10 aa, Homo Sapiens
VYDIADHPDF

SEQ ID NO: 145166 - protein, 10 aa, Homo Sapiens
VYDITNVNSF

SEQ ID NO: 145167 - protein, 10 aa, Homo Sapiens
VYDPSLKTLL

SEQ ID NO: 145168 - protein, 10 aa, Homo Sapiens
VYDPYKPYQL

SEQ ID NO: 145169 - protein, 10 aa, Homo Sapiens
VYDSQGLLIF

SEQ ID NO: 145170 - protein, 10 aa, Homo Sapiens
VYDVTDQESF

SEQ ID NO: 145171 - protein, 10 aa, Homo Sapiens
VYDVTKMTSF

SEQ ID NO: 145172 - protein, 10 aa, Homo Sapiens
YFDAIPVTMT

SEQ ID NO: 145173 - protein, 10 aa, Homo Sapiens
YFYDRRRIYL

SEQ ID NO: 145174 - protein, 10 aa, Homo Sapiens
YIDFMGTDAA

SEQ ID NO: 145175 - protein, 10 aa, Homo Sapiens
YVDGPASTAF

SEQ ID NO: 145176 - protein, 10 aa, Homo Sapiens
YWDGEKETYV

SEQ ID NO: 145177 - protein, 10 aa, Homo Sapiens
YWDPLLGTCM

SEQ ID NO: 145178 - protein, 10 aa, Homo Sapiens
YWPTYTPMEV

SEQ ID NO: 145179 - protein, 10 aa, Homo Sapiens
YWPTYVPMEV

SEQ ID NO: 145180 - protein, 10 aa, Homo Sapiens
YYDDLKYRYF

SEQ ID NO: 145181 - protein, 10 aa, Homo Sapiens
YYDEKVVKLL

SEQ ID NO: 145182 - protein, 10 aa, Homo Sapiens
YYDLYGGEKF

SEQ ID NO: 145183 - protein, 10 aa, Homo Sapiens
YYDPKHVIFS

SEQ ID NO: 145184 - protein, 10 aa, Homo Sapiens
YYDPQEEVYL

SEQ ID NO: 145185 - protein, 11 aa, Homo Sapiens
AFDVVERSFLE

SEQ ID NO: 145186 - protein, 11 aa, Homo Sapiens
AGDLDKFISEF

SEQ ID NO: 145187 - protein, 11 aa, Homo Sapiens
ASEQILLATAH

SEQ ID NO: 145188 - protein, 11 aa, Homo Sapiens
AVVQDPALKPL

SEQ ID NO: 145189 - protein, 11 aa, Homo Sapiens
AYDDLGNSGHF

SEQ ID NO: 145190 - protein, 11 aa, Homo Sapiens
AYDIGNHFNEF

SEQ ID NO: 145191 - protein, 11 aa, Homo Sapiens
CHAVSAPYASL

SEQ ID NO: 145192 - protein, 11 aa, Homo Sapiens
FAYDGKDYIAL

SEQ ID NO: 145193 - protein, 11 aa, Homo Sapiens
FFDDLGDELLF

SEQ ID NO: 145194 - protein, 11 aa, Homo Sapiens
FFDEMADPDLL

SEQ ID NO: 145195 - protein, 11 aa, Homo Sapiens
FFDHSGTLVMD

SEQ ID NO: 145196 - protein, 11 aa, Homo Sapiens
FFDPASIMDES

SEQ ID NO: 145197 - protein, 11 aa, Homo Sapiens
FFDPDTNIVYL

SEQ ID NO: 145198 - protein, 11 aa, Homo Sapiens
FFDPSLLHLLY

SEQ ID NO: 145199 - protein, 11 aa, Homo Sapiens
FYDETYDYGGF

SEQ ID NO: 145200 - protein, 11 aa, Homo Sapiens
FYDPDTSIIYL

SEQ ID NO: 145201 - protein, 11 aa, Homo Sapiens
FYDPTAGVVML

SEQ ID NO: 145202 - protein, 11 aa, Homo Sapiens
FYEPQKGSIYL

SEQ ID NO: 145203 - protein, 11 aa, Homo Sapiens
GDFGAPALPMA

SEQ ID NO: 145204 - protein, 11 aa, Homo Sapiens
GGSFDVADRMF

SEQ ID NO: 145205 - protein, 11 aa, Homo Sapiens
GPPPPPPGKPQ

SEQ ID NO: 145206 - protein, 11 aa, Homo Sapiens
HFDDIGPSVVM

SEQ ID NO: 145207 - protein, 11 aa, Homo Sapiens
HFDLASSIFVA

SEQ ID NO: 145208 - protein, 11 aa, Homo Sapiens
HFDTQNNISTM

SEQ ID NO: 145209 - protein, 11 aa, Homo Sapiens
HWDPEYSDVKL

SEQ ID NO: 145210 - protein, 11 aa, Homo Sapiens
IFDLQSNTVLA

SEQ ID NO: 145211 - protein, 11 aa, Homo Sapiens
IWDPHNGDILM

SEQ ID NO: 145212 - protein, 11 aa, Homo Sapiens
IYDFIGEFMKA

SEQ ID NO: 145213 - protein, 11 aa, Homo Sapiens
IYDPQEGAVVV

SEQ ID NO: 145214 - protein, 11 aa, Homo Sapiens
IYDRDFSYNYF

SEQ ID NO: 145215 - protein, 11 aa, Homo Sapiens
LYDPASGTISL

SEQ ID NO: 145216 - protein, 11 aa, Homo Sapiens
MAPSETQFSHL

SEQ ID NO: 145217 - protein, 11 aa, Homo Sapiens
NFDVGHVPIRL

SEQ ID NO: 145218 - protein, 11 aa, Homo Sapiens
SFDEMLPGTHF

SEQ ID NO: 145219 - protein, 11 aa, Homo Sapiens
SFDVTQSPFFP

SEQ ID NO: 145220 - protein, 11 aa, Homo Sapiens
SYDAPSDFINF

SEQ ID NO: 145221 - protein, 11 aa, Homo Sapiens
TFDVAPSRLDF

SEQ ID NO: 145222 - protein, 11 aa, Homo Sapiens
VFDDSGVFDQT

SEQ ID NO: 145223 - protein, 11 aa, Homo Sapiens
VFDEAIRAVLC

SEQ ID NO: 145224 - protein, 11 aa, Homo Sapiens
VFDFGRRPVLL

SEQ ID NO: 145225 - protein, 11 aa, Homo Sapiens
VFDLAWVPGEL

SEQ ID NO: 145226 - protein, 11 aa, Homo Sapiens
VFDLNTPVHTF

SEQ ID NO: 145227 - protein, 11 aa, Homo Sapiens
VFDTAPTGHTL

SEQ ID NO: 145228 - protein, 11 aa, Homo Sapiens
VTAPKNVSDII

SEQ ID NO: 145229 - protein, 11 aa, Homo Sapiens
VWDEGCAVVHL

SEQ ID NO: 145230 - protein, 11 aa, Homo Sapiens
VWDLFPEADKV

SEQ ID NO: 145231 - protein, 11 aa, Homo Sapiens
VWNAQEAQADF

SEQ ID NO: 145232 - protein, 11 aa, Homo Sapiens
VYDIDNKTIEL

SEQ ID NO: 145233 - protein, 11 aa, Homo Sapiens
VYDNIGILGNF

SEQ ID NO: 145234 - protein, 11 aa, Homo Sapiens
VYDPSPVSPFI

SEQ ID NO: 145235 - protein, 11 aa, Homo Sapiens
YFDAIPVTMTM

SEQ ID NO: 145236 - protein, 11 aa, Homo Sapiens
YWIDEPDVLVM

SEQ ID NO: 145237 - protein, 8 aa, Homo Sapiens
AADAGTFL

SEQ ID NO: 145238 - protein, 8 aa, Homo Sapiens
AADEPVYI

SEQ ID NO: 145239 - protein, 8 aa, Homo Sapiens
AADGFSLL

SEQ ID NO: 145240 - protein, 8 aa, Homo Sapiens
AADGVIRL

SEQ ID NO: 145241 - protein, 8 aa, Homo Sapiens
AADIAVQL

SEQ ID NO: 145242 - protein, 8 aa, Homo Sapiens
AADKVVFL

SEQ ID NO: 145243 - protein, 8 aa, Homo Sapiens
AADNQIYI

SEQ ID NO: 145244 - protein, 8 aa, Homo Sapiens
AADSAVRL

SEQ ID NO: 145245 - protein, 8 aa, Homo Sapiens
AADTVVIF

SEQ ID NO: 145246 - protein, 8 aa, Homo Sapiens
AADVLVYL

SEQ ID NO: 145247 - protein, 8 aa, Homo Sapiens
AIDEYQIL

SEQ ID NO: 145248 - protein, 8 aa, Homo Sapiens
AIDSPVSF

SEQ ID NO: 145249 - protein, 8 aa, Homo Sapiens
ASDAAAFL

SEQ ID NO: 145250 - protein, 8 aa, Homo Sapiens
ATDFFTVL

SEQ ID NO: 145251 - protein, 8 aa, Homo Sapiens
ATDIFSYL

SEQ ID NO: 145252 - protein, 8 aa, Homo Sapiens
ATDLAYYL

SEQ ID NO: 145253 - protein, 8 aa, Homo Sapiens
ATDLVVCV

SEQ ID NO: 145254 - protein, 8 aa, Homo Sapiens
ATDVAAFL

SEQ ID NO: 145255 - protein, 8 aa, Homo Sapiens
AVDEPQML

SEQ ID NO: 145256 - protein, 8 aa, Homo Sapiens
DLPNGRVC

SEQ ID NO: 145257 - protein, 8 aa, Homo Sapiens
EVGPDGVR

SEQ ID NO: 145258 - protein, 8 aa, Homo Sapiens
FADAITEL

SEQ ID NO: 145259 - protein, 8 aa, Homo Sapiens
FADATVEL

SEQ ID NO: 145260 - protein, 8 aa, Homo Sapiens
FADAVQEL

SEQ ID NO: 145261 - protein, 8 aa, Homo Sapiens
FADDMQEF

SEQ ID NO: 145262 - protein, 8 aa, Homo Sapiens
FADEFIFL

SEQ ID NO: 145263 - protein, 8 aa, Homo Sapiens
FADGFVLV

SEQ ID NO: 145264 - protein, 8 aa, Homo Sapiens
FADGVILL

SEQ ID NO: 145265 - protein, 8 aa, Homo Sapiens
FADGVYLV

SEQ ID NO: 145266 - protein, 8 aa, Homo Sapiens
FADISNLL

SEQ ID NO: 145267 - protein, 8 aa, Homo Sapiens
FADLCSSL

SEQ ID NO: 145268 - protein, 8 aa, Homo Sapiens
FADLHAYL

SEQ ID NO: 145269 - protein, 8 aa, Homo Sapiens
FADLPALF

SEQ ID NO: 145270 - protein, 8 aa, Homo Sapiens
FADQPIQI

SEQ ID NO: 145271 - protein, 8 aa, Homo Sapiens
FADSSYLL

SEQ ID NO: 145272 - protein, 8 aa, Homo Sapiens
FADVAVYF

SEQ ID NO: 145273 - protein, 8 aa, Homo Sapiens
FADVETHF

SEQ ID NO: 145274 - protein, 8 aa, Homo Sapiens
FADVIVLF

SEQ ID NO: 145275 - protein, 8 aa, Homo Sapiens
FADVSVKF

SEQ ID NO: 145276 - protein, 8 aa, Homo Sapiens
FAERVTSL

SEQ ID NO: 145277 - protein, 8 aa, Homo Sapiens
FFENHPYF

SEQ ID NO: 145278 - protein, 8 aa, Homo Sapiens
FFESFGDL

SEQ ID NO: 145279 - protein, 8 aa, Homo Sapiens
FGDACVYL

SEQ ID NO: 145280 - protein, 8 aa, Homo Sapiens
FIDAVYKL

SEQ ID NO: 145281 - protein, 8 aa, Homo Sapiens
FIDDLADL

SEQ ID NO: 145282 - protein, 8 aa, Homo Sapiens
FIDEEVLM

SEQ ID NO: 145283 - protein, 8 aa, Homo Sapiens
FIDEQQIL

SEQ ID NO: 145284 - protein, 8 aa, Homo Sapiens
FIDEYIVL

SEQ ID NO: 145285 - protein, 8 aa, Homo Sapiens
FIDKPVCF

SEQ ID NO: 145286 - protein, 8 aa, Homo Sapiens
FIDKQTNL

SEQ ID NO: 145287 - protein, 8 aa, Homo Sapiens
FIDQPQFL

SEQ ID NO: 145288 - protein, 8 aa, Homo Sapiens
FIDTTSKF

SEQ ID NO: 145289 - protein, 8 aa, Homo Sapiens
FLDEEVKL

SEQ ID NO: 145290 - protein, 8 aa, Homo Sapiens
FLDKPTLL

SEQ ID NO: 145291 - protein, 8 aa, Homo Sapiens
FLDVAGLL

SEQ ID NO: 145292 - protein, 8 aa, Homo Sapiens
FLDVVSKL

SEQ ID NO: 145293 - protein, 8 aa, Homo Sapiens
FNDTFVHV

SEQ ID NO: 145294 - protein, 8 aa, Homo Sapiens
FQDAYVLL

SEQ ID NO: 145295 - protein, 8 aa, Homo Sapiens
FSDGAVSL

SEQ ID NO: 145296 - protein, 8 aa, Homo Sapiens
FSDVEAHF

SEQ ID NO: 145297 - protein, 8 aa, Homo Sapiens
FTDERIFM

SEQ ID NO: 145298 - protein, 8 aa, Homo Sapiens
FTDFHIDF

SEQ ID NO: 145299 - protein, 8 aa, Homo Sapiens
FTDGSVTL

SEQ ID NO: 145300 - protein, 8 aa, Homo Sapiens
FTDGTIRL

SEQ ID NO: 145301 - protein, 8 aa, Homo Sapiens
FTDLCVYF

SEQ ID NO: 145302 - protein, 8 aa, Homo Sapiens
FTDLSSRF

SEQ ID NO: 145303 - protein, 8 aa, Homo Sapiens
FTDNAVAF

SEQ ID NO: 145304 - protein, 8 aa, Homo Sapiens
FTDTPLQI

SEQ ID NO: 145305 - protein, 8 aa, Homo Sapiens
FTDTSIIL

SEQ ID NO: 145306 - protein, 8 aa, Homo Sapiens
FTDTVIRI

SEQ ID NO: 145307 - protein, 8 aa, Homo Sapiens
FTDVEASL

SEQ ID NO: 145308 - protein, 8 aa, Homo Sapiens
FTEDRIWL

SEQ ID NO: 145309 - protein, 8 aa, Homo Sapiens
FVDDETKL

SEQ ID NO: 145310 - protein, 8 aa, Homo Sapiens
FVDGVSTV

SEQ ID NO: 145311 - protein, 8 aa, Homo Sapiens
FVDNHVEL

SEQ ID NO: 145312 - protein, 8 aa, Homo Sapiens
FVDQFVEL

SEQ ID NO: 145313 - protein, 8 aa, Homo Sapiens
FVDSTFYL

SEQ ID NO: 145314 - protein, 8 aa, Homo Sapiens
FVDTEIRL

SEQ ID NO: 145315 - protein, 8 aa, Homo Sapiens
FVDTVVAL

SEQ ID NO: 145316 - protein, 8 aa, Homo Sapiens
GADYAVYI

SEQ ID NO: 145317 - protein, 8 aa, Homo Sapiens
GDLPNGRV

SEQ ID NO: 145318 - protein, 8 aa, Homo Sapiens
HTDLPVSV

SEQ ID NO: 145319 - protein, 8 aa, Homo Sapiens
HTDTTVKF

SEQ ID NO: 145320 - protein, 8 aa, Homo Sapiens
HTDTVVNF

SEQ ID NO: 145321 - protein, 8 aa, Homo Sapiens
HVDVVVNF

SEQ ID NO: 145322 - protein, 8 aa, Homo Sapiens
IADAHGLL

SEQ ID NO: 145323 - protein, 8 aa, Homo Sapiens
IADDFAAF

SEQ ID NO: 145324 - protein, 8 aa, Homo Sapiens
IADFFTEL

SEQ ID NO: 145325 - protein, 8 aa, Homo Sapiens
IADKVVFL

SEQ ID NO: 145326 - protein, 8 aa, Homo Sapiens
IADLAHLL

SEQ ID NO: 145327 - protein, 8 aa, Homo Sapiens
IADLWVVL

SEQ ID NO: 145328 - protein, 8 aa, Homo Sapiens
IADNIIFL

SEQ ID NO: 145329 - protein, 8 aa, Homo Sapiens
IADQITLL

SEQ ID NO: 145330 - protein, 8 aa, Homo Sapiens
IADRLVLL

SEQ ID NO: 145331 - protein, 8 aa, Homo Sapiens
IADRPLYL

SEQ ID NO: 145332 - protein, 8 aa, Homo Sapiens
IADSFQVI

SEQ ID NO: 145333 - protein, 8 aa, Homo Sapiens
IADVSTGL

SEQ ID NO: 145334 - protein, 8 aa, Homo Sapiens
IEDAFEVL

SEQ ID NO: 145335 - protein, 8 aa, Homo Sapiens
IEGIPVTL

SEQ ID NO: 145336 - protein, 8 aa, Homo Sapiens
IGESANLL

SEQ ID NO: 145337 - protein, 8 aa, Homo Sapiens
IIDCVVRI

SEQ ID NO: 145338 - protein, 8 aa, Homo Sapiens
IIDDRVIL

SEQ ID NO: 145339 - protein, 8 aa, Homo Sapiens
IIDKEVSL

SEQ ID NO: 145340 - protein, 8 aa, Homo Sapiens
IIDKYIKL

SEQ ID NO: 145341 - protein, 8 aa, Homo Sapiens
IIDTPGIL

SEQ ID NO: 145342 - protein, 8 aa, Homo Sapiens
IIDYEVSI

SEQ ID NO: 145343 - protein, 8 aa, Homo Sapiens
INDTVVRF

SEQ ID NO: 145344 - protein, 8 aa, Homo Sapiens
ISDFAVFL

SEQ ID NO: 145345 - protein, 8 aa, Homo Sapiens
ISDYAVKI

SEQ ID NO: 145346 - protein, 8 aa, Homo Sapiens
ITDITALL

SEQ ID NO: 145347 - protein, 8 aa, Homo Sapiens
ITDLISEL

SEQ ID NO: 145348 - protein, 8 aa, Homo Sapiens
ITDLPIKL

SEQ ID NO: 145349 - protein, 8 aa, Homo Sapiens
ITDLYTDL

SEQ ID NO: 145350 - protein, 8 aa, Homo Sapiens
ITDSPVVV

SEQ ID NO: 145351 - protein, 8 aa, Homo Sapiens
ITIDTSYL

SEQ ID NO: 145352 - protein, 8 aa, Homo Sapiens
IVDGIYRL

SEQ ID NO: 145353 - protein, 8 aa, Homo Sapiens
IVDKRVLI

SEQ ID NO: 145354 - protein, 8 aa, Homo Sapiens
IVDRPVTL

SEQ ID NO: 145355 - protein, 8 aa, Homo Sapiens
IVDRVSYL

SEQ ID NO: 145356 - protein, 8 aa, Homo Sapiens
IVDVPAHL

SEQ ID NO: 145357 - protein, 8 aa, Homo Sapiens
KIDKEYLL

SEQ ID NO: 145358 - protein, 8 aa, Homo Sapiens
KSDVPVYL

SEQ ID NO: 145359 - protein, 8 aa, Homo Sapiens
KTDEFQLH

SEQ ID NO: 145360 - protein, 8 aa, Homo Sapiens
LADAVTWL

SEQ ID NO: 145361 - protein, 8 aa, Homo Sapiens
LADAVVKI

SEQ ID NO: 145362 - protein, 8 aa, Homo Sapiens
LADFAELI

SEQ ID NO: 145363 - protein, 8 aa, Homo Sapiens
LADHPVMI

SEQ ID NO: 145364 - protein, 8 aa, Homo Sapiens
LADIAQKL

SEQ ID NO: 145365 - protein, 8 aa, Homo Sapiens
LADIFTKL

SEQ ID NO: 145366 - protein, 8 aa, Homo Sapiens
LADKSVLV

SEQ ID NO: 145367 - protein, 8 aa, Homo Sapiens
LADKVYFL

SEQ ID NO: 145368 - protein, 8 aa, Homo Sapiens
LADLPQQL

SEQ ID NO: 145369 - protein, 8 aa, Homo Sapiens
LADQWQFL

SEQ ID NO: 145370 - protein, 8 aa, Homo Sapiens
LADVATVL

SEQ ID NO: 145371 - protein, 8 aa, Homo Sapiens
LADVETFV

SEQ ID NO: 145372 - protein, 8 aa, Homo Sapiens
LADVGSFL

SEQ ID NO: 145373 - protein, 8 aa, Homo Sapiens
LADYIKVF

SEQ ID NO: 145374 - protein, 8 aa, Homo Sapiens
LIDKPTNL

SEQ ID NO: 145375 - protein, 8 aa, Homo Sapiens
LIEKTNEE

SEQ ID NO: 145376 - protein, 8 aa, Homo Sapiens
LSDHHVYL

SEQ ID NO: 145377 - protein, 8 aa, Homo Sapiens
LTDDHVQF

SEQ ID NO: 145378 - protein, 8 aa, Homo Sapiens
LTDYVAFL

SEQ ID NO: 145379 - protein, 8 aa, Homo Sapiens
LVDHVAEL

SEQ ID NO: 145380 - protein, 8 aa, Homo Sapiens
LVDTTVEL

SEQ ID NO: 145381 - protein, 8 aa, Homo Sapiens
LVSMVVLF

SEQ ID NO: 145382 - protein, 8 aa, Homo Sapiens
MADALQYL

SEQ ID NO: 145383 - protein, 8 aa, Homo Sapiens
MIDFPQMV

SEQ ID NO: 145384 - protein, 8 aa, Homo Sapiens
MTDFAIQF

SEQ ID NO: 145385 - protein, 8 aa, Homo Sapiens
MTDVLVFL

SEQ ID NO: 145386 - protein, 8 aa, Homo Sapiens
NADIVTLL

SEQ ID NO: 145387 - protein, 8 aa, Homo Sapiens
NFDNPVYL

SEQ ID NO: 145388 - protein, 8 aa, Homo Sapiens
NIDDVVRF

SEQ ID NO: 145389 - protein, 8 aa, Homo Sapiens
NIDLPASL

SEQ ID NO: 145390 - protein, 8 aa, Homo Sapiens
NTDEMVEL

SEQ ID NO: 145391 - protein, 8 aa, Homo Sapiens
NTDSVVIF

SEQ ID NO: 145392 - protein, 8 aa, Homo Sapiens
NVDICQLL

SEQ ID NO: 145393 - protein, 8 aa, Homo Sapiens
QADCAVLI

SEQ ID NO: 145394 - protein, 8 aa, Homo Sapiens
QADVAVLV

SEQ ID NO: 145395 - protein, 8 aa, Homo Sapiens
QIDGIVHF

SEQ ID NO: 145396 - protein, 8 aa, Homo Sapiens
SADAPMFV

SEQ ID NO: 145397 - protein, 8 aa, Homo Sapiens
SADFHVDL

SEQ ID NO: 145398 - protein, 8 aa, Homo Sapiens
SADLANLL

SEQ ID NO: 145399 - protein, 8 aa, Homo Sapiens
SADTVVIF

SEQ ID NO: 145400 - protein, 8 aa, Homo Sapiens
SFDFHFGF

SEQ ID NO: 145401 - protein, 8 aa, Homo Sapiens
SIDDVVRL

SEQ ID NO: 145402 - protein, 8 aa, Homo Sapiens
SIDEEVYF

SEQ ID NO: 145403 - protein, 8 aa, Homo Sapiens
SIDLPVVV

SEQ ID NO: 145404 - protein, 8 aa, Homo Sapiens
SLDEVVLL

SEQ ID NO: 145405 - protein, 8 aa, Homo Sapiens
STDRVVLI

SEQ ID NO: 145406 - protein, 8 aa, Homo Sapiens
STDTFTHL

SEQ ID NO: 145407 - protein, 8 aa, Homo Sapiens
TADEIVKL

SEQ ID NO: 145408 - protein, 8 aa, Homo Sapiens
TADICQML

SEQ ID NO: 145409 - protein, 8 aa, Homo Sapiens
TADWRVFL

SEQ ID NO: 145410 - protein, 8 aa, Homo Sapiens
TIDFPEFL

SEQ ID NO: 145411 - protein, 8 aa, Homo Sapiens
TIDGIYYV

SEQ ID NO: 145412 - protein, 8 aa, Homo Sapiens
TIDGVVFV

SEQ ID NO: 145413 - protein, 8 aa, Homo Sapiens
TLQGELIL

SEQ ID NO: 145414 - protein, 8 aa, Homo Sapiens
TSDQPILL

SEQ ID NO: 145415 - protein, 8 aa, Homo Sapiens
TTDIFQTV

SEQ ID NO: 145416 - protein, 8 aa, Homo Sapiens
TVDRVVLL

SEQ ID NO: 145417 - protein, 8 aa, Homo Sapiens
TVPSSIVL

SEQ ID NO: 145418 - protein, 8 aa, Homo Sapiens
VAATMLLL

SEQ ID NO: 145419 - protein, 8 aa, Homo Sapiens
VADAGAFL

SEQ ID NO: 145420 - protein, 8 aa, Homo Sapiens
VADHLQFL

SEQ ID NO: 145421 - protein, 8 aa, Homo Sapiens
VADILTQL

SEQ ID NO: 145422 - protein, 8 aa, Homo Sapiens
VADKFTEL

SEQ ID NO: 145423 - protein, 8 aa, Homo Sapiens
VADKHELL

SEQ ID NO: 145424 - protein, 8 aa, Homo Sapiens
VADKIQLI

SEQ ID NO: 145425 - protein, 8 aa, Homo Sapiens
VADLAHVL

SEQ ID NO: 145426 - protein, 8 aa, Homo Sapiens
VADLQTRL

SEQ ID NO: 145427 - protein, 8 aa, Homo Sapiens
VADLVVIL

SEQ ID NO: 145428 - protein, 8 aa, Homo Sapiens
VADLVVNI

SEQ ID NO: 145429 - protein, 8 aa, Homo Sapiens
VADPVVTF

SEQ ID NO: 145430 - protein, 8 aa, Homo Sapiens
VADRFSEL

SEQ ID NO: 145431 - protein, 8 aa, Homo Sapiens
VADSKTLL

SEQ ID NO: 145432 - protein, 8 aa, Homo Sapiens
VADTILFL

SEQ ID NO: 145433 - protein, 8 aa, Homo Sapiens
VADVEALL

SEQ ID NO: 145434 - protein, 8 aa, Homo Sapiens
VADVVAFL

SEQ ID NO: 145435 - protein, 8 aa, Homo Sapiens
VADVVIKF

SEQ ID NO: 145436 - protein, 8 aa, Homo Sapiens
VFDPHGTL

SEQ ID NO: 145437 - protein, 8 aa, Homo Sapiens
VFDPIGHF

SEQ ID NO: 145438 - protein, 8 aa, Homo Sapiens
VFDPVTKL

SEQ ID NO: 145439 - protein, 8 aa, Homo Sapiens
VFDSHPVL

SEQ ID NO: 145440 - protein, 8 aa, Homo Sapiens
VFDVGGLL

SEQ ID NO: 145441 - protein, 8 aa, Homo Sapiens
VGDLAELL

SEQ ID NO: 145442 - protein, 8 aa, Homo Sapiens
VGDLPNGR

SEQ ID NO: 145443 - protein, 8 aa, Homo Sapiens
VGDSVIIF

SEQ ID NO: 145444 - protein, 8 aa, Homo Sapiens
VGGSVEDL

SEQ ID NO: 145445 - protein, 8 aa, Homo Sapiens
VIDAAVLL

SEQ ID NO: 145446 - protein, 8 aa, Homo Sapiens
VIDACIKL

SEQ ID NO: 145447 - protein, 8 aa, Homo Sapiens
VIDACVKL

SEQ ID NO: 145448 - protein, 8 aa, Homo Sapiens
VIDDFVQF

SEQ ID NO: 145449 - protein, 8 aa, Homo Sapiens
VIDECVEM

SEQ ID NO: 145450 - protein, 8 aa, Homo Sapiens
VIDEIISL

SEQ ID NO: 145451 - protein, 8 aa, Homo Sapiens
VIDEPVRL

SEQ ID NO: 145452 - protein, 8 aa, Homo Sapiens
VIDGVTVL

SEQ ID NO: 145453 - protein, 8 aa, Homo Sapiens
VIDICMKL

SEQ ID NO: 145454 - protein, 8 aa, Homo Sapiens
VIDSPGIL

SEQ ID NO: 145455 - protein, 8 aa, Homo Sapiens
VIDTPGIL

SEQ ID NO: 145456 - protein, 8 aa, Homo Sapiens
VIDVGRLL

SEQ ID NO: 145457 - protein, 8 aa, Homo Sapiens
VIDYAVKI

SEQ ID NO: 145458 - protein, 8 aa, Homo Sapiens
VLDELVRP

SEQ ID NO: 145459 - protein, 8 aa, Homo Sapiens
VLDMHGFL

SEQ ID NO: 145460 - protein, 8 aa, Homo Sapiens
VLWVAVLL

SEQ ID NO: 145461 - protein, 8 aa, Homo Sapiens
VNDGVVRL

SEQ ID NO: 145462 - protein, 8 aa, Homo Sapiens
VSDFHVFV

SEQ ID NO: 145463 - protein, 8 aa, Homo Sapiens
VSDLESYL

SEQ ID NO: 145464 - protein, 8 aa, Homo Sapiens
VSDYEMKL

SEQ ID NO: 145465 - protein, 8 aa, Homo Sapiens
VSELAGLL

SEQ ID NO: 145466 - protein, 8 aa, Homo Sapiens
VTDAFARL

SEQ ID NO: 145467 - protein, 8 aa, Homo Sapiens
VTDAIVLL

SEQ ID NO: 145468 - protein, 8 aa, Homo Sapiens
VTDDLVCL

SEQ ID NO: 145469 - protein, 8 aa, Homo Sapiens
VTDEPVYI

SEQ ID NO: 145470 - protein, 8 aa, Homo Sapiens
VTDFFQKL

SEQ ID NO: 145471 - protein, 8 aa, Homo Sapiens
VTDFISHL

SEQ ID NO: 145472 - protein, 8 aa, Homo Sapiens
VTDISHLV

SEQ ID NO: 145473 - protein, 8 aa, Homo Sapiens
VVDAVMML

SEQ ID NO: 145474 - protein, 8 aa, Homo Sapiens
VVDEAVLV

SEQ ID NO: 145475 - protein, 8 aa, Homo Sapiens
VVDEEVFF

SEQ ID NO: 145476 - protein, 8 aa, Homo Sapiens
VVDEFWLL

SEQ ID NO: 145477 - protein, 8 aa, Homo Sapiens
VVDELVRF

SEQ ID NO: 145478 - protein, 8 aa, Homo Sapiens
VVDGIYRL

SEQ ID NO: 145479 - protein, 8 aa, Homo Sapiens
VVDGVSYL

SEQ ID NO: 145480 - protein, 8 aa, Homo Sapiens
VVDIESRL

SEQ ID NO: 145481 - protein, 8 aa, Homo Sapiens
VVDNPIYL

SEQ ID NO: 145482 - protein, 8 aa, Homo Sapiens
VVDQPLKL

SEQ ID NO: 145483 - protein, 8 aa, Homo Sapiens
VVDRALYL

SEQ ID NO: 145484 - protein, 8 aa, Homo Sapiens
VVDRFVEF

SEQ ID NO: 145485 - protein, 8 aa, Homo Sapiens
VVDVFAQL

SEQ ID NO: 145486 - protein, 8 aa, Homo Sapiens
VVDYLTKL

SEQ ID NO: 145487 - protein, 8 aa, Homo Sapiens
WVGDLPNG

SEQ ID NO: 145488 - protein, 8 aa, Homo Sapiens
YADGESFL

SEQ ID NO: 145489 - protein, 8 aa, Homo Sapiens
YADIQSWL

SEQ ID NO: 145490 - protein, 8 aa, Homo Sapiens
YADIVQLL

SEQ ID NO: 145491 - protein, 8 aa, Homo Sapiens
YADTELLL

SEQ ID NO: 145492 - protein, 8 aa, Homo Sapiens
YADVQAVL

SEQ ID NO: 145493 - protein, 8 aa, Homo Sapiens
YFDEHYEY

SEQ ID NO: 145494 - protein, 8 aa, Homo Sapiens
YFDEPVEL

SEQ ID NO: 145495 - protein, 8 aa, Homo Sapiens
YFDVVEEI

SEQ ID NO: 145496 - protein, 8 aa, Homo Sapiens
YIDKTIRV

SEQ ID NO: 145497 - protein, 8 aa, Homo Sapiens
YIDVAVKL

SEQ ID NO: 145498 - protein, 8 aa, Homo Sapiens
YIELPAYL

SEQ ID NO: 145499 - protein, 8 aa, Homo Sapiens
YSDAIVWL

SEQ ID NO: 145500 - protein, 8 aa, Homo Sapiens
YSDLAEFL

SEQ ID NO: 145501 - protein, 8 aa, Homo Sapiens
YSDVSGLL

SEQ ID NO: 145502 - protein, 8 aa, Homo Sapiens
YTDEAVVI

SEQ ID NO: 145503 - protein, 8 aa, Homo Sapiens
YTDELVEL

SEQ ID NO: 145504 - protein, 8 aa, Homo Sapiens
YTDFHIDF

SEQ ID NO: 145505 - protein, 8 aa, Homo Sapiens
YTDFHVDF

SEQ ID NO: 145506 - protein, 8 aa, Homo Sapiens
YTDLEVRV

SEQ ID NO: 145507 - protein, 8 aa, Homo Sapiens
YTDLLRLL

SEQ ID NO: 145508 - protein, 8 aa, Homo Sapiens
YTDNLVRV

SEQ ID NO: 145509 - protein, 8 aa, Homo Sapiens
YTDRVFFL

SEQ ID NO: 145510 - protein, 8 aa, Homo Sapiens
YVDDTQFL

SEQ ID NO: 145511 - protein, 8 aa, Homo Sapiens
YVDDTQFV

SEQ ID NO: 145512 - protein, 8 aa, Homo Sapiens
YVDFPQHL

SEQ ID NO: 145513 - protein, 8 aa, Homo Sapiens
YVDGRVLV

SEQ ID NO: 145514 - protein, 9 aa, Homo Sapiens
AADEPVTVL

SEQ ID NO: 145515 - protein, 9 aa, Homo Sapiens
AADFEIGHF

SEQ ID NO: 145516 - protein, 9 aa, Homo Sapiens
AADHWAWLL

SEQ ID NO: 145517 - protein, 9 aa, Homo Sapiens
AADLLVVHL

SEQ ID NO: 145518 - protein, 9 aa, Homo Sapiens
AADLPARGF

SEQ ID NO: 145519 - protein, 9 aa, Homo Sapiens
AADLSEIEI

SEQ ID NO: 145520 - protein, 9 aa, Homo Sapiens
AADPLASKL

SEQ ID NO: 145521 - protein, 9 aa, Homo Sapiens
AADPRVACL

SEQ ID NO: 145522 - protein, 9 aa, Homo Sapiens
AADPSVVNL

SEQ ID NO: 145523 - protein, 9 aa, Homo Sapiens
AADPVSPLL

SEQ ID NO: 145524 - protein, 9 aa, Homo Sapiens
AADSAVRLW

SEQ ID NO: 145525 - protein, 9 aa, Homo Sapiens
AADTLVTKF

SEQ ID NO: 145526 - protein, 9 aa, Homo Sapiens
AADTVVIFD

SEQ ID NO: 145527 - protein, 9 aa, Homo Sapiens
AAEFVPSFL

SEQ ID NO: 145528 - protein, 9 aa, Homo Sapiens
AAEYPAVKF

SEQ ID NO: 145529 - protein, 9 aa, Homo Sapiens
AAPDDLALL

SEQ ID NO: 145530 - protein, 9 aa, Homo Sapiens
AFADSSYLL

SEQ ID NO: 145531 - protein, 9 aa, Homo Sapiens
AFDCMKNYL

SEQ ID NO: 145532 - protein, 9 aa, Homo Sapiens
AFDDAIAEL

SEQ ID NO: 145533 - protein, 9 aa, Homo Sapiens
AFDEAIAEL

SEQ ID NO: 145534 - protein, 9 aa, Homo Sapiens
AFDLIEHYF

SEQ ID NO: 145535 - protein, 9 aa, Homo Sapiens
AFDLSQVLF

SEQ ID NO: 145536 - protein, 9 aa, Homo Sapiens
AFDLTEQRY

SEQ ID NO: 145537 - protein, 9 aa, Homo Sapiens
AFDLTKTNM

SEQ ID NO: 145538 - protein, 9 aa, Homo Sapiens
AFDNVLNYI

SEQ ID NO: 145539 - protein, 9 aa, Homo Sapiens
AFDPAAAAF

SEQ ID NO: 145540 - protein, 9 aa, Homo Sapiens
AFDPTSTLL

SEQ ID NO: 145541 - protein, 9 aa, Homo Sapiens
AFDPVLNRW

SEQ ID NO: 145542 - protein, 9 aa, Homo Sapiens
AFDVHLNAF

SEQ ID NO: 145543 - protein, 9 aa, Homo Sapiens
AFDVVERSF

SEQ ID NO: 145544 - protein, 9 aa, Homo Sapiens
AIDSPVSFL

SEQ ID NO: 145545 - protein, 9 aa, Homo Sapiens
AIPAFISLL

SEQ ID NO: 145546 - protein, 9 aa, Homo Sapiens
ASDIPGLHL

SEQ ID NO: 145547 - protein, 9 aa, Homo Sapiens
ASDPYQVHV

SEQ ID NO: 145548 - protein, 9 aa, Homo Sapiens
ATDEFASYF

SEQ ID NO: 145549 - protein, 9 aa, Homo Sapiens
ATDLRPIYI

SEQ ID NO: 145550 - protein, 9 aa, Homo Sapiens
ATDPFASVF

SEQ ID NO: 145551 - protein, 9 aa, Homo Sapiens
ATDPGRLLL

SEQ ID NO: 145552 - protein, 9 aa, Homo Sapiens
ATDPNILSL

SEQ ID NO: 145553 - protein, 9 aa, Homo Sapiens
ATDVRRVWL

SEQ ID NO: 145554 - protein, 9 aa, Homo Sapiens
ATDVWAVYF

SEQ ID NO: 145555 - protein, 9 aa, Homo Sapiens
AVDAVIAEL

SEQ ID NO: 145556 - protein, 9 aa, Homo Sapiens
AVDFESNNI

SEQ ID NO: 145557 - protein, 9 aa, Homo Sapiens
AVEEYVYEF

SEQ ID NO: 145558 - protein, 9 aa, Homo Sapiens
AVPEVAVYL

SEQ ID NO: 145559 - protein, 9 aa, Homo Sapiens
AYDASLAML

SEQ ID NO: 145560 - protein, 9 aa, Homo Sapiens
CADPRVPWV

SEQ ID NO: 145561 - protein, 9 aa, Homo Sapiens
CSDFVVVQF

SEQ ID NO: 145562 - protein, 9 aa, Homo Sapiens
CSDGKVLLF

SEQ ID NO: 145563 - protein, 9 aa, Homo Sapiens
DFDVAVVTF

SEQ ID NO: 145564 - protein, 9 aa, Homo Sapiens
DLPNGRVCP

SEQ ID NO: 145565 - protein, 9 aa, Homo Sapiens
ETDPGMVHL

SEQ ID NO: 145566 - protein, 9 aa, Homo Sapiens
FADAASLLL

SEQ ID NO: 145567 - protein, 9 aa, Homo Sapiens
FADAGLVCI

SEQ ID NO: 145568 - protein, 9 aa, Homo Sapiens
FADAVQELL

SEQ ID NO: 145569 - protein, 9 aa, Homo Sapiens
FADELSHLL

SEQ ID NO: 145570 - protein, 9 aa, Homo Sapiens
FADFEKIFV

SEQ ID NO: 145571 - protein, 9 aa, Homo Sapiens
FADFLQAHL

SEQ ID NO: 145572 - protein, 9 aa, Homo Sapiens
FADFLVYEF

SEQ ID NO: 145573 - protein, 9 aa, Homo Sapiens
FADGHVLEL

SEQ ID NO: 145574 - protein, 9 aa, Homo Sapiens
FADGKVYAL

SEQ ID NO: 145575 - protein, 9 aa, Homo Sapiens
FADGVILLL

SEQ ID NO: 145576 - protein, 9 aa, Homo Sapiens
FADHVSSSL

SEQ ID NO: 145577 - protein, 9 aa, Homo Sapiens
FADIALAPM

SEQ ID NO: 145578 - protein, 9 aa, Homo Sapiens
FADLNLAEF

SEQ ID NO: 145579 - protein, 9 aa, Homo Sapiens
FADNDVSRF

SEQ ID NO: 145580 - protein, 9 aa, Homo Sapiens
FADQAEILL

SEQ ID NO: 145581 - protein, 9 aa, Homo Sapiens
FADREVQLL

SEQ ID NO: 145582 - protein, 9 aa, Homo Sapiens
FADVAPLQL

SEQ ID NO: 145583 - protein, 9 aa, Homo Sapiens
FADYPCHTV

SEQ ID NO: 145584 - protein, 9 aa, Homo Sapiens
FADYRPTEV

SEQ ID NO: 145585 - protein, 9 aa, Homo Sapiens
FAIPLIEKL

SEQ ID NO: 145586 - protein, 9 aa, Homo Sapiens
FALPYVDHF

SEQ ID NO: 145587 - protein, 9 aa, Homo Sapiens
FAPEDPCFF

SEQ ID NO: 145588 - protein, 9 aa, Homo Sapiens
FEDEKPALL

SEQ ID NO: 145589 - protein, 9 aa, Homo Sapiens
FFDAIFTQL

SEQ ID NO: 145590 - protein, 9 aa, Homo Sapiens
FFDAQEVLL

SEQ ID NO: 145591 - protein, 9 aa, Homo Sapiens
FFDDCIEKL

SEQ ID NO: 145592 - protein, 9 aa, Homo Sapiens
FFDEKLNSL

SEQ ID NO: 145593 - protein, 9 aa, Homo Sapiens
FFDEVVKQM

SEQ ID NO: 145594 - protein, 9 aa, Homo Sapiens
FFDNISSEL

SEQ ID NO: 145595 - protein, 9 aa, Homo Sapiens
FFDPHQSTF

SEQ ID NO: 145596 - protein, 9 aa, Homo Sapiens
FFDPSLLHL

SEQ ID NO: 145597 - protein, 9 aa, Homo Sapiens
FFDSVQVVF

SEQ ID NO: 145598 - protein, 9 aa, Homo Sapiens
FFDTNTSVL

SEQ ID NO: 145599 - protein, 9 aa, Homo Sapiens
FFDVTYRHF

SEQ ID NO: 145600 - protein, 9 aa, Homo Sapiens
FFGTHETAF

SEQ ID NO: 145601 - protein, 9 aa, Homo Sapiens
FIDEAGHCM

SEQ ID NO: 145602 - protein, 9 aa, Homo Sapiens
FIDGGGSVL

SEQ ID NO: 145603 - protein, 9 aa, Homo Sapiens
FIDKPVCFV

SEQ ID NO: 145604 - protein, 9 aa, Homo Sapiens
FIEEGIVVM

SEQ ID NO: 145605 - protein, 9 aa, Homo Sapiens
FIEEHATKL

SEQ ID NO: 145606 - protein, 9 aa, Homo Sapiens
FIEEKTLLL

SEQ ID NO: 145607 - protein, 9 aa, Homo Sapiens
FIISRTQAL

SEQ ID NO: 145608 - protein, 9 aa, Homo Sapiens
FIPDQPFRV

SEQ ID NO: 145609 - protein, 9 aa, Homo Sapiens
FIPGRPMLL

SEQ ID NO: 145610 - protein, 9 aa, Homo Sapiens
FIPPYVPRF

SEQ ID NO: 145611 - protein, 9 aa, Homo Sapiens
FIPSPPSFL

SEQ ID NO: 145612 - protein, 9 aa, Homo Sapiens
FLDALIVSM

SEQ ID NO: 145613 - protein, 9 aa, Homo Sapiens
FLDEPTNHL

SEQ ID NO: 145614 - protein, 9 aa, Homo Sapiens
FLDLTEQEF

SEQ ID NO: 145615 - protein, 9 aa, Homo Sapiens
FLERLPMML

SEQ ID NO: 145616 - protein, 9 aa, Homo Sapiens
FLPEAPAEL

SEQ ID NO: 145617 - protein, 9 aa, Homo Sapiens
FLPPFPAHL

SEQ ID NO: 145618 - protein, 9 aa, Homo Sapiens
FLPQKIIYL

SEQ ID NO: 145619 - protein, 9 aa, Homo Sapiens
FQDPSVTQL

SEQ ID NO: 145620 - protein, 9 aa, Homo Sapiens
FSDCHVAWV

SEQ ID NO: 145621 - protein, 9 aa, Homo Sapiens
FSDEWVACL

SEQ ID NO: 145622 - protein, 9 aa, Homo Sapiens
FSDFLLTKL

SEQ ID NO: 145623 - protein, 9 aa, Homo Sapiens
FSDTGNFGF

SEQ ID NO: 145624 - protein, 9 aa, Homo Sapiens
FSEEHPVLL

SEQ ID NO: 145625 - protein, 9 aa, Homo Sapiens
FSEETPVVL

SEQ ID NO: 145626 - protein, 9 aa, Homo Sapiens
FSPFHASVL

SEQ ID NO: 145627 - protein, 9 aa, Homo Sapiens
FTADPLSLL

SEQ ID NO: 145628 - protein, 9 aa, Homo Sapiens
FTDAVVSWL

SEQ ID NO: 145629 - protein, 9 aa, Homo Sapiens
FTDEESRVF

SEQ ID NO: 145630 - protein, 9 aa, Homo Sapiens
FTDERIFML

SEQ ID NO: 145631 - protein, 9 aa, Homo Sapiens
FTDFKVVNV

SEQ ID NO: 145632 - protein, 9 aa, Homo Sapiens
FTDFLIPML

SEQ ID NO: 145633 - protein, 9 aa, Homo Sapiens
FTDGITNKL

SEQ ID NO: 145634 - protein, 9 aa, Homo Sapiens
FTDIGKVDF

SEQ ID NO: 145635 - protein, 9 aa, Homo Sapiens
FTDKRIGYL

SEQ ID NO: 145636 - protein, 9 aa, Homo Sapiens
FTDKRVGYL

SEQ ID NO: 145637 - protein, 9 aa, Homo Sapiens
FTDMFIYWI

SEQ ID NO: 145638 - protein, 9 aa, Homo Sapiens
FTDNVPALV

SEQ ID NO: 145639 - protein, 9 aa, Homo Sapiens
FTDSLISNL

SEQ ID NO: 145640 - protein, 9 aa, Homo Sapiens
FTDTSIILF

SEQ ID NO: 145641 - protein, 9 aa, Homo Sapiens
FTDTVGNIL

SEQ ID NO: 145642 - protein, 9 aa, Homo Sapiens
FTDVIGHYI

SEQ ID NO: 145643 - protein, 9 aa, Homo Sapiens
FTDVNKIYL

SEQ ID NO: 145644 - protein, 9 aa, Homo Sapiens
FTDVVTTNL

SEQ ID NO: 145645 - protein, 9 aa, Homo Sapiens
FTDYDVIHL

SEQ ID NO: 145646 - protein, 9 aa, Homo Sapiens
FTEDHYVEF

SEQ ID NO: 145647 - protein, 9 aa, Homo Sapiens
FTEEIPLKI

SEQ ID NO: 145648 - protein, 9 aa, Homo Sapiens
FTEFYTTLL

SEQ ID NO: 145649 - protein, 9 aa, Homo Sapiens
FTETSIILF

SEQ ID NO: 145650 - protein, 9 aa, Homo Sapiens
FTPDIPTML

SEQ ID NO: 145651 - protein, 9 aa, Homo Sapiens
FVDDYTVRV

SEQ ID NO: 145652 - protein, 9 aa, Homo Sapiens
FVDEFLTYL

SEQ ID NO: 145653 - protein, 9 aa, Homo Sapiens
FVDIVKVLL

SEQ ID NO: 145654 - protein, 9 aa, Homo Sapiens
FVDLEPTVI

SEQ ID NO: 145655 - protein, 9 aa, Homo Sapiens
FVDLSGHNL

SEQ ID NO: 145656 - protein, 9 aa, Homo Sapiens
FVDPAQITM

SEQ ID NO: 145657 - protein, 9 aa, Homo Sapiens
FVDTNLYFL

SEQ ID NO: 145658 - protein, 9 aa, Homo Sapiens
FVDWCPTGF

SEQ ID NO: 145659 - protein, 9 aa, Homo Sapiens
FVEEEEHFL

SEQ ID NO: 145660 - protein, 9 aa, Homo Sapiens
FVEETVYLL

SEQ ID NO: 145661 - protein, 9 aa, Homo Sapiens
FVEGLIVTL

SEQ ID NO: 145662 - protein, 9 aa, Homo Sapiens
FVEGRSVEF

SEQ ID NO: 145663 - protein, 9 aa, Homo Sapiens
FVEPFVILL

SEQ ID NO: 145664 - protein, 9 aa, Homo Sapiens
FWDGKIVLV

SEQ ID NO: 145665 - protein, 9 aa, Homo Sapiens
FWPPYVELL

SEQ ID NO: 145666 - protein, 9 aa, Homo Sapiens
FYDERIVVV

SEQ ID NO: 145667 - protein, 9 aa, Homo Sapiens
GADNSVVRF

SEQ ID NO: 145668 - protein, 9 aa, Homo Sapiens
GDLPNGRVC

SEQ ID NO: 145669 - protein, 9 aa, Homo Sapiens
GLVEGAKNI

SEQ ID NO: 145670 - protein, 9 aa, Homo Sapiens
GSDEPPVFL

SEQ ID NO: 145671 - protein, 9 aa, Homo Sapiens
GSDPRVTQL

SEQ ID NO: 145672 - protein, 9 aa, Homo Sapiens
HADILLINL

SEQ ID NO: 145673 - protein, 9 aa, Homo Sapiens
HADVGVALL

SEQ ID NO: 145674 - protein, 9 aa, Homo Sapiens
HFDDFVTNL

SEQ ID NO: 145675 - protein, 9 aa, Homo Sapiens
HFDDTVVCL

SEQ ID NO: 145676 - protein, 9 aa, Homo Sapiens
HFDFQGCNF

SEQ ID NO: 145677 - protein, 9 aa, Homo Sapiens
HFDGFVVEV

SEQ ID NO: 145678 - protein, 9 aa, Homo Sapiens
HFDIVIRNL

SEQ ID NO: 145679 - protein, 9 aa, Homo Sapiens
HFDLNLRQF

SEQ ID NO: 145680 - protein, 9 aa, Homo Sapiens
HFDLSVIEL

SEQ ID NO: 145681 - protein, 9 aa, Homo Sapiens
HFDPEVVQI

SEQ ID NO: 145682 - protein, 9 aa, Homo Sapiens
HFDYQSLLM

SEQ ID NO: 145683 - protein, 9 aa, Homo Sapiens
HIIAGAGEL

SEQ ID NO: 145684 - protein, 9 aa, Homo Sapiens
HIPDVITYL

SEQ ID NO: 145685 - protein, 9 aa, Homo Sapiens
HLDPGPIYM

SEQ ID NO: 145686 - protein, 9 aa, Homo Sapiens
HTDLPVSVF

SEQ ID NO: 145687 - protein, 9 aa, Homo Sapiens
HVPEHAVVL

SEQ ID NO: 145688 - protein, 9 aa, Homo Sapiens
HYDEQQNFF

SEQ ID NO: 145689 - protein, 9 aa, Homo Sapiens
HYDPATEEF

SEQ ID NO: 145690 - protein, 9 aa, Homo Sapiens
HYDVQSILF

SEQ ID NO: 145691 - protein, 9 aa, Homo Sapiens
IADGGFTEL

SEQ ID NO: 145692 - protein, 9 aa, Homo Sapiens
IADGLPVAV

SEQ ID NO: 145693 - protein, 9 aa, Homo Sapiens
IADIHPIQV

SEQ ID NO: 145694 - protein, 9 aa, Homo Sapiens
IADIIRTCL

SEQ ID NO: 145695 - protein, 9 aa, Homo Sapiens
IADIVTSVF

SEQ ID NO: 145696 - protein, 9 aa, Homo Sapiens
IADLAHLLL

SEQ ID NO: 145697 - protein, 9 aa, Homo Sapiens
IADLGLIRV

SEQ ID NO: 145698 - protein, 9 aa, Homo Sapiens
IADLISSFL

SEQ ID NO: 145699 - protein, 9 aa, Homo Sapiens
IADLMEEKF

SEQ ID NO: 145700 - protein, 9 aa, Homo Sapiens
IADLPSTQL

SEQ ID NO: 145701 - protein, 9 aa, Homo Sapiens
IADLVTSVL

SEQ ID NO: 145702 - protein, 9 aa, Homo Sapiens
IADLVVAVF

SEQ ID NO: 145703 - protein, 9 aa, Homo Sapiens
IADPIVLAL

SEQ ID NO: 145704 - protein, 9 aa, Homo Sapiens
IADPNIAKL

SEQ ID NO: 145705 - protein, 9 aa, Homo Sapiens
IADRLNVEF

SEQ ID NO: 145706 - protein, 9 aa, Homo Sapiens
IADSNPMVV

SEQ ID NO: 145707 - protein, 9 aa, Homo Sapiens
IADTVPKYL

SEQ ID NO: 145708 - protein, 9 aa, Homo Sapiens
IFDEFRTVL

SEQ ID NO: 145709 - protein, 9 aa, Homo Sapiens
IFDGNVAHI

SEQ ID NO: 145710 - protein, 9 aa, Homo Sapiens
IFDLGGGTF

SEQ ID NO: 145711 - protein, 9 aa, Homo Sapiens
IFDLSCMGF

SEQ ID NO: 145712 - protein, 9 aa, Homo Sapiens
IFDNTFSRF

SEQ ID NO: 145713 - protein, 9 aa, Homo Sapiens
IFDPTRECM

SEQ ID NO: 145714 - protein, 9 aa, Homo Sapiens
IFDPVKQQF

SEQ ID NO: 145715 - protein, 9 aa, Homo Sapiens
IFDQSGTYL

SEQ ID NO: 145716 - protein, 9 aa, Homo Sapiens
IFDRVLTEL

SEQ ID NO: 145717 - protein, 9 aa, Homo Sapiens
IFDSKVTEI

SEQ ID NO: 145718 - protein, 9 aa, Homo Sapiens
IFDVHVHEV

SEQ ID NO: 145719 - protein, 9 aa, Homo Sapiens
IFDVLPNFF

SEQ ID NO: 145720 - protein, 9 aa, Homo Sapiens
IIDDALVRL

SEQ ID NO: 145721 - protein, 9 aa, Homo Sapiens
IIDDLPCRF

SEQ ID NO: 145722 - protein, 9 aa, Homo Sapiens
IIDEFIYQF

SEQ ID NO: 145723 - protein, 9 aa, Homo Sapiens
IIDEQPLIF

SEQ ID NO: 145724 - protein, 9 aa, Homo Sapiens
IIDEVVNKF

SEQ ID NO: 145725 - protein, 9 aa, Homo Sapiens
IIDKEVSLM

SEQ ID NO: 145726 - protein, 9 aa, Homo Sapiens
IIEEEFVSL

SEQ ID NO: 145727 - protein, 9 aa, Homo Sapiens
IIEEHPPMI

SEQ ID NO: 145728 - protein, 9 aa, Homo Sapiens
IIPPEPSYL

SEQ ID NO: 145729 - protein, 9 aa, Homo Sapiens
ILDPHVVLL

SEQ ID NO: 145730 - protein, 9 aa, Homo Sapiens
ILPTAPMLV

SEQ ID NO: 145731 - protein, 9 aa, Homo Sapiens
IQPDNIVYV

SEQ ID NO: 145732 - protein, 9 aa, Homo Sapiens
ISDEGIAYL

SEQ ID NO: 145733 - protein, 9 aa, Homo Sapiens
ISDHYPVEV

SEQ ID NO: 145734 - protein, 9 aa, Homo Sapiens
ISDLDTIWL

SEQ ID NO: 145735 - protein, 9 aa, Homo Sapiens
ISPEFFTVL

SEQ ID NO: 145736 - protein, 9 aa, Homo Sapiens
ITDEGLITI

SEQ ID NO: 145737 - protein, 9 aa, Homo Sapiens
ITDGVITDL

SEQ ID NO: 145738 - protein, 9 aa, Homo Sapiens
ITDHLIAML

SEQ ID NO: 145739 - protein, 9 aa, Homo Sapiens
ITDILVTEF

SEQ ID NO: 145740 - protein, 9 aa, Homo Sapiens
ITDKEVIYI

SEQ ID NO: 145741 - protein, 9 aa, Homo Sapiens
ITDKGIIAL

SEQ ID NO: 145742 - protein, 9 aa, Homo Sapiens
ITDLPSEVL

SEQ ID NO: 145743 - protein, 9 aa, Homo Sapiens
ITDPDVVHI

SEQ ID NO: 145744 - protein, 9 aa, Homo Sapiens
ITDPEVVFV

SEQ ID NO: 145745 - protein, 9 aa, Homo Sapiens
ITDPQQLQL

SEQ ID NO: 145746 - protein, 9 aa, Homo Sapiens
ITDPRTVFV

SEQ ID NO: 145747 - protein, 9 aa, Homo Sapiens
ITDPSVIVM

SEQ ID NO: 145748 - protein, 9 aa, Homo Sapiens
ITDQYIYMV

SEQ ID NO: 145749 - protein, 9 aa, Homo Sapiens
ITDVQLAIF

SEQ ID NO: 145750 - protein, 9 aa, Homo Sapiens
ITENFPLKL

SEQ ID NO: 145751 - protein, 9 aa, Homo Sapiens
IVDDFGTHL

SEQ ID NO: 145752 - protein, 9 aa, Homo Sapiens
IVDDHTPWV

SEQ ID NO: 145753 - protein, 9 aa, Homo Sapiens
IVDEAIYYF

SEQ ID NO: 145754 - protein, 9 aa, Homo Sapiens
IVDEVNGLI

SEQ ID NO: 145755 - protein, 9 aa, Homo Sapiens
IVDGAVVKF

SEQ ID NO: 145756 - protein, 9 aa, Homo Sapiens
IVDGRVYYI

SEQ ID NO: 145757 - protein, 9 aa, Homo Sapiens
IVDIPGTSV

SEQ ID NO: 145758 - protein, 9 aa, Homo Sapiens
IVDRPVTLV

SEQ ID NO: 145759 - protein, 9 aa, Homo Sapiens
IVDTPEVVL

SEQ ID NO: 145760 - protein, 9 aa, Homo Sapiens
IVDVRPTLV

SEQ ID NO: 145761 - protein, 9 aa, Homo Sapiens
IVENLLMIL

SEQ ID NO: 145762 - protein, 9 aa, Homo Sapiens
IVPKKPPLL

SEQ ID NO: 145763 - protein, 9 aa, Homo Sapiens
IVPVSPAEV

SEQ ID NO: 145764 - protein, 9 aa, Homo Sapiens
IWDETPLYF

SEQ ID NO: 145765 - protein, 9 aa, Homo Sapiens
IWDPVLSVM

SEQ ID NO: 145766 - protein, 9 aa, Homo Sapiens
IYDFIGEFM

SEQ ID NO: 145767 - protein, 9 aa, Homo Sapiens
IYDLATQTL

SEQ ID NO: 145768 - protein, 9 aa, Homo Sapiens
IYDLVDRHL

SEQ ID NO: 145769 - protein, 9 aa, Homo Sapiens
IYDSVKVYF

SEQ ID NO: 145770 - protein, 9 aa, Homo Sapiens
KADEKIIFL

SEQ ID NO: 145771 - protein, 9 aa, Homo Sapiens
KADGVPVYL

SEQ ID NO: 145772 - protein, 9 aa, Homo Sapiens
KADSVVVLL

SEQ ID NO: 145773 - protein, 9 aa, Homo Sapiens
KADVVISAF

SEQ ID NO: 145774 - protein, 9 aa, Homo Sapiens
KADVVPVTL

SEQ ID NO: 145775 - protein, 9 aa, Homo Sapiens
KFDDIRIYF

SEQ ID NO: 145776 - protein, 9 aa, Homo Sapiens
KFDFPVSYL

SEQ ID NO: 145777 - protein, 9 aa, Homo Sapiens
KIDDKPVKI

SEQ ID NO: 145778 - protein, 9 aa, Homo Sapiens
KSDPLCVLL

SEQ ID NO: 145779 - protein, 9 aa, Homo Sapiens
KSDPSIVLL

SEQ ID NO: 145780 - protein, 9 aa, Homo Sapiens
KSDPSIVRL

SEQ ID NO: 145781 - protein, 9 aa, Homo Sapiens
KTDAVTVLL

SEQ ID NO: 145782 - protein, 9 aa, Homo Sapiens
KTDDLITRF

SEQ ID NO: 145783 - protein, 9 aa, Homo Sapiens
KTDIIDHSF

SEQ ID NO: 145784 - protein, 9 aa, Homo Sapiens
KTDKTLVLL

SEQ ID NO: 145785 - protein, 9 aa, Homo Sapiens
KTDQFPLFL

SEQ ID NO: 145786 - protein, 9 aa, Homo Sapiens
KTDQLVSFL

SEQ ID NO: 145787 - protein, 9 aa, Homo Sapiens
KTDVTVVRF

SEQ ID NO: 145788 - protein, 9 aa, Homo Sapiens
LADAINTEF

SEQ ID NO: 145789 - protein, 9 aa, Homo Sapiens
LADAVAVTM

SEQ ID NO: 145790 - protein, 9 aa, Homo Sapiens
LADEAEVHL

SEQ ID NO: 145791 - protein, 9 aa, Homo Sapiens
LADERVLWL

SEQ ID NO: 145792 - protein, 9 aa, Homo Sapiens
LADEVITVF

SEQ ID NO: 145793 - protein, 9 aa, Homo Sapiens
LADFEAGLL

SEQ ID NO: 145794 - protein, 9 aa, Homo Sapiens
LADGLKVVL

SEQ ID NO: 145795 - protein, 9 aa, Homo Sapiens
LADGSIAVL

SEQ ID NO: 145796 - protein, 9 aa, Homo Sapiens
LADIIATGF

SEQ ID NO: 145797 - protein, 9 aa, Homo Sapiens
LADIVATGF

SEQ ID NO: 145798 - protein, 9 aa, Homo Sapiens
LADLHPDVF

SEQ ID NO: 145799 - protein, 9 aa, Homo Sapiens
LADLQLEYL

SEQ ID NO: 145800 - protein, 9 aa, Homo Sapiens
LADNDEVKF

SEQ ID NO: 145801 - protein, 9 aa, Homo Sapiens
LADNVPVTV

SEQ ID NO: 145802 - protein, 9 aa, Homo Sapiens
LADPAVTDF

SEQ ID NO: 145803 - protein, 9 aa, Homo Sapiens
LADPGIITI

SEQ ID NO: 145804 - protein, 9 aa, Homo Sapiens
LADPGPVNF

SEQ ID NO: 145805 - protein, 9 aa, Homo Sapiens
LADQGEIRV

SEQ ID NO: 145806 - protein, 9 aa, Homo Sapiens
LADRNVTVL

SEQ ID NO: 145807 - protein, 9 aa, Homo Sapiens
LADSKEIFL

SEQ ID NO: 145808 - protein, 9 aa, Homo Sapiens
LADTQPAVL

SEQ ID NO: 145809 - protein, 9 aa, Homo Sapiens
LALAFFAII

SEQ ID NO: 145810 - protein, 9 aa, Homo Sapiens
LAPNIISQL

SEQ ID NO: 145811 - protein, 9 aa, Homo Sapiens
LDEVAMGEM

SEQ ID NO: 145812 - protein, 9 aa, Homo Sapiens
LDTLVPAKF

SEQ ID NO: 145813 - protein, 9 aa, Homo Sapiens
LFDGSPTYV

SEQ ID NO: 145814 - protein, 9 aa, Homo Sapiens
LFDITGQDF

SEQ ID NO: 145815 - protein, 9 aa, Homo Sapiens
LFDLVCHEF

SEQ ID NO: 145816 - protein, 9 aa, Homo Sapiens
LFDPMTGTF

SEQ ID NO: 145817 - protein, 9 aa, Homo Sapiens
LFDVQILNY

SEQ ID NO: 145818 - protein, 9 aa, Homo Sapiens
LIDEPSAYL

SEQ ID NO: 145819 - protein, 9 aa, Homo Sapiens
LIDLPGTEL

SEQ ID NO: 145820 - protein, 9 aa, Homo Sapiens
LIDQQVVYI

SEQ ID NO: 145821 - protein, 9 aa, Homo Sapiens
LIPDDLSLL

SEQ ID NO: 145822 - protein, 9 aa, Homo Sapiens
LLDGGVINL

SEQ ID NO: 145823 - protein, 9 aa, Homo Sapiens
LLPDIISRL

SEQ ID NO: 145824 - protein, 9 aa, Homo Sapiens
LLPERPSYL

SEQ ID NO: 145825 - protein, 9 aa, Homo Sapiens
LRDEFLVKI

SEQ ID NO: 145826 - protein, 9 aa, Homo Sapiens
LSDEEIVKF

SEQ ID NO: 145827 - protein, 9 aa, Homo Sapiens
LSDGVVVQV

SEQ ID NO: 145828 - protein, 9 aa, Homo Sapiens
LSVMEEVLI

SEQ ID NO: 145829 - protein, 9 aa, Homo Sapiens
LTDDGRVFL

SEQ ID NO: 145830 - protein, 9 aa, Homo Sapiens
LTDEDVVRL

SEQ ID NO: 145831 - protein, 9 aa, Homo Sapiens
LTDEGVVAL

SEQ ID NO: 145832 - protein, 9 aa, Homo Sapiens
LTDHTVTFL

SEQ ID NO: 145833 - protein, 9 aa, Homo Sapiens
LTDPAIVKV

SEQ ID NO: 145834 - protein, 9 aa, Homo Sapiens
LTDPDIHVL

SEQ ID NO: 145835 - protein, 9 aa, Homo Sapiens
LTDPRLLYI

SEQ ID NO: 145836 - protein, 9 aa, Homo Sapiens
LTDQTPVLL

SEQ ID NO: 145837 - protein, 9 aa, Homo Sapiens
LTEALPVKL

SEQ ID NO: 145838 - protein, 9 aa, Homo Sapiens
LTEEGVIKV

SEQ ID NO: 145839 - protein, 9 aa, Homo Sapiens
LTEFGVIHL

SEQ ID NO: 145840 - protein, 9 aa, Homo Sapiens
LTEQRIVFF

SEQ ID NO: 145841 - protein, 9 aa, Homo Sapiens
LVDLEPGTM

SEQ ID NO: 145842 - protein, 9 aa, Homo Sapiens
LVEIVGCHF

SEQ ID NO: 145843 - protein, 9 aa, Homo Sapiens
LYDLVTEKM

SEQ ID NO: 145844 - protein, 9 aa, Homo Sapiens
LYDPCTVMF

SEQ ID NO: 145845 - protein, 9 aa, Homo Sapiens
LYDPVISKL

SEQ ID NO: 145846 - protein, 9 aa, Homo Sapiens
LYDVVDVKY

SEQ ID NO: 145847 - protein, 9 aa, Homo Sapiens
MADAGILRL

SEQ ID NO: 145848 - protein, 9 aa, Homo Sapiens
MADIPGHVF

SEQ ID NO: 145849 - protein, 9 aa, Homo Sapiens
MADTFLEHM

SEQ ID NO: 145850 - protein, 9 aa, Homo Sapiens
MFDIVGTHL

SEQ ID NO: 145851 - protein, 9 aa, Homo Sapiens
MIPTLPSIL

SEQ ID NO: 145852 - protein, 9 aa, Homo Sapiens
MLDPLEVHL

SEQ ID NO: 145853 - protein, 9 aa, Homo Sapiens
MTDDKITEV

SEQ ID NO: 145854 - protein, 9 aa, Homo Sapiens
MTDPEMVEV

SEQ ID NO: 145855 - protein, 9 aa, Homo Sapiens
MTDPIRILV

SEQ ID NO: 145856 - protein, 9 aa, Homo Sapiens
MTDVVAAFL

SEQ ID NO: 145857 - protein, 9 aa, Homo Sapiens
MVDGKPVNL

SEQ ID NO: 145858 - protein, 9 aa, Homo Sapiens
MVDSKPVNL

SEQ ID NO: 145859 - protein, 9 aa, Homo Sapiens
NADAIVVKL

SEQ ID NO: 145860 - protein, 9 aa, Homo Sapiens
NADGKIISL

SEQ ID NO: 145861 - protein, 9 aa, Homo Sapiens
NADIAVVEM

SEQ ID NO: 145862 - protein, 9 aa, Homo Sapiens
NADKLTVKF

SEQ ID NO: 145863 - protein, 9 aa, Homo Sapiens
NADPILISL

SEQ ID NO: 145864 - protein, 9 aa, Homo Sapiens
NADPLEVML

SEQ ID NO: 145865 - protein, 9 aa, Homo Sapiens
NADPLGVLI

SEQ ID NO: 145866 - protein, 9 aa, Homo Sapiens
NADPQAVTM

SEQ ID NO: 145867 - protein, 9 aa, Homo Sapiens
NADVALVNF

SEQ ID NO: 145868 - protein, 9 aa, Homo Sapiens
NAYTGIVLL

SEQ ID NO: 145869 - protein, 9 aa, Homo Sapiens
NFDDIKNGL

SEQ ID NO: 145870 - protein, 9 aa, Homo Sapiens
NFDFTRSYL

SEQ ID NO: 145871 - protein, 9 aa, Homo Sapiens
NFDLTKNYL

SEQ ID NO: 145872 - protein, 9 aa, Homo Sapiens
NFDNILNSF

SEQ ID NO: 145873 - protein, 9 aa, Homo Sapiens
NFDTIDQQF

SEQ ID NO: 145874 - protein, 9 aa, Homo Sapiens
NIDIDPVYL

SEQ ID NO: 145875 - protein, 9 aa, Homo Sapiens
NIDVVGVSF

SEQ ID NO: 145876 - protein, 9 aa, Homo Sapiens
NTDEPPMVF

SEQ ID NO: 145877 - protein, 9 aa, Homo Sapiens
NTDPECYWL

SEQ ID NO: 145878 - protein, 9 aa, Homo Sapiens
NVDAAVVLL

SEQ ID NO: 145879 - protein, 9 aa, Homo Sapiens
NVDSLITRL

SEQ ID NO: 145880 - protein, 9 aa, Homo Sapiens
NYDEALRLL

SEQ ID NO: 145881 - protein, 9 aa, Homo Sapiens
NYDFGPIHM

SEQ ID NO: 145882 - protein, 9 aa, Homo Sapiens
NYDLALKYF

SEQ ID NO: 145883 - protein, 9 aa, Homo Sapiens
PIRLLAAAA

SEQ ID NO: 145884 - protein, 9 aa, Homo Sapiens
PTSAVITTI

SEQ ID NO: 145885 - protein, 9 aa, Homo Sapiens
QADEVIAIL

SEQ ID NO: 145886 - protein, 9 aa, Homo Sapiens
QADGRVVLV

SEQ ID NO: 145887 - protein, 9 aa, Homo Sapiens
QIPEIKQTL

SEQ ID NO: 145888 - protein, 9 aa, Homo Sapiens
QKADIEEIK

SEQ ID NO: 145889 - protein, 9 aa, Homo Sapiens
QLDPLVVEL

SEQ ID NO: 145890 - protein, 9 aa, Homo Sapiens
QLPEQPLFL

SEQ ID NO: 145891 - protein, 9 aa, Homo Sapiens
QTDHTPVHL

SEQ ID NO: 145892 - protein, 9 aa, Homo Sapiens
QTDVGITHF

SEQ ID NO: 145893 - protein, 9 aa, Homo Sapiens
QWDLVENYL

SEQ ID NO: 145894 - protein, 9 aa, Homo Sapiens
RADAPVALV

SEQ ID NO: 145895 - protein, 9 aa, Homo Sapiens
RFDCAIVLL

SEQ ID NO: 145896 - protein, 9 aa, Homo Sapiens
RFDGRVVLV

SEQ ID NO: 145897 - protein, 9 aa, Homo Sapiens
RFDPLGHYL

SEQ ID NO: 145898 - protein, 9 aa, Homo Sapiens
RFDYTNSEF

SEQ ID NO: 145899 - protein, 9 aa, Homo Sapiens
RLPPTPLLL

SEQ ID NO: 145900 - protein, 9 aa, Homo Sapiens
RTDCSPIQF

SEQ ID NO: 145901 - protein, 9 aa, Homo Sapiens
RTDDKVIRF

SEQ ID NO: 145902 - protein, 9 aa, Homo Sapiens
RTDDTPVVL

SEQ ID NO: 145903 - protein, 9 aa, Homo Sapiens
RTDEIGVAF

SEQ ID NO: 145904 - protein, 9 aa, Homo Sapiens
RTDGKVFQF

SEQ ID NO: 145905 - protein, 9 aa, Homo Sapiens
RTDPIPIVV

SEQ ID NO: 145906 - protein, 9 aa, Homo Sapiens
RTDPVPVTI

SEQ ID NO: 145907 - protein, 9 aa, Homo Sapiens
RTDSEIALL

SEQ ID NO: 145908 - protein, 9 aa, Homo Sapiens
RTDVPGELL

SEQ ID NO: 145909 - protein, 9 aa, Homo Sapiens
RYDLGGLVM

SEQ ID NO: 145910 - protein, 9 aa, Homo Sapiens
SADDKTVRL

SEQ ID NO: 145911 - protein, 9 aa, Homo Sapiens
SADELVTRI

SEQ ID NO: 145912 - protein, 9 aa, Homo Sapiens
SADEPMTTF

SEQ ID NO: 145913 - protein, 9 aa, Homo Sapiens
SADEVQRFF

SEQ ID NO: 145914 - protein, 9 aa, Homo Sapiens
SADFETVRM

SEQ ID NO: 145915 - protein, 9 aa, Homo Sapiens
SADFPALVV

SEQ ID NO: 145916 - protein, 9 aa, Homo Sapiens
SADFSPAFL

SEQ ID NO: 145917 - protein, 9 aa, Homo Sapiens
SADHPVIKV

SEQ ID NO: 145918 - protein, 9 aa, Homo Sapiens
SADISLERL

SEQ ID NO: 145919 - protein, 9 aa, Homo Sapiens
SADKFQVLL

SEQ ID NO: 145920 - protein, 9 aa, Homo Sapiens
SADPEVMLL

SEQ ID NO: 145921 - protein, 9 aa, Homo Sapiens
SADPLGAWL

SEQ ID NO: 145922 - protein, 9 aa, Homo Sapiens
SADPNVVDL

SEQ ID NO: 145923 - protein, 9 aa, Homo Sapiens
SADPRHILL

SEQ ID NO: 145924 - protein, 9 aa, Homo Sapiens
SADRFVTLL

SEQ ID NO: 145925 - protein, 9 aa, Homo Sapiens
SADSKVLLF

SEQ ID NO: 145926 - protein, 9 aa, Homo Sapiens
SADSRIVKM

SEQ ID NO: 145927 - protein, 9 aa, Homo Sapiens
SADTVVIFD

SEQ ID NO: 145928 - protein, 9 aa, Homo Sapiens
SADVAAVVM

SEQ ID NO: 145929 - protein, 9 aa, Homo Sapiens
SADVKEVLL

SEQ ID NO: 145930 - protein, 9 aa, Homo Sapiens
SAPKYIDYL

SEQ ID NO: 145931 - protein, 9 aa, Homo Sapiens
SFDAHLTEL

SEQ ID NO: 145932 - protein, 9 aa, Homo Sapiens
SFDCIQQTF

SEQ ID NO: 145933 - protein, 9 aa, Homo Sapiens
SFDEIHQLF

SEQ ID NO: 145934 - protein, 9 aa, Homo Sapiens
SFDETCTRF

SEQ ID NO: 145935 - protein, 9 aa, Homo Sapiens
SFDETVTHF

SEQ ID NO: 145936 - protein, 9 aa, Homo Sapiens
SFDGIIAMM

SEQ ID NO: 145937 - protein, 9 aa, Homo Sapiens
SFDIQLTSV

SEQ ID NO: 145938 - protein, 9 aa, Homo Sapiens
SFDLAKVLL

SEQ ID NO: 145939 - protein, 9 aa, Homo Sapiens
SFDTGFTSF

SEQ ID NO: 145940 - protein, 9 aa, Homo Sapiens
SFDVADRMF

SEQ ID NO: 145941 - protein, 9 aa, Homo Sapiens
SFEEKPVYI

SEQ ID NO: 145942 - protein, 9 aa, Homo Sapiens
SIDDLPTVL

SEQ ID NO: 145943 - protein, 9 aa, Homo Sapiens
SIDRNPPQL

SEQ ID NO: 145944 - protein, 9 aa, Homo Sapiens
SIPDFPMHL

SEQ ID NO: 145945 - protein, 9 aa, Homo Sapiens
SIPERPAQL

SEQ ID NO: 145946 - protein, 9 aa, Homo Sapiens
SIPGGPVRL

SEQ ID NO: 145947 - protein, 9 aa, Homo Sapiens
SLPDIPAHL

SEQ ID NO: 145948 - protein, 9 aa, Homo Sapiens
SMDPLPVFL

SEQ ID NO: 145949 - protein, 9 aa, Homo Sapiens
SSDPKVLTL

SEQ ID NO: 145950 - protein, 9 aa, Homo Sapiens
STDDFFAGL

SEQ ID NO: 145951 - protein, 9 aa, Homo Sapiens
STDMDKVLL

SEQ ID NO: 145952 - protein, 9 aa, Homo Sapiens
STDNGRIFL

SEQ ID NO: 145953 - protein, 9 aa, Homo Sapiens
STDQVGEFF

SEQ ID NO: 145954 - protein, 9 aa, Homo Sapiens
STDVHIINL

SEQ ID NO: 145955 - protein, 9 aa, Homo Sapiens
STDYETHEF

SEQ ID NO: 145956 - protein, 9 aa, Homo Sapiens
SVDDHIVRF

SEQ ID NO: 145957 - protein, 9 aa, Homo Sapiens
SVEDAAILL

SEQ ID NO: 145958 - protein, 9 aa, Homo Sapiens
SVPDEIILL

SEQ ID NO: 145959 - protein, 9 aa, Homo Sapiens
SYDSKLVWF

SEQ ID NO: 145960 - protein, 9 aa, Homo Sapiens
TADAFIVRF

SEQ ID NO: 145961 - protein, 9 aa, Homo Sapiens
TADAIARKL

SEQ ID NO: 145962 - protein, 9 aa, Homo Sapiens
TADDFLVFL

SEQ ID NO: 145963 - protein, 9 aa, Homo Sapiens
TADDPSLSL

SEQ ID NO: 145964 - protein, 9 aa, Homo Sapiens
TADEVHYFL

SEQ ID NO: 145965 - protein, 9 aa, Homo Sapiens
TADGRVVKL

SEQ ID NO: 145966 - protein, 9 aa, Homo Sapiens
TADIGCVLV

SEQ ID NO: 145967 - protein, 9 aa, Homo Sapiens
TADISDVWL

SEQ ID NO: 145968 - protein, 9 aa, Homo Sapiens
TADIVINLL

SEQ ID NO: 145969 - protein, 9 aa, Homo Sapiens
TFDDIVHSF

SEQ ID NO: 145970 - protein, 9 aa, Homo Sapiens
TFDDVAVTF

SEQ ID NO: 145971 - protein, 9 aa, Homo Sapiens
TFDEVLELM

SEQ ID NO: 145972 - protein, 9 aa, Homo Sapiens
TFDFVHNVM

SEQ ID NO: 145973 - protein, 9 aa, Homo Sapiens
TFDLQRIGF

SEQ ID NO: 145974 - protein, 9 aa, Homo Sapiens
TFDLTVVSY

SEQ ID NO: 145975 - protein, 9 aa, Homo Sapiens
TFDNVTSYL

SEQ ID NO: 145976 - protein, 9 aa, Homo Sapiens
TIDCGLVRL

SEQ ID NO: 145977 - protein, 9 aa, Homo Sapiens
TIEDAIAVL

SEQ ID NO: 145978 - protein, 9 aa, Homo Sapiens
TIEDGIFEV

SEQ ID NO: 145979 - protein, 9 aa, Homo Sapiens
TIPITPAFL

SEQ ID NO: 145980 - protein, 9 aa, Homo Sapiens
TSDGRVIFF

SEQ ID NO: 145981 - protein, 9 aa, Homo Sapiens
TSDPAEVLV

SEQ ID NO: 145982 - protein, 9 aa, Homo Sapiens
TSDPLELFL

SEQ ID NO: 145983 - protein, 9 aa, Homo Sapiens
TSDYLVVYL

SEQ ID NO: 145984 - protein, 9 aa, Homo Sapiens
TSPEAFLAL

SEQ ID NO: 145985 - protein, 9 aa, Homo Sapiens
TSPSYIDKL

SEQ ID NO: 145986 - protein, 9 aa, Homo Sapiens
TTDGYLLRL

SEQ ID NO: 145987 - protein, 9 aa, Homo Sapiens
TTDPMLAYL

SEQ ID NO: 145988 - protein, 9 aa, Homo Sapiens
TTEGIPVLI

SEQ ID NO: 145989 - protein, 9 aa, Homo Sapiens
TTEMMPVYL

SEQ ID NO: 145990 - protein, 9 aa, Homo Sapiens
TVDDLLSLK

SEQ ID NO: 145991 - protein, 9 aa, Homo Sapiens
TVPVRLSSL

SEQ ID NO: 145992 - protein, 9 aa, Homo Sapiens
VADAIRTSL

SEQ ID NO: 145993 - protein, 9 aa, Homo Sapiens
VADALILRV

SEQ ID NO: 145994 - protein, 9 aa, Homo Sapiens
VADDPIVMV

SEQ ID NO: 145995 - protein, 9 aa, Homo Sapiens
VADDTPVLL

SEQ ID NO: 145996 - protein, 9 aa, Homo Sapiens
VADEGICYL

SEQ ID NO: 145997 - protein, 9 aa, Homo Sapiens
VADELVAEF

SEQ ID NO: 145998 - protein, 9 aa, Homo Sapiens
VADELVSEF

SEQ ID NO: 145999 - protein, 9 aa, Homo Sapiens
VADEVCRIF

SEQ ID NO: 146000 - protein, 9 aa, Homo Sapiens
VADFGLARL

SEQ ID NO: 146001 - protein, 9 aa, Homo Sapiens
VADFGLITM

SEQ ID NO: 146002 - protein, 9 aa, Homo Sapiens
VADFGSATF

SEQ ID NO: 146003 - protein, 9 aa, Homo Sapiens
VADFSATYL

SEQ ID NO: 146004 - protein, 9 aa, Homo Sapiens
VADGLITTL

SEQ ID NO: 146005 - protein, 9 aa, Homo Sapiens
VADGLVTTL

SEQ ID NO: 146006 - protein, 9 aa, Homo Sapiens
VADGYPVRL

SEQ ID NO: 146007 - protein, 9 aa, Homo Sapiens
VADHPGIDF

SEQ ID NO: 146008 - protein, 9 aa, Homo Sapiens
VADKDTVLL

SEQ ID NO: 146009 - protein, 9 aa, Homo Sapiens
VADLAESIM

SEQ ID NO: 146010 - protein, 9 aa, Homo Sapiens
VADLLLVFI

SEQ ID NO: 146011 - protein, 9 aa, Homo Sapiens
VADLQLIDF

SEQ ID NO: 146012 - protein, 9 aa, Homo Sapiens
VADLREAIL

SEQ ID NO: 146013 - protein, 9 aa, Homo Sapiens
VADPIIYVL

SEQ ID NO: 146014 - protein, 9 aa, Homo Sapiens
VADPILYCF

SEQ ID NO: 146015 - protein, 9 aa, Homo Sapiens
VADPTPFHI

SEQ ID NO: 146016 - protein, 9 aa, Homo Sapiens
VADPVEAVL

SEQ ID NO: 146017 - protein, 9 aa, Homo Sapiens
VADPVYRTF

SEQ ID NO: 146018 - protein, 9 aa, Homo Sapiens
VADPYVVIM

SEQ ID NO: 146019 - protein, 9 aa, Homo Sapiens
VADQIVTKL

SEQ ID NO: 146020 - protein, 9 aa, Homo Sapiens
VADQSVILL

SEQ ID NO: 146021 - protein, 9 aa, Homo Sapiens
VADRLLVEL

SEQ ID NO: 146022 - protein, 9 aa, Homo Sapiens
VADTFQDYF

SEQ ID NO: 146023 - protein, 9 aa, Homo Sapiens
VADVLCEFL

SEQ ID NO: 146024 - protein, 9 aa, Homo Sapiens
VADVVVSRW

SEQ ID NO: 146025 - protein, 9 aa, Homo Sapiens
VAEAVATFL

SEQ ID NO: 146026 - protein, 9 aa, Homo Sapiens
VAETHIVLL

SEQ ID NO: 146027 - protein, 9 aa, Homo Sapiens
VAEYEPVLI

SEQ ID NO: 146028 - protein, 9 aa, Homo Sapiens
VFDCVVNSL

SEQ ID NO: 146029 - protein, 9 aa, Homo Sapiens
VFDCVVTSL

SEQ ID NO: 146030 - protein, 9 aa, Homo Sapiens
VFDDMINLL

SEQ ID NO: 146031 - protein, 9 aa, Homo Sapiens
VFDDTITEM

SEQ ID NO: 146032 - protein, 9 aa, Homo Sapiens
VFDDTLGSF

SEQ ID NO: 146033 - protein, 9 aa, Homo Sapiens
VFDEAIRAV

SEQ ID NO: 146034 - protein, 9 aa, Homo Sapiens
VFDEVVQIF

SEQ ID NO: 146035 - protein, 9 aa, Homo Sapiens
VFDIVIHRF

SEQ ID NO: 146036 - protein, 9 aa, Homo Sapiens
VFDKTLAEL

SEQ ID NO: 146037 - protein, 9 aa, Homo Sapiens
VFDLIQELF

SEQ ID NO: 146038 - protein, 9 aa, Homo Sapiens
VFDLTKEIF

SEQ ID NO: 146039 - protein, 9 aa, Homo Sapiens
VFDNVKDFF

SEQ ID NO: 146040 - protein, 9 aa, Homo Sapiens
VFDPALNLF

SEQ ID NO: 146041 - protein, 9 aa, Homo Sapiens
VFDPIANCW

SEQ ID NO: 146042 - protein, 9 aa, Homo Sapiens
VFDPVPVGV

SEQ ID NO: 146043 - protein, 9 aa, Homo Sapiens
VFDPVQKTL

SEQ ID NO: 146044 - protein, 9 aa, Homo Sapiens
VFDPVTKLW

SEQ ID NO: 146045 - protein, 9 aa, Homo Sapiens
VFDTAIAHL

SEQ ID NO: 146046 - protein, 9 aa, Homo Sapiens
VFDVIIRCF

SEQ ID NO: 146047 - protein, 9 aa, Homo Sapiens
VFDWIEANL

SEQ ID NO: 146048 - protein, 9 aa, Homo Sapiens
VGDGYVVHL

SEQ ID NO: 146049 - protein, 9 aa, Homo Sapiens
VGDLPNGRV

SEQ ID NO: 146050 - protein, 9 aa, Homo Sapiens
VGDPAVVFL

SEQ ID NO: 146051 - protein, 9 aa, Homo Sapiens
VGDPHTVTV

SEQ ID NO: 146052 - protein, 9 aa, Homo Sapiens
VGDTQVVVF

SEQ ID NO: 146053 - protein, 9 aa, Homo Sapiens
VIDKLVVHL

SEQ ID NO: 146054 - protein, 9 aa, Homo Sapiens
VIDPVPAAV

SEQ ID NO: 146055 - protein, 9 aa, Homo Sapiens
VIDVVPPKF

SEQ ID NO: 146056 - protein, 9 aa, Homo Sapiens
VIEDKTIEL

SEQ ID NO: 146057 - protein, 9 aa, Homo Sapiens
VIEINPYLL

SEQ ID NO: 146058 - protein, 9 aa, Homo Sapiens
VIPESVILL

SEQ ID NO: 146059 - protein, 9 aa, Homo Sapiens
VIPGYEELL

SEQ ID NO: 146060 - protein, 9 aa, Homo Sapiens
VIPTNVPEL

SEQ ID NO: 146061 - protein, 9 aa, Homo Sapiens
VLPNDPVFL

SEQ ID NO: 146062 - protein, 9 aa, Homo Sapiens
VMDSKIVQV

SEQ ID NO: 146063 - protein, 9 aa, Homo Sapiens
VQDLIEGHL

SEQ ID NO: 146064 - protein, 9 aa, Homo Sapiens
VQDPKVTYL

SEQ ID NO: 146065 - protein, 9 aa, Homo Sapiens
VRPNDEVTA

SEQ ID NO: 146066 - protein, 9 aa, Homo Sapiens
VSDGLIVMI

SEQ ID NO: 146067 - protein, 9 aa, Homo Sapiens
VSDHFPVEF

SEQ ID NO: 146068 - protein, 9 aa, Homo Sapiens
VSDICTIYL

SEQ ID NO: 146069 - protein, 9 aa, Homo Sapiens
VSDLGPVVL

SEQ ID NO: 146070 - protein, 9 aa, Homo Sapiens
VSDPVTVHF

SEQ ID NO: 146071 - protein, 9 aa, Homo Sapiens
VSTSHTTIS

SEQ ID NO: 146072 - protein, 9 aa, Homo Sapiens
VTDDLVCLV

SEQ ID NO: 146073 - protein, 9 aa, Homo Sapiens
VTDEVFNFL

SEQ ID NO: 146074 - protein, 9 aa, Homo Sapiens
VTDFISHLF

SEQ ID NO: 146075 - protein, 9 aa, Homo Sapiens
VTDFPSCYL

SEQ ID NO: 146076 - protein, 9 aa, Homo Sapiens
VTDGALVVV

SEQ ID NO: 146077 - protein, 9 aa, Homo Sapiens
VTDGKEVLL

SEQ ID NO: 146078 - protein, 9 aa, Homo Sapiens
VTDIHQLSF

SEQ ID NO: 146079 - protein, 9 aa, Homo Sapiens
VTDPRVVDL

SEQ ID NO: 146080 - protein, 9 aa, Homo Sapiens
VTDSCIVAL

SEQ ID NO: 146081 - protein, 9 aa, Homo Sapiens
VTDSHTVFI

SEQ ID NO: 146082 - protein, 9 aa, Homo Sapiens
VTDVGEVFV

SEQ ID NO: 146083 - protein, 9 aa, Homo Sapiens
VTDVGQILL

SEQ ID NO: 146084 - protein, 9 aa, Homo Sapiens
VTDVHPTLL

SEQ ID NO: 146085 - protein, 9 aa, Homo Sapiens
VTDVTSNLL

SEQ ID NO: 146086 - protein, 9 aa, Homo Sapiens
VTEEFGVHL

SEQ ID NO: 146087 - protein, 9 aa, Homo Sapiens
VTEEHVVTF

SEQ ID NO: 146088 - protein, 9 aa, Homo Sapiens
VTEGEVISL

SEQ ID NO: 146089 - protein, 9 aa, Homo Sapiens
VVDAIPVFL

SEQ ID NO: 146090 - protein, 9 aa, Homo Sapiens
VVDDEIYYF

SEQ ID NO: 146091 - protein, 9 aa, Homo Sapiens
VVDYKEVLL

SEQ ID NO: 146092 - protein, 9 aa, Homo Sapiens
VVEDVAWHL

SEQ ID NO: 146093 - protein, 9 aa, Homo Sapiens
VVPDHPVLL

SEQ ID NO: 146094 - protein, 9 aa, Homo Sapiens
VVPFLPSVL

SEQ ID NO: 146095 - protein, 9 aa, Homo Sapiens
VWDIVGTEL

SEQ ID NO: 146096 - protein, 9 aa, Homo Sapiens
VYDALNVLM

SEQ ID NO: 146097 - protein, 9 aa, Homo Sapiens
VYDLLKTNL

SEQ ID NO: 146098 - protein, 9 aa, Homo Sapiens
VYDLSIRGF

SEQ ID NO: 146099 - protein, 9 aa, Homo Sapiens
VYDVVEEKL

SEQ ID NO: 146100 - protein, 9 aa, Homo Sapiens
VYDVVELKF

SEQ ID NO: 146101 - protein, 9 aa, Homo Sapiens
YADFAPSLL

SEQ ID NO: 146102 - protein, 9 aa, Homo Sapiens
YADHPFIFL

SEQ ID NO: 146103 - protein, 9 aa, Homo Sapiens
YADIEAAWL

SEQ ID NO: 146104 - protein, 9 aa, Homo Sapiens
YADIFLRNV

SEQ ID NO: 146105 - protein, 9 aa, Homo Sapiens
YADIFPSKV

SEQ ID NO: 146106 - protein, 9 aa, Homo Sapiens
YAEEFRTYL

SEQ ID NO: 146107 - protein, 9 aa, Homo Sapiens
YAEVGRVLL

SEQ ID NO: 146108 - protein, 9 aa, Homo Sapiens
YFDAIPVTM

SEQ ID NO: 146109 - protein, 9 aa, Homo Sapiens
YFDDALEDF

SEQ ID NO: 146110 - protein, 9 aa, Homo Sapiens
YFDEILNKL

SEQ ID NO: 146111 - protein, 9 aa, Homo Sapiens
YFDEPVELR

SEQ ID NO: 146112 - protein, 9 aa, Homo Sapiens
YFDLLGELM

SEQ ID NO: 146113 - protein, 9 aa, Homo Sapiens
YFDLQLLVF

SEQ ID NO: 146114 - protein, 9 aa, Homo Sapiens
YFDLQTHVI

SEQ ID NO: 146115 - protein, 9 aa, Homo Sapiens
YFDNILNSF

SEQ ID NO: 146116 - protein, 9 aa, Homo Sapiens
YFDPANGKF

SEQ ID NO: 146117 - protein, 9 aa, Homo Sapiens
YFDPQYFEF

SEQ ID NO: 146118 - protein, 9 aa, Homo Sapiens
YFDPTIVSV

SEQ ID NO: 146119 - protein, 9 aa, Homo Sapiens
YFDQVLVNI

SEQ ID NO: 146120 - protein, 9 aa, Homo Sapiens
YFDVMLENF

SEQ ID NO: 146121 - protein, 9 aa, Homo Sapiens
YFEELITML

SEQ ID NO: 146122 - protein, 9 aa, Homo Sapiens
YFPDKVALL

SEQ ID NO: 146123 - protein, 9 aa, Homo Sapiens
YGDCHPVFF

SEQ ID NO: 146124 - protein, 9 aa, Homo Sapiens
YGDSLVVLV

SEQ ID NO: 146125 - protein, 9 aa, Homo Sapiens
YIDDLVVIL

SEQ ID NO: 146126 - protein, 9 aa, Homo Sapiens
YIDLPPPRL

SEQ ID NO: 146127 - protein, 9 aa, Homo Sapiens
YIDRGVVFV

SEQ ID NO: 146128 - protein, 9 aa, Homo Sapiens
YIPNKVLIL

SEQ ID NO: 146129 - protein, 9 aa, Homo Sapiens
YLDNGVVFV

SEQ ID NO: 146130 - protein, 9 aa, Homo Sapiens
YLEDSPLEL

SEQ ID NO: 146131 - protein, 9 aa, Homo Sapiens
YLPDFLDYF

SEQ ID NO: 146132 - protein, 9 aa, Homo Sapiens
YNDPIYVKL

SEQ ID NO: 146133 - protein, 9 aa, Homo Sapiens
YSDDIPHAL

SEQ ID NO: 146134 - protein, 9 aa, Homo Sapiens
YTDATPLRV

SEQ ID NO: 146135 - protein, 9 aa, Homo Sapiens
YTDIQEPML

SEQ ID NO: 146136 - protein, 9 aa, Homo Sapiens
YTDKIMTYL

SEQ ID NO: 146137 - protein, 9 aa, Homo Sapiens
YTDLPNRQL

SEQ ID NO: 146138 - protein, 9 aa, Homo Sapiens
YTDNLVRVW

SEQ ID NO: 146139 - protein, 9 aa, Homo Sapiens
YTDTKMILF

SEQ ID NO: 146140 - protein, 9 aa, Homo Sapiens
YTDVNIVTI

SEQ ID NO: 146141 - protein, 9 aa, Homo Sapiens
YTDVTPRQF

SEQ ID NO: 146142 - protein, 9 aa, Homo Sapiens
YTELNIVNL

SEQ ID NO: 146143 - protein, 9 aa, Homo Sapiens
YTEMDPVII

SEQ ID NO: 146144 - protein, 9 aa, Homo Sapiens
YTIEILKVE

SEQ ID NO: 146145 - protein, 9 aa, Homo Sapiens
YVDDGLISL

SEQ ID NO: 146146 - protein, 9 aa, Homo Sapiens
YVDDVISRI

SEQ ID NO: 146147 - protein, 9 aa, Homo Sapiens
YVDEGEVYF

SEQ ID NO: 146148 - protein, 9 aa, Homo Sapiens
YVDGRVLVV

SEQ ID NO: 146149 - protein, 9 aa, Homo Sapiens
YVDVVKVLL

SEQ ID NO: 146150 - protein, 9 aa, Homo Sapiens
YVPAEVCRL

SEQ ID NO: 146151 - protein, 9 aa, Homo Sapiens
YVPDSPALL

SEQ ID NO: 146152 - protein, 9 aa, Homo Sapiens
YVQDYEDFM

SEQ ID NO: 146153 - protein, 9 aa, Homo Sapiens
YYDEIINAL

SEQ ID NO: 146154 - protein, 9 aa, Homo Sapiens
YYDEKVVKL

SEQ ID NO: 146155 - protein, 9 aa, Homo Sapiens
YYDLVKAFM

SEQ ID NO: 146156 - protein, 9 aa, Homo Sapiens
YYDLVRTEI

SEQ ID NO: 146157 - protein, 9 aa, Homo Sapiens
YYDPKHVIF

SEQ ID NO: 146158 - protein, 9 aa, Homo Sapiens
YYDVAKQLL

SEQ ID NO: 146159 - protein, 9 aa, Homo Sapiens
YYDVPIATL

SEQ ID NO: 146160 - protein, 10 aa, Homo Sapiens
AADPGLPARL

SEQ ID NO: 146161 - protein, 10 aa, Homo Sapiens
AFDVVERSFL

SEQ ID NO: 146162 - protein, 10 aa, Homo Sapiens
AQFIDKPVCF

SEQ ID NO: 146163 - protein, 10 aa, Homo Sapiens
DAAVIPIKNN

SEQ ID NO: 146164 - protein, 10 aa, Homo Sapiens
DANMDELLDL

SEQ ID NO: 146165 - protein, 10 aa, Homo Sapiens
FADPVDVNPF

SEQ ID NO: 146166 - protein, 10 aa, Homo Sapiens
FADVAVYFSP

SEQ ID NO: 146167 - protein, 10 aa, Homo Sapiens
FFDATDRVSF

SEQ ID NO: 146168 - protein, 10 aa, Homo Sapiens
FFDDVGAVTL

SEQ ID NO: 146169 - protein, 10 aa, Homo Sapiens
FFDPNTHENL

SEQ ID NO: 146170 - protein, 10 aa, Homo Sapiens
FFDPSLLHLL

SEQ ID NO: 146171 - protein, 10 aa, Homo Sapiens
FLPARFYQAL

SEQ ID NO: 146172 - protein, 10 aa, Homo Sapiens
FLSEHPNVTL

SEQ ID NO: 146173 - protein, 10 aa, Homo Sapiens
FMEAIAPPLL

SEQ ID NO: 146174 - protein, 10 aa, Homo Sapiens
FTDCYGYHDF

SEQ ID NO: 146175 - protein, 10 aa, Homo Sapiens
FTDEESRVFL

SEQ ID NO: 146176 - protein, 10 aa, Homo Sapiens
FTDQATVERF

SEQ ID NO: 146177 - protein, 10 aa, Homo Sapiens
FTDSLITRNF

SEQ ID NO: 146178 - protein, 10 aa, Homo Sapiens
FTDTDCVVRF

SEQ ID NO: 146179 - protein, 10 aa, Homo Sapiens
FVDDGTETHF

SEQ ID NO: 146180 - protein, 10 aa, Homo Sapiens
FVDSGAPPAL

SEQ ID NO: 146181 - protein, 10 aa, Homo Sapiens
GDLPNGRVCP

SEQ ID NO: 146182 - protein, 10 aa, Homo Sapiens
HLHNMPPSAL

SEQ ID NO: 146183 - protein, 10 aa, Homo Sapiens
IADLAHLLLF

SEQ ID NO: 146184 - protein, 10 aa, Homo Sapiens
IADNRPSVEF

SEQ ID NO: 146185 - protein, 10 aa, Homo Sapiens
IFDLQSNTVL

SEQ ID NO: 146186 - protein, 10 aa, Homo Sapiens
IFDVVDGTYV

SEQ ID NO: 146187 - protein, 10 aa, Homo Sapiens
IGEDIFPPLL

SEQ ID NO: 146188 - protein, 10 aa, Homo Sapiens
IIDDPSGNSF

SEQ ID NO: 146189 - protein, 10 aa, Homo Sapiens
IIDTPGHESF

SEQ ID NO: 146190 - protein, 10 aa, Homo Sapiens
IIDTPGHVDF

SEQ ID NO: 146191 - protein, 10 aa, Homo Sapiens
IIEEHPPLML

SEQ ID NO: 146192 - protein, 10 aa, Homo Sapiens
ILDDVSLTHL

SEQ ID NO: 146193 - protein, 10 aa, Homo Sapiens
IQNAVNGVKQ

SEQ ID NO: 146194 - protein, 10 aa, Homo Sapiens
ITDPDVVHIW

SEQ ID NO: 146195 - protein, 10 aa, Homo Sapiens
ITDPEVVFVA

SEQ ID NO: 146196 - protein, 10 aa, Homo Sapiens
KADGIVSKNF

SEQ ID NO: 146197 - protein, 10 aa, Homo Sapiens
LEGLALPHDL

SEQ ID NO: 146198 - protein, 10 aa, Homo Sapiens
LLGLFGYLVF

SEQ ID NO: 146199 - protein, 10 aa, Homo Sapiens
LTDPAIVKVF

SEQ ID NO: 146200 - protein, 10 aa, Homo Sapiens
PKWVGDLPNG

SEQ ID NO: 146201 - protein, 10 aa, Homo Sapiens
QLHHNPGEET

SEQ ID NO: 146202 - protein, 10 aa, Homo Sapiens
RPNDEVTAVL

SEQ ID NO: 146203 - protein, 10 aa, Homo Sapiens
RSDVPSLVTF

SEQ ID NO: 146204 - protein, 10 aa, Homo Sapiens
SQAGDRIFFV

SEQ ID NO: 146205 - protein, 10 aa, Homo Sapiens
SVRPNDEVTA

SEQ ID NO: 146206 - protein, 10 aa, Homo Sapiens
SYDPTIENTF

SEQ ID NO: 146207 - protein, 10 aa, Homo Sapiens
TFDETVSTYV

SEQ ID NO: 146208 - protein, 10 aa, Homo Sapiens
TIPIVPTAEF

SEQ ID NO: 146209 - protein, 10 aa, Homo Sapiens
VADPDNPLVL

SEQ ID NO: 146210 - protein, 10 aa, Homo Sapiens
VADPYVVIMS

SEQ ID NO: 146211 - protein, 10 aa, Homo Sapiens
VAETHIVLLF

SEQ ID NO: 146212 - protein, 10 aa, Homo Sapiens
VAPEEHPVLL

SEQ ID NO: 146213 - protein, 10 aa, Homo Sapiens
VDGGWYPVIL

SEQ ID NO: 146214 - protein, 10 aa, Homo Sapiens
VFDEAIRAVL

SEQ ID NO: 146215 - protein, 10 aa, Homo Sapiens
VFDIVTSQIF

SEQ ID NO: 146216 - protein, 10 aa, Homo Sapiens
VFDMGAEVGF

SEQ ID NO: 146217 - protein, 10 aa, Homo Sapiens
VFDPVQKTLL

SEQ ID NO: 146218 - protein, 10 aa, Homo Sapiens
VFDTAIAHLF

SEQ ID NO: 146219 - protein, 10 aa, Homo Sapiens
VFDVFLVEGY

SEQ ID NO: 146220 - protein, 10 aa, Homo Sapiens
VFDVLDGEEM

SEQ ID NO: 146221 - protein, 10 aa, Homo Sapiens
VFDVTAPNTF

SEQ ID NO: 146222 - protein, 10 aa, Homo Sapiens
VGDLEDCLLN

SEQ ID NO: 146223 - protein, 10 aa, Homo Sapiens
VGDLPNGRVC

SEQ ID NO: 146224 - protein, 10 aa, Homo Sapiens
VRPNDEVTAV

SEQ ID NO: 146225 - protein, 10 aa, Homo Sapiens
VSDDSLGSLL

SEQ ID NO: 146226 - protein, 10 aa, Homo Sapiens
VTDDLVCLVY

SEQ ID NO: 146227 - protein, 10 aa, Homo Sapiens
VTDEFLSDFL

SEQ ID NO: 146228 - protein, 10 aa, Homo Sapiens
VTDEPVYIDL

SEQ ID NO: 146229 - protein, 10 aa, Homo Sapiens
VTDPRVVDLL

SEQ ID NO: 146230 - protein, 10 aa, Homo Sapiens
VTEGGEPYRL

SEQ ID NO: 146231 - protein, 10 aa, Homo Sapiens
VVTSHQAPGE

SEQ ID NO: 146232 - protein, 10 aa, Homo Sapiens
WVGDLPNGRV

SEQ ID NO: 146233 - protein, 10 aa, Homo Sapiens
YADPGAEVKI

SEQ ID NO: 146234 - protein, 10 aa, Homo Sapiens
YVDDTQFVRF

SEQ ID NO: 146235 - protein, 10 aa, Homo Sapiens
YVDGPASTAF

SEQ ID NO: 146236 - protein, 11 aa, Homo Sapiens
DDAAVIPIKNN

SEQ ID NO: 146237 - protein, 11 aa, Homo Sapiens
DESLQVAERLT

SEQ ID NO: 146238 - protein, 11 aa, Homo Sapiens
DVSSFNPHGIS

SEQ ID NO: 146239 - protein, 11 aa, Homo Sapiens
EIQNAVNGVKQ

SEQ ID NO: 146240 - protein, 11 aa, Homo Sapiens
FFDPSLLHLLY

SEQ ID NO: 146241 - protein, 11 aa, Homo Sapiens
FTDEGVPKFLS

SEQ ID NO: 146242 - protein, 11 aa, Homo Sapiens
FYDPDTSIIYL

SEQ ID NO: 146243 - protein, 11 aa, Homo Sapiens
FYEPQKGSIYL

SEQ ID NO: 146244 - protein, 11 aa, Homo Sapiens
GADNSVVRFLP

SEQ ID NO: 146245 - protein, 11 aa, Homo Sapiens
HSPAFQHPPTE

SEQ ID NO: 146246 - protein, 11 aa, Homo Sapiens
IADLSNIINKL

SEQ ID NO: 146247 - protein, 11 aa, Homo Sapiens
IADPSAYGIYI

SEQ ID NO: 146248 - protein, 11 aa, Homo Sapiens
IIDLEQTATHL

SEQ ID NO: 146249 - protein, 11 aa, Homo Sapiens
ITDGSTPINLF

SEQ ID NO: 146250 - protein, 11 aa, Homo Sapiens
KELEMLLMSAE

SEQ ID NO: 146251 - protein, 11 aa, Homo Sapiens
LCDGQLEGAEI

SEQ ID NO: 146252 - protein, 11 aa, Homo Sapiens
LLPEELTPLIL

SEQ ID NO: 146253 - protein, 11 aa, Homo Sapiens
MAPSETQFSHL

SEQ ID NO: 146254 - protein, 11 aa, Homo Sapiens
NFDVGHVPIRL

SEQ ID NO: 146255 - protein, 11 aa, Homo Sapiens
QDNTRKIIIKN

SEQ ID NO: 146256 - protein, 11 aa, Homo Sapiens
QDSQLQKARED

SEQ ID NO: 146257 - protein, 11 aa, Homo Sapiens
QKADIEEIKSG

SEQ ID NO: 146258 - protein, 11 aa, Homo Sapiens
QPTDSDIPSFL

SEQ ID NO: 146259 - protein, 11 aa, Homo Sapiens
SVRPNDEVTAV

SEQ ID NO: 146260 - protein, 11 aa, Homo Sapiens
TFDVAPSRLDF

SEQ ID NO: 146261 - protein, 11 aa, Homo Sapiens
VADPYVVIMSA

SEQ ID NO: 146262 - protein, 11 aa, Homo Sapiens
VGDLPNGRVCP

SEQ ID NO: 146263 - protein, 11 aa, Homo Sapiens
VGEVPAVGARA

SEQ ID NO: 146264 - protein, 11 aa, Homo Sapiens
VGEVTSTSKYC

SEQ ID NO: 146265 - protein, 11 aa, Homo Sapiens
VLDVDLVCEAL

SEQ ID NO: 146266 - protein, 11 aa, Homo Sapiens
VTEGGEPYRLY

SEQ ID NO: 146267 - protein, 11 aa, Homo Sapiens
VVVTSHQAPGE

SEQ ID NO: 146268 - protein, 11 aa, Homo Sapiens
WVGDLPNGRVC

SEQ ID NO: 146269 - protein, 11 aa, Homo Sapiens
YTDGPLMPSDF

SEQ ID NO: 146270 - protein, 8 aa, Homo Sapiens
AADAGTFL

SEQ ID NO: 146271 - protein, 8 aa, Homo Sapiens
AADEPSSL

SEQ ID NO: 146272 - protein, 8 aa, Homo Sapiens
AADEPVTV

SEQ ID NO: 146273 - protein, 8 aa, Homo Sapiens
AADFTAKV

SEQ ID NO: 146274 - protein, 8 aa, Homo Sapiens
AADGGPKL

SEQ ID NO: 146275 - protein, 8 aa, Homo Sapiens
AADGPQKL

SEQ ID NO: 146276 - protein, 8 aa, Homo Sapiens
AADGSVKL

SEQ ID NO: 146277 - protein, 8 aa, Homo Sapiens
AADGTVEL

SEQ ID NO: 146278 - protein, 8 aa, Homo Sapiens
AADGVIRL

SEQ ID NO: 146279 - protein, 8 aa, Homo Sapiens
AADIASKV

SEQ ID NO: 146280 - protein, 8 aa, Homo Sapiens
AADIPINI

SEQ ID NO: 146281 - protein, 8 aa, Homo Sapiens
AADLGSVV

SEQ ID NO: 146282 - protein, 8 aa, Homo Sapiens
AADNQIYI

SEQ ID NO: 146283 - protein, 8 aa, Homo Sapiens
AADSAVRL

SEQ ID NO: 146284 - protein, 8 aa, Homo Sapiens
AADTPAIM

SEQ ID NO: 146285 - protein, 8 aa, Homo Sapiens
AADTVVIF

SEQ ID NO: 146286 - protein, 8 aa, Homo Sapiens
AGDGDVKL

SEQ ID NO: 146287 - protein, 8 aa, Homo Sapiens
AGDHPVEL

SEQ ID NO: 146288 - protein, 8 aa, Homo Sapiens
AGDKPATF

SEQ ID NO: 146289 - protein, 8 aa, Homo Sapiens
AIDSPVSF

SEQ ID NO: 146290 - protein, 8 aa, Homo Sapiens
AIDTEERL

SEQ ID NO: 146291 - protein, 8 aa, Homo Sapiens
AIDTESRL

SEQ ID NO: 146292 - protein, 8 aa, Homo Sapiens
ALDKATVL

SEQ ID NO: 146293 - protein, 8 aa, Homo Sapiens
ALDTPVMV

SEQ ID NO: 146294 - protein, 8 aa, Homo Sapiens
AQDFKTDL

SEQ ID NO: 146295 - protein, 8 aa, Homo Sapiens
AQDQPVKM

SEQ ID NO: 146296 - protein, 8 aa, Homo Sapiens
ASDAAAFL

SEQ ID NO: 146297 - protein, 8 aa, Homo Sapiens
ASDDPEKL

SEQ ID NO: 146298 - protein, 8 aa, Homo Sapiens
ASDEVTRL

SEQ ID NO: 146299 - protein, 8 aa, Homo Sapiens
ASDGTVRL

SEQ ID NO: 146300 - protein, 8 aa, Homo Sapiens
ASDVAQHL

SEQ ID NO: 146301 - protein, 8 aa, Homo Sapiens
ASDVHGNF

SEQ ID NO: 146302 - protein, 8 aa, Homo Sapiens
AVDDPAAI

SEQ ID NO: 146303 - protein, 8 aa, Homo Sapiens
AVDEPQML

SEQ ID NO: 146304 - protein, 8 aa, Homo Sapiens
AVDREARL

SEQ ID NO: 146305 - protein, 8 aa, Homo Sapiens
AVDSVVSL

SEQ ID NO: 146306 - protein, 8 aa, Homo Sapiens
AVDTSSEI

SEQ ID NO: 146307 - protein, 8 aa, Homo Sapiens
EIDHAVHL

SEQ ID NO: 146308 - protein, 8 aa, Homo Sapiens
ESLIACKA

SEQ ID NO: 146309 - protein, 8 aa, Homo Sapiens
ETDTPAQL

SEQ ID NO: 146310 - protein, 8 aa, Homo Sapiens
ETEDPRLL

SEQ ID NO: 146311 - protein, 8 aa, Homo Sapiens
FADAHSNL

SEQ ID NO: 146312 - protein, 8 aa, Homo Sapiens
FADATVEL

SEQ ID NO: 146313 - protein, 8 aa, Homo Sapiens
FADAVQEL

SEQ ID NO: 146314 - protein, 8 aa, Homo Sapiens
FADDMQEF

SEQ ID NO: 146315 - protein, 8 aa, Homo Sapiens
FADIGNTV

SEQ ID NO: 146316 - protein, 8 aa, Homo Sapiens
FADKHIQV

SEQ ID NO: 146317 - protein, 8 aa, Homo Sapiens
FADNVSGL

SEQ ID NO: 146318 - protein, 8 aa, Homo Sapiens
FADYVSTM

SEQ ID NO: 146319 - protein, 8 aa, Homo Sapiens
FAEGITKI

SEQ ID NO: 146320 - protein, 8 aa, Homo Sapiens
FAERVTSL

SEQ ID NO: 146321 - protein, 8 aa, Homo Sapiens
FGDKDSKL

SEQ ID NO: 146322 - protein, 8 aa, Homo Sapiens
FGDSEPEL

SEQ ID NO: 146323 - protein, 8 aa, Homo Sapiens
FGDVSSRL

SEQ ID NO: 146324 - protein, 8 aa, Homo Sapiens
FIDKPVCF

SEQ ID NO: 146325 - protein, 8 aa, Homo Sapiens
FIDKQTNL

SEQ ID NO: 146326 - protein, 8 aa, Homo Sapiens
FIDQSQSL

SEQ ID NO: 146327 - protein, 8 aa, Homo Sapiens
FIDTAQHM

SEQ ID NO: 146328 - protein, 8 aa, Homo Sapiens
FIDTTSKF

SEQ ID NO: 146329 - protein, 8 aa, Homo Sapiens
FLDDPQAV

SEQ ID NO: 146330 - protein, 8 aa, Homo Sapiens
FLDEEVKL

SEQ ID NO: 146331 - protein, 8 aa, Homo Sapiens
FLDKALEL

SEQ ID NO: 146332 - protein, 8 aa, Homo Sapiens
FLDVVSKL

SEQ ID NO: 146333 - protein, 8 aa, Homo Sapiens
FLEDPSVL

SEQ ID NO: 146334 - protein, 8 aa, Homo Sapiens
FMDQHPEM

SEQ ID NO: 146335 - protein, 8 aa, Homo Sapiens
FQDGATKL

SEQ ID NO: 146336 - protein, 8 aa, Homo Sapiens
FQDKASEL

SEQ ID NO: 146337 - protein, 8 aa, Homo Sapiens
FSDGAVSL

SEQ ID NO: 146338 - protein, 8 aa, Homo Sapiens
FSDGDAKL

SEQ ID NO: 146339 - protein, 8 aa, Homo Sapiens
FSDGITSV

SEQ ID NO: 146340 - protein, 8 aa, Homo Sapiens
FSDSHNAL

SEQ ID NO: 146341 - protein, 8 aa, Homo Sapiens
FSDTEAAM

SEQ ID NO: 146342 - protein, 8 aa, Homo Sapiens
FTDEESRV

SEQ ID NO: 146343 - protein, 8 aa, Homo Sapiens
FTDSAIAM

SEQ ID NO: 146344 - protein, 8 aa, Homo Sapiens
FTDTVIRI

SEQ ID NO: 146345 - protein, 8 aa, Homo Sapiens
FVDAITEL

SEQ ID NO: 146346 - protein, 8 aa, Homo Sapiens
FVDDETKL

SEQ ID NO: 146347 - protein, 8 aa, Homo Sapiens
FVDGVSTV

SEQ ID NO: 146348 - protein, 8 aa, Homo Sapiens
GADEPQRL

SEQ ID NO: 146349 - protein, 8 aa, Homo Sapiens
GADKSVKF

SEQ ID NO: 146350 - protein, 8 aa, Homo Sapiens
GADVVSKF

SEQ ID NO: 146351 - protein, 8 aa, Homo Sapiens
GIDRPAEL

SEQ ID NO: 146352 - protein, 8 aa, Homo Sapiens
HADLEIRL

SEQ ID NO: 146353 - protein, 8 aa, Homo Sapiens
HADSVTGL

SEQ ID NO: 146354 - protein, 8 aa, Homo Sapiens
HADVAQLL

SEQ ID NO: 146355 - protein, 8 aa, Homo Sapiens
HADVGKEL

SEQ ID NO: 146356 - protein, 8 aa, Homo Sapiens
HGDSAMHL

SEQ ID NO: 146357 - protein, 8 aa, Homo Sapiens
HIDHPVMV

SEQ ID NO: 146358 - protein, 8 aa, Homo Sapiens
HIDNDVKL

SEQ ID NO: 146359 - protein, 8 aa, Homo Sapiens
HLDKASVM

SEQ ID NO: 146360 - protein, 8 aa, Homo Sapiens
HLDQEQQL

SEQ ID NO: 146361 - protein, 8 aa, Homo Sapiens
HLDTHSGL

SEQ ID NO: 146362 - protein, 8 aa, Homo Sapiens
HQDEAVVL

SEQ ID NO: 146363 - protein, 8 aa, Homo Sapiens
HSDELTSL

SEQ ID NO: 146364 - protein, 8 aa, Homo Sapiens
HSDGSVSL

SEQ ID NO: 146365 - protein, 8 aa, Homo Sapiens
HSDNPSQL

SEQ ID NO: 146366 - protein, 8 aa, Homo Sapiens
HTDLPVSV

SEQ ID NO: 146367 - protein, 8 aa, Homo Sapiens
HTDTTVKF

SEQ ID NO: 146368 - protein, 8 aa, Homo Sapiens
HVDAHATL

SEQ ID NO: 146369 - protein, 8 aa, Homo Sapiens
HVDECVEF

SEQ ID NO: 146370 - protein, 8 aa, Homo Sapiens
HVDNETEL

SEQ ID NO: 146371 - protein, 8 aa, Homo Sapiens
HVTLSIKH

SEQ ID NO: 146372 - protein, 8 aa, Homo Sapiens
IADDFAAF

SEQ ID NO: 146373 - protein, 8 aa, Homo Sapiens
IADHCPTL

SEQ ID NO: 146374 - protein, 8 aa, Homo Sapiens
IADHYMQV

SEQ ID NO: 146375 - protein, 8 aa, Homo Sapiens
IADLAHLL

SEQ ID NO: 146376 - protein, 8 aa, Homo Sapiens
IADLQQKL

SEQ ID NO: 146377 - protein, 8 aa, Homo Sapiens
IADQITLL

SEQ ID NO: 146378 - protein, 8 aa, Homo Sapiens
IADREQRL

SEQ ID NO: 146379 - protein, 8 aa, Homo Sapiens
IADRPLYL

SEQ ID NO: 146380 - protein, 8 aa, Homo Sapiens
IADSHPEM

SEQ ID NO: 146381 - protein, 8 aa, Homo Sapiens
IADSHQNF

SEQ ID NO: 146382 - protein, 8 aa, Homo Sapiens
IADTGANV

SEQ ID NO: 146383 - protein, 8 aa, Homo Sapiens
IADTMVQI

SEQ ID NO: 146384 - protein, 8 aa, Homo Sapiens
IADVHLVE

SEQ ID NO: 146385 - protein, 8 aa, Homo Sapiens
IADVSTGL

SEQ ID NO: 146386 - protein, 8 aa, Homo Sapiens
IGDDSMKV

SEQ ID NO: 146387 - protein, 8 aa, Homo Sapiens
IGDTSGHF

SEQ ID NO: 146388 - protein, 8 aa, Homo Sapiens
IIDDHPEV

SEQ ID NO: 146389 - protein, 8 aa, Homo Sapiens
IIDDRVIL

SEQ ID NO: 146390 - protein, 8 aa, Homo Sapiens
IIDGTSEM

SEQ ID NO: 146391 - protein, 8 aa, Homo Sapiens
IIDKEVSL

SEQ ID NO: 146392 - protein, 8 aa, Homo Sapiens
IIDTPGIL

SEQ ID NO: 146393 - protein, 8 aa, Homo Sapiens
IIEEPSRL

SEQ ID NO: 146394 - protein, 8 aa, Homo Sapiens
ILDDSVEM

SEQ ID NO: 146395 - protein, 8 aa, Homo Sapiens
ILDEAVEL

SEQ ID NO: 146396 - protein, 8 aa, Homo Sapiens
ILDKPQSI

SEQ ID NO: 146397 - protein, 8 aa, Homo Sapiens
IQDQPVAL

SEQ ID NO: 146398 - protein, 8 aa, Homo Sapiens
IQDQSVEV

SEQ ID NO: 146399 - protein, 8 aa, Homo Sapiens
ISDHEATL

SEQ ID NO: 146400 - protein, 8 aa, Homo Sapiens
ISDIDKKL

SEQ ID NO: 146401 - protein, 8 aa, Homo Sapiens
ISDKDLEL

SEQ ID NO: 146402 - protein, 8 aa, Homo Sapiens
ISDKDQQL

SEQ ID NO: 146403 - protein, 8 aa, Homo Sapiens
ISDSPIGV

SEQ ID NO: 146404 - protein, 8 aa, Homo Sapiens
ISDYAVKI

SEQ ID NO: 146405 - protein, 8 aa, Homo Sapiens
ITDDSTSL

SEQ ID NO: 146406 - protein, 8 aa, Homo Sapiens
ITDLEERL

SEQ ID NO: 146407 - protein, 8 aa, Homo Sapiens
ITDLYTDL

SEQ ID NO: 146408 - protein, 8 aa, Homo Sapiens
ITDSPVVV

SEQ ID NO: 146409 - protein, 8 aa, Homo Sapiens
ITDTLQEL

SEQ ID NO: 146410 - protein, 8 aa, Homo Sapiens
IVDDEATL

SEQ ID NO: 146411 - protein, 8 aa, Homo Sapiens
IVDEASQI

SEQ ID NO: 146412 - protein, 8 aa, Homo Sapiens
IVDEDVKL

SEQ ID NO: 146413 - protein, 8 aa, Homo Sapiens
IVDEGALL

SEQ ID NO: 146414 - protein, 8 aa, Homo Sapiens
IVDRPVTL

SEQ ID NO: 146415 - protein, 8 aa, Homo Sapiens
KAAFKELQ

SEQ ID NO: 146416 - protein, 8 aa, Homo Sapiens
KADAIVKM

SEQ ID NO: 146417 - protein, 8 aa, Homo Sapiens
KADKDYHF

SEQ ID NO: 146418 - protein, 8 aa, Homo Sapiens
KADKVTML

SEQ ID NO: 146419 - protein, 8 aa, Homo Sapiens
KADNVVNI

SEQ ID NO: 146420 - protein, 8 aa, Homo Sapiens
KMDESTLL

SEQ ID NO: 146421 - protein, 8 aa, Homo Sapiens
KQDEPIDL

SEQ ID NO: 146422 - protein, 8 aa, Homo Sapiens
KSDLHPTL

SEQ ID NO: 146423 - protein, 8 aa, Homo Sapiens
KSDVEAIF

SEQ ID NO: 146424 - protein, 8 aa, Homo Sapiens
KVDEIVVL

SEQ ID NO: 146425 - protein, 8 aa, Homo Sapiens
KVDQEVKL

SEQ ID NO: 146426 - protein, 8 aa, Homo Sapiens
LADALQEL

SEQ ID NO: 146427 - protein, 8 aa, Homo Sapiens
LADAVVKI

SEQ ID NO: 146428 - protein, 8 aa, Homo Sapiens
LADFAELI

SEQ ID NO: 146429 - protein, 8 aa, Homo Sapiens
LADGGVKM

SEQ ID NO: 146430 - protein, 8 aa, Homo Sapiens
LADGSSRL

SEQ ID NO: 146431 - protein, 8 aa, Homo Sapiens
LADGVQKV

SEQ ID NO: 146432 - protein, 8 aa, Homo Sapiens
LADIAQKL

SEQ ID NO: 146433 - protein, 8 aa, Homo Sapiens
LADKGAKL

SEQ ID NO: 146434 - protein, 8 aa, Homo Sapiens
LADKSVLV

SEQ ID NO: 146435 - protein, 8 aa, Homo Sapiens
LADQCTGL

SEQ ID NO: 146436 - protein, 8 aa, Homo Sapiens
LADQEVRL

SEQ ID NO: 146437 - protein, 8 aa, Homo Sapiens
LADVATVL

SEQ ID NO: 146438 - protein, 8 aa, Homo Sapiens
LIDKPTNL

SEQ ID NO: 146439 - protein, 8 aa, Homo Sapiens
LLDSCTKL

SEQ ID NO: 146440 - protein, 8 aa, Homo Sapiens
LSDDGVDL

SEQ ID NO: 146441 - protein, 8 aa, Homo Sapiens
LSDGIQEL

SEQ ID NO: 146442 - protein, 8 aa, Homo Sapiens
LSDGVAVL

SEQ ID NO: 146443 - protein, 8 aa, Homo Sapiens
LSDLSTKL

SEQ ID NO: 146444 - protein, 8 aa, Homo Sapiens
LSDPSSRL

SEQ ID NO: 146445 - protein, 8 aa, Homo Sapiens
LSDTVQHL

SEQ ID NO: 146446 - protein, 8 aa, Homo Sapiens
LSDVAEKL

SEQ ID NO: 146447 - protein, 8 aa, Homo Sapiens
LTDEQVAL

SEQ ID NO: 146448 - protein, 8 aa, Homo Sapiens
LTDTDAAI

SEQ ID NO: 146449 - protein, 8 aa, Homo Sapiens
LVDHVAEL

SEQ ID NO: 146450 - protein, 8 aa, Homo Sapiens
LVDTTVEL

SEQ ID NO: 146451 - protein, 8 aa, Homo Sapiens
MADSGESL

SEQ ID NO: 146452 - protein, 8 aa, Homo Sapiens
MPDSAAAL

SEQ ID NO: 146453 - protein, 8 aa, Homo Sapiens
MPDSPAEV

SEQ ID NO: 146454 - protein, 8 aa, Homo Sapiens
MSDLPVKV

SEQ ID NO: 146455 - protein, 8 aa, Homo Sapiens
NADEARSL

SEQ ID NO: 146456 - protein, 8 aa, Homo Sapiens
NADIVTLL

SEQ ID NO: 146457 - protein, 8 aa, Homo Sapiens
NADKVLEL

SEQ ID NO: 146458 - protein, 8 aa, Homo Sapiens
NADQPLRV

SEQ ID NO: 146459 - protein, 8 aa, Homo Sapiens
NADSATRL

SEQ ID NO: 146460 - protein, 8 aa, Homo Sapiens
NADSGVHL

SEQ ID NO: 146461 - protein, 8 aa, Homo Sapiens
NADVHASL

SEQ ID NO: 146462 - protein, 8 aa, Homo Sapiens
NADWPAGL

SEQ ID NO: 146463 - protein, 8 aa, Homo Sapiens
NIDDVVRF

SEQ ID NO: 146464 - protein, 8 aa, Homo Sapiens
NQDKPALL

SEQ ID NO: 146465 - protein, 8 aa, Homo Sapiens
NQDRPSLL

SEQ ID NO: 146466 - protein, 8 aa, Homo Sapiens
NSDRPGVL

SEQ ID NO: 146467 - protein, 8 aa, Homo Sapiens
NTDEMVEL

SEQ ID NO: 146468 - protein, 8 aa, Homo Sapiens
QADCAVLI

SEQ ID NO: 146469 - protein, 8 aa, Homo Sapiens
QADEPTTL

SEQ ID NO: 146470 - protein, 8 aa, Homo Sapiens
RGDDPVRI

SEQ ID NO: 146471 - protein, 8 aa, Homo Sapiens
RIDMETEL

SEQ ID NO: 146472 - protein, 8 aa, Homo Sapiens
RLDVDTKL

SEQ ID NO: 146473 - protein, 8 aa, Homo Sapiens
RQDSAVNL

SEQ ID NO: 146474 - protein, 8 aa, Homo Sapiens
RSDSYVEL

SEQ ID NO: 146475 - protein, 8 aa, Homo Sapiens
RVDSPVTV

SEQ ID NO: 146476 - protein, 8 aa, Homo Sapiens
SADASIKI

SEQ ID NO: 146477 - protein, 8 aa, Homo Sapiens
SADDVIKM

SEQ ID NO: 146478 - protein, 8 aa, Homo Sapiens
SADEANVL

SEQ ID NO: 146479 - protein, 8 aa, Homo Sapiens
SADEVMRF

SEQ ID NO: 146480 - protein, 8 aa, Homo Sapiens
SADEVQRF

SEQ ID NO: 146481 - protein, 8 aa, Homo Sapiens
SADFHVDL

SEQ ID NO: 146482 - protein, 8 aa, Homo Sapiens
SADFKTEL

SEQ ID NO: 146483 - protein, 8 aa, Homo Sapiens
SADGHSIL

SEQ ID NO: 146484 - protein, 8 aa, Homo Sapiens
SADGHTML

SEQ ID NO: 146485 - protein, 8 aa, Homo Sapiens
SADGIVRI

SEQ ID NO: 146486 - protein, 8 aa, Homo Sapiens
SADGPLKL

SEQ ID NO: 146487 - protein, 8 aa, Homo Sapiens
SADGQTLF

SEQ ID NO: 146488 - protein, 8 aa, Homo Sapiens
SADHCVQL

SEQ ID NO: 146489 - protein, 8 aa, Homo Sapiens
SADHPPKL

SEQ ID NO: 146490 - protein, 8 aa, Homo Sapiens
SADKFQVL

SEQ ID NO: 146491 - protein, 8 aa, Homo Sapiens
SADKPASL

SEQ ID NO: 146492 - protein, 8 aa, Homo Sapiens
SADKSVII

SEQ ID NO: 146493 - protein, 8 aa, Homo Sapiens
SADKTVKL

SEQ ID NO: 146494 - protein, 8 aa, Homo Sapiens
SADKYVKI

SEQ ID NO: 146495 - protein, 8 aa, Homo Sapiens
SADLVAQL

SEQ ID NO: 146496 - protein, 8 aa, Homo Sapiens
SADMTIKL

SEQ ID NO: 146497 - protein, 8 aa, Homo Sapiens
SADNIAHL

SEQ ID NO: 146498 - protein, 8 aa, Homo Sapiens
SADRFVTL

SEQ ID NO: 146499 - protein, 8 aa, Homo Sapiens
SGDDISKL

SEQ ID NO: 146500 - protein, 8 aa, Homo Sapiens
SGDEMVSL

SEQ ID NO: 146501 - protein, 8 aa, Homo Sapiens
SGDVSGKL

SEQ ID NO: 146502 - protein, 8 aa, Homo Sapiens
SIDKAVQL

SEQ ID NO: 146503 - protein, 8 aa, Homo Sapiens
SIVHRKCF

SEQ ID NO: 146504 - protein, 8 aa, Homo Sapiens
SLDAPVKL

SEQ ID NO: 146505 - protein, 8 aa, Homo Sapiens
SLDEVVLL

SEQ ID NO: 146506 - protein, 8 aa, Homo Sapiens
SLDGIVRL

SEQ ID NO: 146507 - protein, 8 aa, Homo Sapiens
SLDSPVLL

SEQ ID NO: 146508 - protein, 8 aa, Homo Sapiens
SLDSPVSV

SEQ ID NO: 146509 - protein, 8 aa, Homo Sapiens
SLDSPVTV

SEQ ID NO: 146510 - protein, 8 aa, Homo Sapiens
SNDDAVRV

SEQ ID NO: 146511 - protein, 8 aa, Homo Sapiens
SSDEAVIL

SEQ ID NO: 146512 - protein, 8 aa, Homo Sapiens
SSDGTVKI

SEQ ID NO: 146513 - protein, 8 aa, Homo Sapiens
SSDLPQVL

SEQ ID NO: 146514 - protein, 8 aa, Homo Sapiens
SSDLPVAL

SEQ ID NO: 146515 - protein, 8 aa, Homo Sapiens
SSDQPLTV

SEQ ID NO: 146516 - protein, 8 aa, Homo Sapiens
SSDQSVKV

SEQ ID NO: 146517 - protein, 8 aa, Homo Sapiens
SSDRPVSL

SEQ ID NO: 146518 - protein, 8 aa, Homo Sapiens
SSDTTVKV

SEQ ID NO: 146519 - protein, 8 aa, Homo Sapiens
STDDGVQF

SEQ ID NO: 146520 - protein, 8 aa, Homo Sapiens
STDGSVLL

SEQ ID NO: 146521 - protein, 8 aa, Homo Sapiens
STDLDSKL

SEQ ID NO: 146522 - protein, 8 aa, Homo Sapiens
STDRVVLI

SEQ ID NO: 146523 - protein, 8 aa, Homo Sapiens
SVDGPIRL

SEQ ID NO: 146524 - protein, 8 aa, Homo Sapiens
SVDQPLKI

SEQ ID NO: 146525 - protein, 8 aa, Homo Sapiens
TADDELSF

SEQ ID NO: 146526 - protein, 8 aa, Homo Sapiens
TADEIVKL

SEQ ID NO: 146527 - protein, 8 aa, Homo Sapiens
TADGMVHL

SEQ ID NO: 146528 - protein, 8 aa, Homo Sapiens
TADGSALV

SEQ ID NO: 146529 - protein, 8 aa, Homo Sapiens
TADISSHF

SEQ ID NO: 146530 - protein, 8 aa, Homo Sapiens
TADKAVDL

SEQ ID NO: 146531 - protein, 8 aa, Homo Sapiens
TADKYAAL

SEQ ID NO: 146532 - protein, 8 aa, Homo Sapiens
TADLPNEL

SEQ ID NO: 146533 - protein, 8 aa, Homo Sapiens
TADQPRWV

SEQ ID NO: 146534 - protein, 8 aa, Homo Sapiens
TADVNSGF

SEQ ID NO: 146535 - protein, 8 aa, Homo Sapiens
TADYICKV

SEQ ID NO: 146536 - protein, 8 aa, Homo Sapiens
TIDEIQKL

SEQ ID NO: 146537 - protein, 8 aa, Homo Sapiens
TIDFPEFL

SEQ ID NO: 146538 - protein, 8 aa, Homo Sapiens
TIDGPSKV

SEQ ID NO: 146539 - protein, 8 aa, Homo Sapiens
TIDGVVFV

SEQ ID NO: 146540 - protein, 8 aa, Homo Sapiens
TIDKNTKI

SEQ ID NO: 146541 - protein, 8 aa, Homo Sapiens
TIDPSHPM

SEQ ID NO: 146542 - protein, 8 aa, Homo Sapiens
TIDTDTLL

SEQ ID NO: 146543 - protein, 8 aa, Homo Sapiens
TLDKPSVV

SEQ ID NO: 146544 - protein, 8 aa, Homo Sapiens
TLDSPAHL

SEQ ID NO: 146545 - protein, 8 aa, Homo Sapiens
TQDGVSRL

SEQ ID NO: 146546 - protein, 8 aa, Homo Sapiens
TSDQPILL

SEQ ID NO: 146547 - protein, 8 aa, Homo Sapiens
TSDWPTVL

SEQ ID NO: 146548 - protein, 8 aa, Homo Sapiens
TTDIQVKV

SEQ ID NO: 146549 - protein, 8 aa, Homo Sapiens
TTDPNSTF

SEQ ID NO: 146550 - protein, 8 aa, Homo Sapiens
VADAGAFL

SEQ ID NO: 146551 - protein, 8 aa, Homo Sapiens
VADDPIVM

SEQ ID NO: 146552 - protein, 8 aa, Homo Sapiens
VADEALKV

SEQ ID NO: 146553 - protein, 8 aa, Homo Sapiens
VADEPERI

SEQ ID NO: 146554 - protein, 8 aa, Homo Sapiens
VADFADKL

SEQ ID NO: 146555 - protein, 8 aa, Homo Sapiens
VADHIQKV

SEQ ID NO: 146556 - protein, 8 aa, Homo Sapiens
VADHRVKL

SEQ ID NO: 146557 - protein, 8 aa, Homo Sapiens
VADKDTVL

SEQ ID NO: 146558 - protein, 8 aa, Homo Sapiens
VADKFTEL

SEQ ID NO: 146559 - protein, 8 aa, Homo Sapiens
VADKHELL

SEQ ID NO: 146560 - protein, 8 aa, Homo Sapiens
VADKIQLI

SEQ ID NO: 146561 - protein, 8 aa, Homo Sapiens
VADLAESI

SEQ ID NO: 146562 - protein, 8 aa, Homo Sapiens
VADLAHVL

SEQ ID NO: 146563 - protein, 8 aa, Homo Sapiens
VADLQTRL

SEQ ID NO: 146564 - protein, 8 aa, Homo Sapiens
VADPVVTF

SEQ ID NO: 146565 - protein, 8 aa, Homo Sapiens
VADRFSEL

SEQ ID NO: 146566 - protein, 8 aa, Homo Sapiens
VADSGLTL

SEQ ID NO: 146567 - protein, 8 aa, Homo Sapiens
VADSKTLL

SEQ ID NO: 146568 - protein, 8 aa, Homo Sapiens
VADTPENL

SEQ ID NO: 146569 - protein, 8 aa, Homo Sapiens
VADVVIKF

SEQ ID NO: 146570 - protein, 8 aa, Homo Sapiens
VAEINGTM

SEQ ID NO: 146571 - protein, 8 aa, Homo Sapiens
VFDPHGTL

SEQ ID NO: 146572 - protein, 8 aa, Homo Sapiens
VGDEASEL

SEQ ID NO: 146573 - protein, 8 aa, Homo Sapiens
VGDGPVDM

SEQ ID NO: 146574 - protein, 8 aa, Homo Sapiens
VIDACIKL

SEQ ID NO: 146575 - protein, 8 aa, Homo Sapiens
VIDEPVRL

SEQ ID NO: 146576 - protein, 8 aa, Homo Sapiens
VIDICMKL

SEQ ID NO: 146577 - protein, 8 aa, Homo Sapiens
VIDKRSPL

SEQ ID NO: 146578 - protein, 8 aa, Homo Sapiens
VIDNGSGM

SEQ ID NO: 146579 - protein, 8 aa, Homo Sapiens
VIDSPGIL

SEQ ID NO: 146580 - protein, 8 aa, Homo Sapiens
VIDTQQKV

SEQ ID NO: 146581 - protein, 8 aa, Homo Sapiens
VIDYAVKI

SEQ ID NO: 146582 - protein, 8 aa, Homo Sapiens
VLDHFSEL

SEQ ID NO: 146583 - protein, 8 aa, Homo Sapiens
VLDIEQRL

SEQ ID NO: 146584 - protein, 8 aa, Homo Sapiens
VLDKPSRL

SEQ ID NO: 146585 - protein, 8 aa, Homo Sapiens
VNDGVVRL

SEQ ID NO: 146586 - protein, 8 aa, Homo Sapiens
VSDAPVHI

SEQ ID NO: 146587 - protein, 8 aa, Homo Sapiens
VSDDPQVL

SEQ ID NO: 146588 - protein, 8 aa, Homo Sapiens
VSDDTVEM

SEQ ID NO: 146589 - protein, 8 aa, Homo Sapiens
VSDEHSLF

SEQ ID NO: 146590 - protein, 8 aa, Homo Sapiens
VSDGETKF

SEQ ID NO: 146591 - protein, 8 aa, Homo Sapiens
VSDGVIKV

SEQ ID NO: 146592 - protein, 8 aa, Homo Sapiens
VSDHEATL

SEQ ID NO: 146593 - protein, 8 aa, Homo Sapiens
VSDKAVSL

SEQ ID NO: 146594 - protein, 8 aa, Homo Sapiens
VSDKDASL

SEQ ID NO: 146595 - protein, 8 aa, Homo Sapiens
VSDKDTGL

SEQ ID NO: 146596 - protein, 8 aa, Homo Sapiens
VSDNQVHL

SEQ ID NO: 146597 - protein, 8 aa, Homo Sapiens
VSDYEMKL

SEQ ID NO: 146598 - protein, 8 aa, Homo Sapiens
VTDAESKL

SEQ ID NO: 146599 - protein, 8 aa, Homo Sapiens
VTDDGMAV

SEQ ID NO: 146600 - protein, 8 aa, Homo Sapiens
VTDDLVCL

SEQ ID NO: 146601 - protein, 8 aa, Homo Sapiens
VTDDPTQV

SEQ ID NO: 146602 - protein, 8 aa, Homo Sapiens
VTDEPVYI

SEQ ID NO: 146603 - protein, 8 aa, Homo Sapiens
VTDFISHL

SEQ ID NO: 146604 - protein, 8 aa, Homo Sapiens
VTDSGPTF

SEQ ID NO: 146605 - protein, 8 aa, Homo Sapiens
VVDDAAVL

SEQ ID NO: 146606 - protein, 8 aa, Homo Sapiens
VVDEAVLV

SEQ ID NO: 146607 - protein, 8 aa, Homo Sapiens
VVDHQTEL

SEQ ID NO: 146608 - protein, 8 aa, Homo Sapiens
VVDIESRL

SEQ ID NO: 146609 - protein, 8 aa, Homo Sapiens
VVDIVQEL

SEQ ID NO: 146610 - protein, 8 aa, Homo Sapiens
VVDKAMEL

SEQ ID NO: 146611 - protein, 8 aa, Homo Sapiens
VVDNPIYL

SEQ ID NO: 146612 - protein, 8 aa, Homo Sapiens
VVDNPQKF

SEQ ID NO: 146613 - protein, 8 aa, Homo Sapiens
VVDQEQHL

SEQ ID NO: 146614 - protein, 8 aa, Homo Sapiens
VVDQPLKL

SEQ ID NO: 146615 - protein, 8 aa, Homo Sapiens
VVDVDVKL

SEQ ID NO: 146616 - protein, 8 aa, Homo Sapiens
VVDVSSHL

SEQ ID NO: 146617 - protein, 8 aa, Homo Sapiens
YADGESFL

SEQ ID NO: 146618 - protein, 8 aa, Homo Sapiens
YADRHAEL

SEQ ID NO: 146619 - protein, 8 aa, Homo Sapiens
YADTVTTV

SEQ ID NO: 146620 - protein, 8 aa, Homo Sapiens
YADVQAVL

SEQ ID NO: 146621 - protein, 8 aa, Homo Sapiens
YEDIAQKS

SEQ ID NO: 146622 - protein, 8 aa, Homo Sapiens
YFDEPVEL

SEQ ID NO: 146623 - protein, 8 aa, Homo Sapiens
YGDSAAKI

SEQ ID NO: 146624 - protein, 8 aa, Homo Sapiens
YIDKSTQL

SEQ ID NO: 146625 - protein, 8 aa, Homo Sapiens
YIDKTIRV

SEQ ID NO: 146626 - protein, 8 aa, Homo Sapiens
YLDKISEL

SEQ ID NO: 146627 - protein, 8 aa, Homo Sapiens
YLDSEQRL

SEQ ID NO: 146628 - protein, 8 aa, Homo Sapiens
YSDGEISI

SEQ ID NO: 146629 - protein, 8 aa, Homo Sapiens
YSDIVTTL

SEQ ID NO: 146630 - protein, 8 aa, Homo Sapiens
YSDRISEL

SEQ ID NO: 146631 - protein, 8 aa, Homo Sapiens
YSDSTAKL

SEQ ID NO: 146632 - protein, 8 aa, Homo Sapiens
YTDEAVVI

SEQ ID NO: 146633 - protein, 8 aa, Homo Sapiens
YTDELVEL

SEQ ID NO: 146634 - protein, 8 aa, Homo Sapiens
YTDLEVRV

SEQ ID NO: 146635 - protein, 8 aa, Homo Sapiens
YTDNLVRV

SEQ ID NO: 146636 - protein, 8 aa, Homo Sapiens
YVDDSIAL

SEQ ID NO: 146637 - protein, 8 aa, Homo Sapiens
YVDDTQFV

SEQ ID NO: 146638 - protein, 8 aa, Homo Sapiens
YVDFPQHL

SEQ ID NO: 146639 - protein, 9 aa, Homo Sapiens
AACGGHVEL

SEQ ID NO: 146640 - protein, 9 aa, Homo Sapiens
AADAEPLEI

SEQ ID NO: 146641 - protein, 9 aa, Homo Sapiens
AADAGFALF

SEQ ID NO: 146642 - protein, 9 aa, Homo Sapiens
AADAKPESL

SEQ ID NO: 146643 - protein, 9 aa, Homo Sapiens
AADDHTVKL

SEQ ID NO: 146644 - protein, 9 aa, Homo Sapiens
AADDIHRSL

SEQ ID NO: 146645 - protein, 9 aa, Homo Sapiens
AADDKEACF

SEQ ID NO: 146646 - protein, 9 aa, Homo Sapiens
AADDRLRIS

SEQ ID NO: 146647 - protein, 9 aa, Homo Sapiens
AADDRTVRI

SEQ ID NO: 146648 - protein, 9 aa, Homo Sapiens
AADDSKLVL

SEQ ID NO: 146649 - protein, 9 aa, Homo Sapiens
AADDSSVKL

SEQ ID NO: 146650 - protein, 9 aa, Homo Sapiens
AADDTEISF

SEQ ID NO: 146651 - protein, 9 aa, Homo Sapiens
AADEITHCI

SEQ ID NO: 146652 - protein, 9 aa, Homo Sapiens
AADEKSVSI

SEQ ID NO: 146653 - protein, 9 aa, Homo Sapiens
AADEPVTVL

SEQ ID NO: 146654 - protein, 9 aa, Homo Sapiens
AADEVLAVL

SEQ ID NO: 146655 - protein, 9 aa, Homo Sapiens
AADEVTAHL

SEQ ID NO: 146656 - protein, 9 aa, Homo Sapiens
AADFAQMEL

SEQ ID NO: 146657 - protein, 9 aa, Homo Sapiens
AADFEIGHF

SEQ ID NO: 146658 - protein, 9 aa, Homo Sapiens
AADGGPKLV

SEQ ID NO: 146659 - protein, 9 aa, Homo Sapiens
AADGKGVVV

SEQ ID NO: 146660 - protein, 9 aa, Homo Sapiens
AADGKLLKL

SEQ ID NO: 146661 - protein, 9 aa, Homo Sapiens
AADGPQKLL

SEQ ID NO: 146662 - protein, 9 aa, Homo Sapiens
AADGSVKLW

SEQ ID NO: 146663 - protein, 9 aa, Homo Sapiens
AADGVLSEV

SEQ ID NO: 146664 - protein, 9 aa, Homo Sapiens
AADHTGPKF

SEQ ID NO: 146665 - protein, 9 aa, Homo Sapiens
AADHTVYKL

SEQ ID NO: 146666 - protein, 9 aa, Homo Sapiens
AADIENRVL

SEQ ID NO: 146667 - protein, 9 aa, Homo Sapiens
AADKAIEKM

SEQ ID NO: 146668 - protein, 9 aa, Homo Sapiens
AADKGHYKF

SEQ ID NO: 146669 - protein, 9 aa, Homo Sapiens
AADKIHSSF

SEQ ID NO: 146670 - protein, 9 aa, Homo Sapiens
AADKRLTVL

SEQ ID NO: 146671 - protein, 9 aa, Homo Sapiens
AADKRPPKF

SEQ ID NO: 146672 - protein, 9 aa, Homo Sapiens
AADLGSPSL

SEQ ID NO: 146673 - protein, 9 aa, Homo Sapiens
AADLPARGF

SEQ ID NO: 146674 - protein, 9 aa, Homo Sapiens
AADLSLHSF

SEQ ID NO: 146675 - protein, 9 aa, Homo Sapiens
AADPEAPEI

SEQ ID NO: 146676 - protein, 9 aa, Homo Sapiens
AADPIITRW

SEQ ID NO: 146677 - protein, 9 aa, Homo Sapiens
AADPLASKL

SEQ ID NO: 146678 - protein, 9 aa, Homo Sapiens
AADPSVVNL

SEQ ID NO: 146679 - protein, 9 aa, Homo Sapiens
AADPVSPLL

SEQ ID NO: 146680 - protein, 9 aa, Homo Sapiens
AADQAKQLL

SEQ ID NO: 146681 - protein, 9 aa, Homo Sapiens
AADRCGAAL

SEQ ID NO: 146682 - protein, 9 aa, Homo Sapiens
AADRPGVSL

SEQ ID NO: 146683 - protein, 9 aa, Homo Sapiens
AADSAVRLW

SEQ ID NO: 146684 - protein, 9 aa, Homo Sapiens
AADSPGSGL

SEQ ID NO: 146685 - protein, 9 aa, Homo Sapiens
AADSPSQNL

SEQ ID NO: 146686 - protein, 9 aa, Homo Sapiens
AADTLVTKF

SEQ ID NO: 146687 - protein, 9 aa, Homo Sapiens
AAEAAAAVV

SEQ ID NO: 146688 - protein, 9 aa, Homo Sapiens
AAEAAEVIL

SEQ ID NO: 146689 - protein, 9 aa, Homo Sapiens
AAEATPVAL

SEQ ID NO: 146690 - protein, 9 aa, Homo Sapiens
AAEDKSWRV

SEQ ID NO: 146691 - protein, 9 aa, Homo Sapiens
AAEEANAVL

SEQ ID NO: 146692 - protein, 9 aa, Homo Sapiens
AAEEPLSLL

SEQ ID NO: 146693 - protein, 9 aa, Homo Sapiens
AAEEPNAAV

SEQ ID NO: 146694 - protein, 9 aa, Homo Sapiens
AAEEPVSEV

SEQ ID NO: 146695 - protein, 9 aa, Homo Sapiens
AAEEREASL

SEQ ID NO: 146696 - protein, 9 aa, Homo Sapiens
AAEFVPSFL

SEQ ID NO: 146697 - protein, 9 aa, Homo Sapiens
AAEKGDVGL

SEQ ID NO: 146698 - protein, 9 aa, Homo Sapiens
AAEKKVVKI

SEQ ID NO: 146699 - protein, 9 aa, Homo Sapiens
AAEKSITIL

SEQ ID NO: 146700 - protein, 9 aa, Homo Sapiens
AAEPHVVTV

SEQ ID NO: 146701 - protein, 9 aa, Homo Sapiens
AAEPTPTQV

SEQ ID NO: 146702 - protein, 9 aa, Homo Sapiens
AAEQKVTRL

SEQ ID NO: 146703 - protein, 9 aa, Homo Sapiens
AAEVAATEI

SEQ ID NO: 146704 - protein, 9 aa, Homo Sapiens
AAEYPAVKF

SEQ ID NO: 146705 - protein, 9 aa, Homo Sapiens
AAISQVDRL

SEQ ID NO: 146706 - protein, 9 aa, Homo Sapiens
AAPAYSRAL

SEQ ID NO: 146707 - protein, 9 aa, Homo Sapiens
AGDDAPRAV

SEQ ID NO: 146708 - protein, 9 aa, Homo Sapiens
AGDEGRVLL

SEQ ID NO: 146709 - protein, 9 aa, Homo Sapiens
AGDGEVTKI

SEQ ID NO: 146710 - protein, 9 aa, Homo Sapiens
AGDGGRVAL

SEQ ID NO: 146711 - protein, 9 aa, Homo Sapiens
AGDGPPRSF

SEQ ID NO: 146712 - protein, 9 aa, Homo Sapiens
AGDKPRTFL

SEQ ID NO: 146713 - protein, 9 aa, Homo Sapiens
AGDSPGSQF

SEQ ID NO: 146714 - protein, 9 aa, Homo Sapiens
AGDTTNFHF

SEQ ID NO: 146715 - protein, 9 aa, Homo Sapiens
AGDWRPSSI

SEQ ID NO: 146716 - protein, 9 aa, Homo Sapiens
AIDRAGAEV

SEQ ID NO: 146717 - protein, 9 aa, Homo Sapiens
AIDSPVSFL

SEQ ID NO: 146718 - protein, 9 aa, Homo Sapiens
AKDEPDTNL

SEQ ID NO: 146719 - protein, 9 aa, Homo Sapiens
AKEIDVSFV

SEQ ID NO: 146720 - protein, 9 aa, Homo Sapiens
ALDEAAAAL

SEQ ID NO: 146721 - protein, 9 aa, Homo Sapiens
ALDEPTTNL

SEQ ID NO: 146722 - protein, 9 aa, Homo Sapiens
ALDGDAVVL

SEQ ID NO: 146723 - protein, 9 aa, Homo Sapiens
ALDKATVLL

SEQ ID NO: 146724 - protein, 9 aa, Homo Sapiens
ALDSGVSTM

SEQ ID NO: 146725 - protein, 9 aa, Homo Sapiens
ALDVPHAEL

SEQ ID NO: 146726 - protein, 9 aa, Homo Sapiens
ALDVPNTML

SEQ ID NO: 146727 - protein, 9 aa, Homo Sapiens
AMDLVKNHL

SEQ ID NO: 146728 - protein, 9 aa, Homo Sapiens
ANDDPNGIF

SEQ ID NO: 146729 - protein, 9 aa, Homo Sapiens
AQDDPDSCL

SEQ ID NO: 146730 - protein, 9 aa, Homo Sapiens
AQDEHLITF

SEQ ID NO: 146731 - protein, 9 aa, Homo Sapiens
AQDLGVVNL

SEQ ID NO: 146732 - protein, 9 aa, Homo Sapiens
AQDPEIASL

SEQ ID NO: 146733 - protein, 9 aa, Homo Sapiens
AQDPVPSKL

SEQ ID NO: 146734 - protein, 9 aa, Homo Sapiens
ASDDGTVRI

SEQ ID NO: 146735 - protein, 9 aa, Homo Sapiens
ASDDGYIKI

SEQ ID NO: 146736 - protein, 9 aa, Homo Sapiens
ASDDHTVCL

SEQ ID NO: 146737 - protein, 9 aa, Homo Sapiens
ASDDKTVKL

SEQ ID NO: 146738 - protein, 9 aa, Homo Sapiens
ASDEGRVQM

SEQ ID NO: 146739 - protein, 9 aa, Homo Sapiens
ASDHAPHTL

SEQ ID NO: 146740 - protein, 9 aa, Homo Sapiens
ASDIAMTEL

SEQ ID NO: 146741 - protein, 9 aa, Homo Sapiens
ASDIPGLHL

SEQ ID NO: 146742 - protein, 9 aa, Homo Sapiens
ASDKETYEL

SEQ ID NO: 146743 - protein, 9 aa, Homo Sapiens
ASDPDEAKL

SEQ ID NO: 146744 - protein, 9 aa, Homo Sapiens
ASDPRIIRL

SEQ ID NO: 146745 - protein, 9 aa, Homo Sapiens
ASDPYQVHV

SEQ ID NO: 146746 - protein, 9 aa, Homo Sapiens
ASDQPSHSL

SEQ ID NO: 146747 - protein, 9 aa, Homo Sapiens
ASEDATIKV

SEQ ID NO: 146748 - protein, 9 aa, Homo Sapiens
ASEGKTVEV

SEQ ID NO: 146749 - protein, 9 aa, Homo Sapiens
ATDPRPCEV

SEQ ID NO: 146750 - protein, 9 aa, Homo Sapiens
AVDAVIAEL

SEQ ID NO: 146751 - protein, 9 aa, Homo Sapiens
AVDDGVNTF

SEQ ID NO: 146752 - protein, 9 aa, Homo Sapiens
AVDGNTVEL

SEQ ID NO: 146753 - protein, 9 aa, Homo Sapiens
AVDGRTVNL

SEQ ID NO: 146754 - protein, 9 aa, Homo Sapiens
AVDGSGTKF

SEQ ID NO: 146755 - protein, 9 aa, Homo Sapiens
AVDKTGRIL

SEQ ID NO: 146756 - protein, 9 aa, Homo Sapiens
AVDLGGTNL

SEQ ID NO: 146757 - protein, 9 aa, Homo Sapiens
AVDPNGAFL

SEQ ID NO: 146758 - protein, 9 aa, Homo Sapiens
AVDPQPSVV

SEQ ID NO: 146759 - protein, 9 aa, Homo Sapiens
AVDRAITHL

SEQ ID NO: 146760 - protein, 9 aa, Homo Sapiens
CAPRRKVAL

SEQ ID NO: 146761 - protein, 9 aa, Homo Sapiens
CSDEVTRQL

SEQ ID NO: 146762 - protein, 9 aa, Homo Sapiens
EIKDKTAEL

SEQ ID NO: 146763 - protein, 9 aa, Homo Sapiens
EKAQGPILL

SEQ ID NO: 146764 - protein, 9 aa, Homo Sapiens
EPSELPLPG

SEQ ID NO: 146765 - protein, 9 aa, Homo Sapiens
ESSPPGTTF

SEQ ID NO: 146766 - protein, 9 aa, Homo Sapiens
ETDPGMVHL

SEQ ID NO: 146767 - protein, 9 aa, Homo Sapiens
FADAVQELL

SEQ ID NO: 146768 - protein, 9 aa, Homo Sapiens
FADDPCSSV

SEQ ID NO: 146769 - protein, 9 aa, Homo Sapiens
FADENNEKL

SEQ ID NO: 146770 - protein, 9 aa, Homo Sapiens
FADGHVLEL

SEQ ID NO: 146771 - protein, 9 aa, Homo Sapiens
FADHVSSSL

SEQ ID NO: 146772 - protein, 9 aa, Homo Sapiens
FADKHIQVL

SEQ ID NO: 146773 - protein, 9 aa, Homo Sapiens
FADNDVSRF

SEQ ID NO: 146774 - protein, 9 aa, Homo Sapiens
FADQAEILL

SEQ ID NO: 146775 - protein, 9 aa, Homo Sapiens
FADQENQVA

SEQ ID NO: 146776 - protein, 9 aa, Homo Sapiens
FADQEVRSL

SEQ ID NO: 146777 - protein, 9 aa, Homo Sapiens
FADQVEEIL

SEQ ID NO: 146778 - protein, 9 aa, Homo Sapiens
FADREVQLL

SEQ ID NO: 146779 - protein, 9 aa, Homo Sapiens
FADVAPLQL

SEQ ID NO: 146780 - protein, 9 aa, Homo Sapiens
FADVEGKNL

SEQ ID NO: 146781 - protein, 9 aa, Homo Sapiens
FADYPCHTV

SEQ ID NO: 146782 - protein, 9 aa, Homo Sapiens
FAEAGRSTL

SEQ ID NO: 146783 - protein, 9 aa, Homo Sapiens
FAEAVKTVF

SEQ ID NO: 146784 - protein, 9 aa, Homo Sapiens
FAEDPPTSL

SEQ ID NO: 146785 - protein, 9 aa, Homo Sapiens
FAEEVGAAL

SEQ ID NO: 146786 - protein, 9 aa, Homo Sapiens
FAEHRPPKI

SEQ ID NO: 146787 - protein, 9 aa, Homo Sapiens
FAEKLSVKL

SEQ ID NO: 146788 - protein, 9 aa, Homo Sapiens
FAEMYVAKF

SEQ ID NO: 146789 - protein, 9 aa, Homo Sapiens
FAEPSSVSF

SEQ ID NO: 146790 - protein, 9 aa, Homo Sapiens
FAERSVAKL

SEQ ID NO: 146791 - protein, 9 aa, Homo Sapiens
FAERTVAKL

SEQ ID NO: 146792 - protein, 9 aa, Homo Sapiens
FAETHRTVL

SEQ ID NO: 146793 - protein, 9 aa, Homo Sapiens
FAIDPHLLL

SEQ ID NO: 146794 - protein, 9 aa, Homo Sapiens
FAIPLIEKL

SEQ ID NO: 146795 - protein, 9 aa, Homo Sapiens
FGDDIPSAL

SEQ ID NO: 146796 - protein, 9 aa, Homo Sapiens
FGDTGGFHF

SEQ ID NO: 146797 - protein, 9 aa, Homo Sapiens
FIDDANYSV

SEQ ID NO: 146798 - protein, 9 aa, Homo Sapiens
FIDEAGHCM

SEQ ID NO: 146799 - protein, 9 aa, Homo Sapiens
FIDGHFVEM

SEQ ID NO: 146800 - protein, 9 aa, Homo Sapiens
FIDKPVCFV

SEQ ID NO: 146801 - protein, 9 aa, Homo Sapiens
FIEEHATKL

SEQ ID NO: 146802 - protein, 9 aa, Homo Sapiens
FIEESRQLL

SEQ ID NO: 146803 - protein, 9 aa, Homo Sapiens
FIESAHTEL

SEQ ID NO: 146804 - protein, 9 aa, Homo Sapiens
FLDASGAKL

SEQ ID NO: 146805 - protein, 9 aa, Homo Sapiens
FLDEKTHEL

SEQ ID NO: 146806 - protein, 9 aa, Homo Sapiens
FLDENVHFF

SEQ ID NO: 146807 - protein, 9 aa, Homo Sapiens
FLDEPTNHL

SEQ ID NO: 146808 - protein, 9 aa, Homo Sapiens
FLDNGPKTI

SEQ ID NO: 146809 - protein, 9 aa, Homo Sapiens
FLDQHGHNL

SEQ ID NO: 146810 - protein, 9 aa, Homo Sapiens
FLDSEVSEL

SEQ ID NO: 146811 - protein, 9 aa, Homo Sapiens
FLDSTSPLL

SEQ ID NO: 146812 - protein, 9 aa, Homo Sapiens
FLEDHGLLV

SEQ ID NO: 146813 - protein, 9 aa, Homo Sapiens
FLEDSNVKL

SEQ ID NO: 146814 - protein, 9 aa, Homo Sapiens
FLEEHGPAM

SEQ ID NO: 146815 - protein, 9 aa, Homo Sapiens
FLEKESAIV

SEQ ID NO: 146816 - protein, 9 aa, Homo Sapiens
FQDDDQTRV

SEQ ID NO: 146817 - protein, 9 aa, Homo Sapiens
FQDFNPSKF

SEQ ID NO: 146818 - protein, 9 aa, Homo Sapiens
FQDGPKSYL

SEQ ID NO: 146819 - protein, 9 aa, Homo Sapiens
FQDKQVSRV

SEQ ID NO: 146820 - protein, 9 aa, Homo Sapiens
FQDPVPLTV

SEQ ID NO: 146821 - protein, 9 aa, Homo Sapiens
FQDSGLSRF

SEQ ID NO: 146822 - protein, 9 aa, Homo Sapiens
FQEADSPTL

SEQ ID NO: 146823 - protein, 9 aa, Homo Sapiens
FSDDSDLQL

SEQ ID NO: 146824 - protein, 9 aa, Homo Sapiens
FSDEIRHNL

SEQ ID NO: 146825 - protein, 9 aa, Homo Sapiens
FSDENVPRL

SEQ ID NO: 146826 - protein, 9 aa, Homo Sapiens
FSDKQMIKL

SEQ ID NO: 146827 - protein, 9 aa, Homo Sapiens
FSDLTMHEL

SEQ ID NO: 146828 - protein, 9 aa, Homo Sapiens
FSDSSGLTV

SEQ ID NO: 146829 - protein, 9 aa, Homo Sapiens
FSDSVKSTF

SEQ ID NO: 146830 - protein, 9 aa, Homo Sapiens
FSDTGNFGF

SEQ ID NO: 146831 - protein, 9 aa, Homo Sapiens
FSDTLKTYF

SEQ ID NO: 146832 - protein, 9 aa, Homo Sapiens
FSEEHPVLL

SEQ ID NO: 146833 - protein, 9 aa, Homo Sapiens
FSEETPVVL

SEQ ID NO: 146834 - protein, 9 aa, Homo Sapiens
FTDEESRVF

SEQ ID NO: 146835 - protein, 9 aa, Homo Sapiens
FTDGGPRTL

SEQ ID NO: 146836 - protein, 9 aa, Homo Sapiens
FTDGITNKL

SEQ ID NO: 146837 - protein, 9 aa, Homo Sapiens
FTDIGKVDF

SEQ ID NO: 146838 - protein, 9 aa, Homo Sapiens
FTEDHYVEF

SEQ ID NO: 146839 - protein, 9 aa, Homo Sapiens
FVDCPGHDI

SEQ ID NO: 146840 - protein, 9 aa, Homo Sapiens
FVDDQQTFF

SEQ ID NO: 146841 - protein, 9 aa, Homo Sapiens
FVDDYTVRV

SEQ ID NO: 146842 - protein, 9 aa, Homo Sapiens
FVDEGKATV

SEQ ID NO: 146843 - protein, 9 aa, Homo Sapiens
FVDGSAIQV

SEQ ID NO: 146844 - protein, 9 aa, Homo Sapiens
FVDLEPTVI

SEQ ID NO: 146845 - protein, 9 aa, Homo Sapiens
FVDPAQITM

SEQ ID NO: 146846 - protein, 9 aa, Homo Sapiens
FVDVQPSSL

SEQ ID NO: 146847 - protein, 9 aa, Homo Sapiens
FVEEEEHFL

SEQ ID NO: 146848 - protein, 9 aa, Homo Sapiens
FVEGRSVEF

SEQ ID NO: 146849 - protein, 9 aa, Homo Sapiens
FVEPSRQFV

SEQ ID NO: 146850 - protein, 9 aa, Homo Sapiens
GADDRLVKI

SEQ ID NO: 146851 - protein, 9 aa, Homo Sapiens
GADEAPPRL

SEQ ID NO: 146852 - protein, 9 aa, Homo Sapiens
GADEKVLRV

SEQ ID NO: 146853 - protein, 9 aa, Homo Sapiens
GADFLVTEV

SEQ ID NO: 146854 - protein, 9 aa, Homo Sapiens
GADIHSKEF

SEQ ID NO: 146855 - protein, 9 aa, Homo Sapiens
GADKNVVVF

SEQ ID NO: 146856 - protein, 9 aa, Homo Sapiens
GADLPNLLF

SEQ ID NO: 146857 - protein, 9 aa, Homo Sapiens
GADLPSNHV

SEQ ID NO: 146858 - protein, 9 aa, Homo Sapiens
GADNSVVRF

SEQ ID NO: 146859 - protein, 9 aa, Homo Sapiens
GADPNATTL

SEQ ID NO: 146860 - protein, 9 aa, Homo Sapiens
GADPSTVEM

SEQ ID NO: 146861 - protein, 9 aa, Homo Sapiens
GADSKTVKL

SEQ ID NO: 146862 - protein, 9 aa, Homo Sapiens
GDAVSPRQL

SEQ ID NO: 146863 - protein, 9 aa, Homo Sapiens
GIDSPVSEL

SEQ ID NO: 146864 - protein, 9 aa, Homo Sapiens
GIDSSSPEV

SEQ ID NO: 146865 - protein, 9 aa, Homo Sapiens
GSDDGTVKL

SEQ ID NO: 146866 - protein, 9 aa, Homo Sapiens
GSDPRVTQL

SEQ ID NO: 146867 - protein, 9 aa, Homo Sapiens
GSDPTVVSI

SEQ ID NO: 146868 - protein, 9 aa, Homo Sapiens
HADDFIQEM

SEQ ID NO: 146869 - protein, 9 aa, Homo Sapiens
HADDPERVV

SEQ ID NO: 146870 - protein, 9 aa, Homo Sapiens
HADGLCHRL

SEQ ID NO: 146871 - protein, 9 aa, Homo Sapiens
HADHIGQGF

SEQ ID NO: 146872 - protein, 9 aa, Homo Sapiens
HADHSSLTL

SEQ ID NO: 146873 - protein, 9 aa, Homo Sapiens
HADILLINL

SEQ ID NO: 146874 - protein, 9 aa, Homo Sapiens
HADIPETCV

SEQ ID NO: 146875 - protein, 9 aa, Homo Sapiens
HADPEPSVI

SEQ ID NO: 146876 - protein, 9 aa, Homo Sapiens
HADSNIVIM

SEQ ID NO: 146877 - protein, 9 aa, Homo Sapiens
HADVGVALL

SEQ ID NO: 146878 - protein, 9 aa, Homo Sapiens
HAMQFPAEL

SEQ ID NO: 146879 - protein, 9 aa, Homo Sapiens
HIDFGGTSV

SEQ ID NO: 146880 - protein, 9 aa, Homo Sapiens
HIDSGKTAL

SEQ ID NO: 146881 - protein, 9 aa, Homo Sapiens
HIDSGKTTL

SEQ ID NO: 146882 - protein, 9 aa, Homo Sapiens
HIDVITAEM

SEQ ID NO: 146883 - protein, 9 aa, Homo Sapiens
HLDDQMTLL

SEQ ID NO: 146884 - protein, 9 aa, Homo Sapiens
HLDEARTLL

SEQ ID NO: 146885 - protein, 9 aa, Homo Sapiens
HLDPGPIYM

SEQ ID NO: 146886 - protein, 9 aa, Homo Sapiens
HPDAPMSQV

SEQ ID NO: 146887 - protein, 9 aa, Homo Sapiens
HQDFPSVVL

SEQ ID NO: 146888 - protein, 9 aa, Homo Sapiens
HSEESQIYL

SEQ ID NO: 146889 - protein, 9 aa, Homo Sapiens
HTDDSALCM

SEQ ID NO: 146890 - protein, 9 aa, Homo Sapiens
HTDLPVSVF

SEQ ID NO: 146891 - protein, 9 aa, Homo Sapiens
HTDVADVLL

SEQ ID NO: 146892 - protein, 9 aa, Homo Sapiens
HTEEKPFEV

SEQ ID NO: 146893 - protein, 9 aa, Homo Sapiens
HVDGHLYEL

SEQ ID NO: 146894 - protein, 9 aa, Homo Sapiens
HVDGVAVTL

SEQ ID NO: 146895 - protein, 9 aa, Homo Sapiens
HVDTGNSYL

SEQ ID NO: 146896 - protein, 9 aa, Homo Sapiens
HVDTLVTKF

SEQ ID NO: 146897 - protein, 9 aa, Homo Sapiens
IADDADPRV

SEQ ID NO: 146898 - protein, 9 aa, Homo Sapiens
IADENGAYL

SEQ ID NO: 146899 - protein, 9 aa, Homo Sapiens
IADGGFTEL

SEQ ID NO: 146900 - protein, 9 aa, Homo Sapiens
IADGLPVAV

SEQ ID NO: 146901 - protein, 9 aa, Homo Sapiens
IADIHPIQV

SEQ ID NO: 146902 - protein, 9 aa, Homo Sapiens
IADIKRTVL

SEQ ID NO: 146903 - protein, 9 aa, Homo Sapiens
IADKTENTL

SEQ ID NO: 146904 - protein, 9 aa, Homo Sapiens
IADLMEEKF

SEQ ID NO: 146905 - protein, 9 aa, Homo Sapiens
IADLPSTQL

SEQ ID NO: 146906 - protein, 9 aa, Homo Sapiens
IADLVSKEL

SEQ ID NO: 146907 - protein, 9 aa, Homo Sapiens
IADPDQPVL

SEQ ID NO: 146908 - protein, 9 aa, Homo Sapiens
IADPNIAKL

SEQ ID NO: 146909 - protein, 9 aa, Homo Sapiens
IADPRGNTL

SEQ ID NO: 146910 - protein, 9 aa, Homo Sapiens
IADQEEVKV

SEQ ID NO: 146911 - protein, 9 aa, Homo Sapiens
IADRGAEYV

SEQ ID NO: 146912 - protein, 9 aa, Homo Sapiens
IADRLNVEF

SEQ ID NO: 146913 - protein, 9 aa, Homo Sapiens
IADRPPPVI

SEQ ID NO: 146914 - protein, 9 aa, Homo Sapiens
IADSNPMVV

SEQ ID NO: 146915 - protein, 9 aa, Homo Sapiens
IADTGANVV

SEQ ID NO: 146916 - protein, 9 aa, Homo Sapiens
IADVAPSAI

SEQ ID NO: 146917 - protein, 9 aa, Homo Sapiens
IAEAVRTTL

SEQ ID NO: 146918 - protein, 9 aa, Homo Sapiens
IAEDKTVVV

SEQ ID NO: 146919 - protein, 9 aa, Homo Sapiens
IAEDPKVFL

SEQ ID NO: 146920 - protein, 9 aa, Homo Sapiens
IAEEKGLVV

SEQ ID NO: 146921 - protein, 9 aa, Homo Sapiens
IAEETSSRL

SEQ ID NO: 146922 - protein, 9 aa, Homo Sapiens
IAEGGASRF

SEQ ID NO: 146923 - protein, 9 aa, Homo Sapiens
IAEGPETKI

SEQ ID NO: 146924 - protein, 9 aa, Homo Sapiens
IAESKSPEM

SEQ ID NO: 146925 - protein, 9 aa, Homo Sapiens
IGDEAATHL

SEQ ID NO: 146926 - protein, 9 aa, Homo Sapiens
IGDEGVSQL

SEQ ID NO: 146927 - protein, 9 aa, Homo Sapiens
IGDGRSPEF

SEQ ID NO: 146928 - protein, 9 aa, Homo Sapiens
IGDIHPSDL

SEQ ID NO: 146929 - protein, 9 aa, Homo Sapiens
IGDPNLEFV

SEQ ID NO: 146930 - protein, 9 aa, Homo Sapiens
IGDSRPPSF

SEQ ID NO: 146931 - protein, 9 aa, Homo Sapiens
IIDDGDSNL

SEQ ID NO: 146932 - protein, 9 aa, Homo Sapiens
IIDDNHAIV

SEQ ID NO: 146933 - protein, 9 aa, Homo Sapiens
IIDDPNLVV

SEQ ID NO: 146934 - protein, 9 aa, Homo Sapiens
IIDDSDSNL

SEQ ID NO: 146935 - protein, 9 aa, Homo Sapiens
IIDEKGPVM

SEQ ID NO: 146936 - protein, 9 aa, Homo Sapiens
IIDEVVNKF

SEQ ID NO: 146937 - protein, 9 aa, Homo Sapiens
IIDGKIFCV

SEQ ID NO: 146938 - protein, 9 aa, Homo Sapiens
IIDKEVSLM

SEQ ID NO: 146939 - protein, 9 aa, Homo Sapiens
IIDKSGSTI

SEQ ID NO: 146940 - protein, 9 aa, Homo Sapiens
IIDKSGSTV

SEQ ID NO: 146941 - protein, 9 aa, Homo Sapiens
IIDRAITSL

SEQ ID NO: 146942 - protein, 9 aa, Homo Sapiens
IIDRTNTTL

SEQ ID NO: 146943 - protein, 9 aa, Homo Sapiens
IIEADEVLL

SEQ ID NO: 146944 - protein, 9 aa, Homo Sapiens
IIEEHPPMI

SEQ ID NO: 146945 - protein, 9 aa, Homo Sapiens
ILDEPTNHL

SEQ ID NO: 146946 - protein, 9 aa, Homo Sapiens
ILDPHVVLL

SEQ ID NO: 146947 - protein, 9 aa, Homo Sapiens
ILLAIEEPV

SEQ ID NO: 146948 - protein, 9 aa, Homo Sapiens
INDAGEVRL

SEQ ID NO: 146949 - protein, 9 aa, Homo Sapiens
IQDEIRSVI

SEQ ID NO: 146950 - protein, 9 aa, Homo Sapiens
ISDAPVTGM

SEQ ID NO: 146951 - protein, 9 aa, Homo Sapiens
ISDDRLTVV

SEQ ID NO: 146952 - protein, 9 aa, Homo Sapiens
ISDEANSNF

SEQ ID NO: 146953 - protein, 9 aa, Homo Sapiens
ISDEGIAYL

SEQ ID NO: 146954 - protein, 9 aa, Homo Sapiens
ISDLAQHYL

SEQ ID NO: 146955 - protein, 9 aa, Homo Sapiens
ISDLGQHTL

SEQ ID NO: 146956 - protein, 9 aa, Homo Sapiens
ISDLSEHVF

SEQ ID NO: 146957 - protein, 9 aa, Homo Sapiens
ISDLVKVTL

SEQ ID NO: 146958 - protein, 9 aa, Homo Sapiens
ISDPYNVNL

SEQ ID NO: 146959 - protein, 9 aa, Homo Sapiens
ISDSADCSL

SEQ ID NO: 146960 - protein, 9 aa, Homo Sapiens
ISDTQRISL

SEQ ID NO: 146961 - protein, 9 aa, Homo Sapiens
ISDYAVKIV

SEQ ID NO: 146962 - protein, 9 aa, Homo Sapiens
ISDYTVTEI

SEQ ID NO: 146963 - protein, 9 aa, Homo Sapiens
ITDLPSEVL

SEQ ID NO: 146964 - protein, 9 aa, Homo Sapiens
ITDPDVVHI

SEQ ID NO: 146965 - protein, 9 aa, Homo Sapiens
ITDPEVVFV

SEQ ID NO: 146966 - protein, 9 aa, Homo Sapiens
ITDPSVIVM

SEQ ID NO: 146967 - protein, 9 aa, Homo Sapiens
ITDSTGTHL

SEQ ID NO: 146968 - protein, 9 aa, Homo Sapiens
ITSMLNPLI

SEQ ID NO: 146969 - protein, 9 aa, Homo Sapiens
IVDAVGTML

SEQ ID NO: 146970 - protein, 9 aa, Homo Sapiens
IVDDCGGAF

SEQ ID NO: 146971 - protein, 9 aa, Homo Sapiens
IVDDFGTHL

SEQ ID NO: 146972 - protein, 9 aa, Homo Sapiens
IVDDPEGFF

SEQ ID NO: 146973 - protein, 9 aa, Homo Sapiens
IVDEAIYYF

SEQ ID NO: 146974 - protein, 9 aa, Homo Sapiens
IVDEVNGLI

SEQ ID NO: 146975 - protein, 9 aa, Homo Sapiens
IVDGAVVKF

SEQ ID NO: 146976 - protein, 9 aa, Homo Sapiens
IVDHQNDSF

SEQ ID NO: 146977 - protein, 9 aa, Homo Sapiens
IVDIPGTSV

SEQ ID NO: 146978 - protein, 9 aa, Homo Sapiens
IVDKNGRLV

SEQ ID NO: 146979 - protein, 9 aa, Homo Sapiens
IVDKSGRTL

SEQ ID NO: 146980 - protein, 9 aa, Homo Sapiens
IVDPQNQTM

SEQ ID NO: 146981 - protein, 9 aa, Homo Sapiens
IVDPVDSTL

SEQ ID NO: 146982 - protein, 9 aa, Homo Sapiens
IVDQEGSLL

SEQ ID NO: 146983 - protein, 9 aa, Homo Sapiens
IVDRGSTNL

SEQ ID NO: 146984 - protein, 9 aa, Homo Sapiens
IVDRPVTLV

SEQ ID NO: 146985 - protein, 9 aa, Homo Sapiens
IVDSARSIL

SEQ ID NO: 146986 - protein, 9 aa, Homo Sapiens
IVDTPCNEM

SEQ ID NO: 146987 - protein, 9 aa, Homo Sapiens
KADDPYAHL

SEQ ID NO: 146988 - protein, 9 aa, Homo Sapiens
KADEDPALF

SEQ ID NO: 146989 - protein, 9 aa, Homo Sapiens
KADEGLASL

SEQ ID NO: 146990 - protein, 9 aa, Homo Sapiens
KADGKIMAL

SEQ ID NO: 146991 - protein, 9 aa, Homo Sapiens
KADGVPVYL

SEQ ID NO: 146992 - protein, 9 aa, Homo Sapiens
KADIIVSEL

SEQ ID NO: 146993 - protein, 9 aa, Homo Sapiens
KADIPSVAF

SEQ ID NO: 146994 - protein, 9 aa, Homo Sapiens
KADLESESF

SEQ ID NO: 146995 - protein, 9 aa, Homo Sapiens
KADMNVHLL

SEQ ID NO: 146996 - protein, 9 aa, Homo Sapiens
KADMTCRGF

SEQ ID NO: 146997 - protein, 9 aa, Homo Sapiens
KADNVGSAL

SEQ ID NO: 146998 - protein, 9 aa, Homo Sapiens
KADPQGPEL

SEQ ID NO: 146999 - protein, 9 aa, Homo Sapiens
KADSDGPEF

SEQ ID NO: 147000 - protein, 9 aa, Homo Sapiens
KADSINKPF

SEQ ID NO: 147001 - protein, 9 aa, Homo Sapiens
KADSVVVLL

SEQ ID NO: 147002 - protein, 9 aa, Homo Sapiens
KADTEEEFL

SEQ ID NO: 147003 - protein, 9 aa, Homo Sapiens
KADVEEEFL

SEQ ID NO: 147004 - protein, 9 aa, Homo Sapiens
KADVEGELL

SEQ ID NO: 147005 - protein, 9 aa, Homo Sapiens
KADVVISAF

SEQ ID NO: 147006 - protein, 9 aa, Homo Sapiens
KADVVPVTL

SEQ ID NO: 147007 - protein, 9 aa, Homo Sapiens
KAEEPPSQL

SEQ ID NO: 147008 - protein, 9 aa, Homo Sapiens
KAEEVVSFV

SEQ ID NO: 147009 - protein, 9 aa, Homo Sapiens
KAEGSEIRL

SEQ ID NO: 147010 - protein, 9 aa, Homo Sapiens
KAPEPEEEI

SEQ ID NO: 147011 - protein, 9 aa, Homo Sapiens
KGDPVIYSL

SEQ ID NO: 147012 - protein, 9 aa, Homo Sapiens
KHLDVVTLL

SEQ ID NO: 147013 - protein, 9 aa, Homo Sapiens
KIDDKPVKI

SEQ ID NO: 147014 - protein, 9 aa, Homo Sapiens
KIDEKTAEL

SEQ ID NO: 147015 - protein, 9 aa, Homo Sapiens
KLDETGNSL

SEQ ID NO: 147016 - protein, 9 aa, Homo Sapiens
KLDHVVTII

SEQ ID NO: 147017 - protein, 9 aa, Homo Sapiens
KLDVGNAEV

SEQ ID NO: 147018 - protein, 9 aa, Homo Sapiens
KNDEGVTLL

SEQ ID NO: 147019 - protein, 9 aa, Homo Sapiens
KNDIPSSYM

SEQ ID NO: 147020 - protein, 9 aa, Homo Sapiens
KQDPYLVNF

SEQ ID NO: 147021 - protein, 9 aa, Homo Sapiens
KSDDLVVDV

SEQ ID NO: 147022 - protein, 9 aa, Homo Sapiens
KSDERLTAF

SEQ ID NO: 147023 - protein, 9 aa, Homo Sapiens
KSDERPVHI

SEQ ID NO: 147024 - protein, 9 aa, Homo Sapiens
KSDEVTQEI

SEQ ID NO: 147025 - protein, 9 aa, Homo Sapiens
KSDHPGISI

SEQ ID NO: 147026 - protein, 9 aa, Homo Sapiens
KSDPSIVRL

SEQ ID NO: 147027 - protein, 9 aa, Homo Sapiens
KSDQALHSF

SEQ ID NO: 147028 - protein, 9 aa, Homo Sapiens
KSDSPAIQL

SEQ ID NO: 147029 - protein, 9 aa, Homo Sapiens
KTDGSVVKL

SEQ ID NO: 147030 - protein, 9 aa, Homo Sapiens
KTDTGIVTV

SEQ ID NO: 147031 - protein, 9 aa, Homo Sapiens
KTDVTVVRF

SEQ ID NO: 147032 - protein, 9 aa, Homo Sapiens
KTDVVVNSV

SEQ ID NO: 147033 - protein, 9 aa, Homo Sapiens
KVDEAVAVL

SEQ ID NO: 147034 - protein, 9 aa, Homo Sapiens
KVDELTTEI

SEQ ID NO: 147035 - protein, 9 aa, Homo Sapiens
LADAINTEF

SEQ ID NO: 147036 - protein, 9 aa, Homo Sapiens
LADCKASEV

SEQ ID NO: 147037 - protein, 9 aa, Homo Sapiens
LADDSVRSL

SEQ ID NO: 147038 - protein, 9 aa, Homo Sapiens
LADEAEVHL

SEQ ID NO: 147039 - protein, 9 aa, Homo Sapiens
LADEKVETV

SEQ ID NO: 147040 - protein, 9 aa, Homo Sapiens
LADERNELL

SEQ ID NO: 147041 - protein, 9 aa, Homo Sapiens
LADEVITVF

SEQ ID NO: 147042 - protein, 9 aa, Homo Sapiens
LADGADEHL

SEQ ID NO: 147043 - protein, 9 aa, Homo Sapiens
LADGLKVVL

SEQ ID NO: 147044 - protein, 9 aa, Homo Sapiens
LADGVPVAL

SEQ ID NO: 147045 - protein, 9 aa, Homo Sapiens
LADHAARQL

SEQ ID NO: 147046 - protein, 9 aa, Homo Sapiens
LADHPDAPM

SEQ ID NO: 147047 - protein, 9 aa, Homo Sapiens
LADIAQSQL

SEQ ID NO: 147048 - protein, 9 aa, Homo Sapiens
LADKGEIRV

SEQ ID NO: 147049 - protein, 9 aa, Homo Sapiens
LADKNSELF

SEQ ID NO: 147050 - protein, 9 aa, Homo Sapiens
LADKNVPNL

SEQ ID NO: 147051 - protein, 9 aa, Homo Sapiens
LADLHPDVF

SEQ ID NO: 147052 - protein, 9 aa, Homo Sapiens
LADLQNDEV

SEQ ID NO: 147053 - protein, 9 aa, Homo Sapiens
LADMHSTEI

SEQ ID NO: 147054 - protein, 9 aa, Homo Sapiens
LADNDEVKF

SEQ ID NO: 147055 - protein, 9 aa, Homo Sapiens
LADQGEIRV

SEQ ID NO: 147056 - protein, 9 aa, Homo Sapiens
LADQMISRI

SEQ ID NO: 147057 - protein, 9 aa, Homo Sapiens
LADRNVTVL

SEQ ID NO: 147058 - protein, 9 aa, Homo Sapiens
LADSKEIFL

SEQ ID NO: 147059 - protein, 9 aa, Homo Sapiens
LADSVGHHL

SEQ ID NO: 147060 - protein, 9 aa, Homo Sapiens
LADVDPMQL

SEQ ID NO: 147061 - protein, 9 aa, Homo Sapiens
LADVMSEQL

SEQ ID NO: 147062 - protein, 9 aa, Homo Sapiens
LAEAGVAVF

SEQ ID NO: 147063 - protein, 9 aa, Homo Sapiens
LAEDPKVTL

SEQ ID NO: 147064 - protein, 9 aa, Homo Sapiens
LAEDTRTEL

SEQ ID NO: 147065 - protein, 9 aa, Homo Sapiens
LAEIAKVEL

SEQ ID NO: 147066 - protein, 9 aa, Homo Sapiens
LAEKSTVHM

SEQ ID NO: 147067 - protein, 9 aa, Homo Sapiens
LGDDPTSSF

SEQ ID NO: 147068 - protein, 9 aa, Homo Sapiens
LIDEPSAYL

SEQ ID NO: 147069 - protein, 9 aa, Homo Sapiens
LIDKPNLQF

SEQ ID NO: 147070 - protein, 9 aa, Homo Sapiens
LIDLPGTEL

SEQ ID NO: 147071 - protein, 9 aa, Homo Sapiens
LIFKPDLTL

SEQ ID NO: 147072 - protein, 9 aa, Homo Sapiens
LLDGGVINL

SEQ ID NO: 147073 - protein, 9 aa, Homo Sapiens
LLDSSHSEL

SEQ ID NO: 147074 - protein, 9 aa, Homo Sapiens
LLDVPTAAV

SEQ ID NO: 147075 - protein, 9 aa, Homo Sapiens
LSDEEIVKF

SEQ ID NO: 147076 - protein, 9 aa, Homo Sapiens
LSDEHAGVI

SEQ ID NO: 147077 - protein, 9 aa, Homo Sapiens
LSDGVVVQV

SEQ ID NO: 147078 - protein, 9 aa, Homo Sapiens
LSDKDPPKL

SEQ ID NO: 147079 - protein, 9 aa, Homo Sapiens
LSDLALHFL

SEQ ID NO: 147080 - protein, 9 aa, Homo Sapiens
LSDLCGTVM

SEQ ID NO: 147081 - protein, 9 aa, Homo Sapiens
LSDLTGSLL

SEQ ID NO: 147082 - protein, 9 aa, Homo Sapiens
LSDPIVNTL

SEQ ID NO: 147083 - protein, 9 aa, Homo Sapiens
LSDPQVHTV

SEQ ID NO: 147084 - protein, 9 aa, Homo Sapiens
LSDRKKVTL

SEQ ID NO: 147085 - protein, 9 aa, Homo Sapiens
LSEQGDVKL

SEQ ID NO: 147086 - protein, 9 aa, Homo Sapiens
LTDDGRVFL

SEQ ID NO: 147087 - protein, 9 aa, Homo Sapiens
LTDHGDVKL

SEQ ID NO: 147088 - protein, 9 aa, Homo Sapiens
LTDLPSPSF

SEQ ID NO: 147089 - protein, 9 aa, Homo Sapiens
LTDPAIVKV

SEQ ID NO: 147090 - protein, 9 aa, Homo Sapiens
LTEEGVIKV

SEQ ID NO: 147091 - protein, 9 aa, Homo Sapiens
LVDGPCTQV

SEQ ID NO: 147092 - protein, 9 aa, Homo Sapiens
LVDKDSTFL

SEQ ID NO: 147093 - protein, 9 aa, Homo Sapiens
MADEAGLDL

SEQ ID NO: 147094 - protein, 9 aa, Homo Sapiens
MADKCSPTL

SEQ ID NO: 147095 - protein, 9 aa, Homo Sapiens
MADPEVQQI

SEQ ID NO: 147096 - protein, 9 aa, Homo Sapiens
MADRGEARL

SEQ ID NO: 147097 - protein, 9 aa, Homo Sapiens
MADSGHYCV

SEQ ID NO: 147098 - protein, 9 aa, Homo Sapiens
MADTFLEHM

SEQ ID NO: 147099 - protein, 9 aa, Homo Sapiens
MIDRDNSVF

SEQ ID NO: 147100 - protein, 9 aa, Homo Sapiens
MLDEPTNHL

SEQ ID NO: 147101 - protein, 9 aa, Homo Sapiens
MLDPLEVHL

SEQ ID NO: 147102 - protein, 9 aa, Homo Sapiens
MPDSAAALL

SEQ ID NO: 147103 - protein, 9 aa, Homo Sapiens
MTDDKITEV

SEQ ID NO: 147104 - protein, 9 aa, Homo Sapiens
MTDDKTTKI

SEQ ID NO: 147105 - protein, 9 aa, Homo Sapiens
MTDEKTTKI

SEQ ID NO: 147106 - protein, 9 aa, Homo Sapiens
MTDPEMVEV

SEQ ID NO: 147107 - protein, 9 aa, Homo Sapiens
MVDDRLVTM

SEQ ID NO: 147108 - protein, 9 aa, Homo Sapiens
MVDGKPVNL

SEQ ID NO: 147109 - protein, 9 aa, Homo Sapiens
MVDPFHTLF

SEQ ID NO: 147110 - protein, 9 aa, Homo Sapiens
MVDSKPVNL

SEQ ID NO: 147111 - protein, 9 aa, Homo Sapiens
NADAIVVKL

SEQ ID NO: 147112 - protein, 9 aa, Homo Sapiens
NADGKIISL

SEQ ID NO: 147113 - protein, 9 aa, Homo Sapiens
NADIAVVEM

SEQ ID NO: 147114 - protein, 9 aa, Homo Sapiens
NADISGMKV

SEQ ID NO: 147115 - protein, 9 aa, Homo Sapiens
NADKIRVKI

SEQ ID NO: 147116 - protein, 9 aa, Homo Sapiens
NADKLTVKF

SEQ ID NO: 147117 - protein, 9 aa, Homo Sapiens
NADLRPSKL

SEQ ID NO: 147118 - protein, 9 aa, Homo Sapiens
NADPILISL

SEQ ID NO: 147119 - protein, 9 aa, Homo Sapiens
NADPQAVTM

SEQ ID NO: 147120 - protein, 9 aa, Homo Sapiens
NADSATRLL

SEQ ID NO: 147121 - protein, 9 aa, Homo Sapiens
NADSSNTAL

SEQ ID NO: 147122 - protein, 9 aa, Homo Sapiens
NADSSVQLL

SEQ ID NO: 147123 - protein, 9 aa, Homo Sapiens
NADSVQAKV

SEQ ID NO: 147124 - protein, 9 aa, Homo Sapiens
NADTPVSKF

SEQ ID NO: 147125 - protein, 9 aa, Homo Sapiens
NADTVSSKL

SEQ ID NO: 147126 - protein, 9 aa, Homo Sapiens
NADVALVNF

SEQ ID NO: 147127 - protein, 9 aa, Homo Sapiens
NADVQERLL

SEQ ID NO: 147128 - protein, 9 aa, Homo Sapiens
NAEAKITKL

SEQ ID NO: 147129 - protein, 9 aa, Homo Sapiens
NAEQHVTQL

SEQ ID NO: 147130 - protein, 9 aa, Homo Sapiens
NAIEGGTQL

SEQ ID NO: 147131 - protein, 9 aa, Homo Sapiens
NGDFLPTRL

SEQ ID NO: 147132 - protein, 9 aa, Homo Sapiens
NIDEGPLAF

SEQ ID NO: 147133 - protein, 9 aa, Homo Sapiens
NIDFMPTIL

SEQ ID NO: 147134 - protein, 9 aa, Homo Sapiens
NIDVVGVSF

SEQ ID NO: 147135 - protein, 9 aa, Homo Sapiens
NLDGTVTEM

SEQ ID NO: 147136 - protein, 9 aa, Homo Sapiens
NLDQPPAFF

SEQ ID NO: 147137 - protein, 9 aa, Homo Sapiens
NMDCPNHGF

SEQ ID NO: 147138 - protein, 9 aa, Homo Sapiens
NMDSPGPML

SEQ ID NO: 147139 - protein, 9 aa, Homo Sapiens
NSDEHAVVI

SEQ ID NO: 147140 - protein, 9 aa, Homo Sapiens
NSDPYSVAL

SEQ ID NO: 147141 - protein, 9 aa, Homo Sapiens
NSDSLPHRL

SEQ ID NO: 147142 - protein, 9 aa, Homo Sapiens
NSDTHSSTF

SEQ ID NO: 147143 - protein, 9 aa, Homo Sapiens
NTDEPPMVF

SEQ ID NO: 147144 - protein, 9 aa, Homo Sapiens
NVDAGKSTL

SEQ ID NO: 147145 - protein, 9 aa, Homo Sapiens
NVDAKIAKL

SEQ ID NO: 147146 - protein, 9 aa, Homo Sapiens
NVDDPTGNF

SEQ ID NO: 147147 - protein, 9 aa, Homo Sapiens
NVDGHLYEL

SEQ ID NO: 147148 - protein, 9 aa, Homo Sapiens
NVDPDNVVL

SEQ ID NO: 147149 - protein, 9 aa, Homo Sapiens
NVDPDSVVL

SEQ ID NO: 147150 - protein, 9 aa, Homo Sapiens
NVDSGKSTL

SEQ ID NO: 147151 - protein, 9 aa, Homo Sapiens
NVDSLITRL

SEQ ID NO: 147152 - protein, 9 aa, Homo Sapiens
NVDTPVSTL

SEQ ID NO: 147153 - protein, 9 aa, Homo Sapiens
PAYHSSLMD

SEQ ID NO: 147154 - protein, 9 aa, Homo Sapiens
PIRLLAAAA

SEQ ID NO: 147155 - protein, 9 aa, Homo Sapiens
PSIVHRKCF

SEQ ID NO: 147156 - protein, 9 aa, Homo Sapiens
QADAPNPGL

SEQ ID NO: 147157 - protein, 9 aa, Homo Sapiens
QADAPNPSL

SEQ ID NO: 147158 - protein, 9 aa, Homo Sapiens
QADARQVVL

SEQ ID NO: 147159 - protein, 9 aa, Homo Sapiens
QADCAVLIV

SEQ ID NO: 147160 - protein, 9 aa, Homo Sapiens
QADEVIAIL

SEQ ID NO: 147161 - protein, 9 aa, Homo Sapiens
QADFEAHNI

SEQ ID NO: 147162 - protein, 9 aa, Homo Sapiens
QADFKPATL

SEQ ID NO: 147163 - protein, 9 aa, Homo Sapiens
QADGRVVLV

SEQ ID NO: 147164 - protein, 9 aa, Homo Sapiens
QADHFNTRL

SEQ ID NO: 147165 - protein, 9 aa, Homo Sapiens
QADPSAPCL

SEQ ID NO: 147166 - protein, 9 aa, Homo Sapiens
QADQEAKEL

SEQ ID NO: 147167 - protein, 9 aa, Homo Sapiens
QADSGRVLL

SEQ ID NO: 147168 - protein, 9 aa, Homo Sapiens
QADSQSPKL

SEQ ID NO: 147169 - protein, 9 aa, Homo Sapiens
QSDEDVIRL

SEQ ID NO: 147170 - protein, 9 aa, Homo Sapiens
QSDPSGAYF

SEQ ID NO: 147171 - protein, 9 aa, Homo Sapiens
QTDQPETVI

SEQ ID NO: 147172 - protein, 9 aa, Homo Sapiens
QTDVGITHF

SEQ ID NO: 147173 - protein, 9 aa, Homo Sapiens
RADAPVALV

SEQ ID NO: 147174 - protein, 9 aa, Homo Sapiens
RADDARQLF

SEQ ID NO: 147175 - protein, 9 aa, Homo Sapiens
RADDTFEAL

SEQ ID NO: 147176 - protein, 9 aa, Homo Sapiens
RADEDARMI

SEQ ID NO: 147177 - protein, 9 aa, Homo Sapiens
RADEKITNI

SEQ ID NO: 147178 - protein, 9 aa, Homo Sapiens
RADEVKSMF

SEQ ID NO: 147179 - protein, 9 aa, Homo Sapiens
RADGENTAF

SEQ ID NO: 147180 - protein, 9 aa, Homo Sapiens
RADGISSTF

SEQ ID NO: 147181 - protein, 9 aa, Homo Sapiens
RADIGAASL

SEQ ID NO: 147182 - protein, 9 aa, Homo Sapiens
RADKIASKL

SEQ ID NO: 147183 - protein, 9 aa, Homo Sapiens
RADKPWTRL

SEQ ID NO: 147184 - protein, 9 aa, Homo Sapiens
RADLIEVVM

SEQ ID NO: 147185 - protein, 9 aa, Homo Sapiens
RADLTYAEF

SEQ ID NO: 147186 - protein, 9 aa, Homo Sapiens
RADPEPPGL

SEQ ID NO: 147187 - protein, 9 aa, Homo Sapiens
RADQFEYVM

SEQ ID NO: 147188 - protein, 9 aa, Homo Sapiens
RADQQYECV

SEQ ID NO: 147189 - protein, 9 aa, Homo Sapiens
RADSVGKLV

SEQ ID NO: 147190 - protein, 9 aa, Homo Sapiens
RADTGHAFL

SEQ ID NO: 147191 - protein, 9 aa, Homo Sapiens
RAEEGFTQV

SEQ ID NO: 147192 - protein, 9 aa, Homo Sapiens
RAEELGQEL

SEQ ID NO: 147193 - protein, 9 aa, Homo Sapiens
RAEEREIKF

SEQ ID NO: 147194 - protein, 9 aa, Homo Sapiens
RAELHPVEL

SEQ ID NO: 147195 - protein, 9 aa, Homo Sapiens
RGDDGGASF

SEQ ID NO: 147196 - protein, 9 aa, Homo Sapiens
RGDDTPLHL

SEQ ID NO: 147197 - protein, 9 aa, Homo Sapiens
RGDGKVIKL

SEQ ID NO: 147198 - protein, 9 aa, Homo Sapiens
RIEKNPARL

SEQ ID NO: 147199 - protein, 9 aa, Homo Sapiens
RMDAGEVTL

SEQ ID NO: 147200 - protein, 9 aa, Homo Sapiens
RMDEEFTKI

SEQ ID NO: 147201 - protein, 9 aa, Homo Sapiens
RQDLTTLDV

SEQ ID NO: 147202 - protein, 9 aa, Homo Sapiens
RQDPFTVHM

SEQ ID NO: 147203 - protein, 9 aa, Homo Sapiens
RQDVATNLL

SEQ ID NO: 147204 - protein, 9 aa, Homo Sapiens
RSDELTRHF

SEQ ID NO: 147205 - protein, 9 aa, Homo Sapiens
RSDGEAELL

SEQ ID NO: 147206 - protein, 9 aa, Homo Sapiens
RSDLYAVEM

SEQ ID NO: 147207 - protein, 9 aa, Homo Sapiens
RSDPGHYSF

SEQ ID NO: 147208 - protein, 9 aa, Homo Sapiens
RTDDKVIRF

SEQ ID NO: 147209 - protein, 9 aa, Homo Sapiens
RTDGKVFQF

SEQ ID NO: 147210 - protein, 9 aa, Homo Sapiens
RTDPVPVTI

SEQ ID NO: 147211 - protein, 9 aa, Homo Sapiens
RTDVPGELL

SEQ ID NO: 147212 - protein, 9 aa, Homo Sapiens
RTEEQPMEV

SEQ ID NO: 147213 - protein, 9 aa, Homo Sapiens
RVDAQPVKV

SEQ ID NO: 147214 - protein, 9 aa, Homo Sapiens
RVDAVASKV

SEQ ID NO: 147215 - protein, 9 aa, Homo Sapiens
RVDDPQDVF

SEQ ID NO: 147216 - protein, 9 aa, Homo Sapiens
RVDDVYSVL

SEQ ID NO: 147217 - protein, 9 aa, Homo Sapiens
RVDEEPTTL

SEQ ID NO: 147218 - protein, 9 aa, Homo Sapiens
RVDKNAPTV

SEQ ID NO: 147219 - protein, 9 aa, Homo Sapiens
RVDKQSALM

SEQ ID NO: 147220 - protein, 9 aa, Homo Sapiens
RVDNLAVVM

SEQ ID NO: 147221 - protein, 9 aa, Homo Sapiens
SADARSFEM

SEQ ID NO: 147222 - protein, 9 aa, Homo Sapiens
SADATPLHV

SEQ ID NO: 147223 - protein, 9 aa, Homo Sapiens
SADDKTVRL

SEQ ID NO: 147224 - protein, 9 aa, Homo Sapiens
SADDRCKVL

SEQ ID NO: 147225 - protein, 9 aa, Homo Sapiens
SADDWSEHI

SEQ ID NO: 147226 - protein, 9 aa, Homo Sapiens
SADEAHGLL

SEQ ID NO: 147227 - protein, 9 aa, Homo Sapiens
SADEGQTVF

SEQ ID NO: 147228 - protein, 9 aa, Homo Sapiens
SADELVTRI

SEQ ID NO: 147229 - protein, 9 aa, Homo Sapiens
SADEPMTTF

SEQ ID NO: 147230 - protein, 9 aa, Homo Sapiens
SADERILVI

SEQ ID NO: 147231 - protein, 9 aa, Homo Sapiens
SADEVMRFF

SEQ ID NO: 147232 - protein, 9 aa, Homo Sapiens
SADEVQRFF

SEQ ID NO: 147233 - protein, 9 aa, Homo Sapiens
SADFETVRM

SEQ ID NO: 147234 - protein, 9 aa, Homo Sapiens
SADFPALVV

SEQ ID NO: 147235 - protein, 9 aa, Homo Sapiens
SADFSPAFL

SEQ ID NO: 147236 - protein, 9 aa, Homo Sapiens
SADFTSENF

SEQ ID NO: 147237 - protein, 9 aa, Homo Sapiens
SADGARIMV

SEQ ID NO: 147238 - protein, 9 aa, Homo Sapiens
SADGKTITV

SEQ ID NO: 147239 - protein, 9 aa, Homo Sapiens
SADHLAHEV

SEQ ID NO: 147240 - protein, 9 aa, Homo Sapiens
SADHPVIKV

SEQ ID NO: 147241 - protein, 9 aa, Homo Sapiens
SADISLERL

SEQ ID NO: 147242 - protein, 9 aa, Homo Sapiens
SADKFQVLL

SEQ ID NO: 147243 - protein, 9 aa, Homo Sapiens
SADKGSLEV

SEQ ID NO: 147244 - protein, 9 aa, Homo Sapiens
SADKPDSVL

SEQ ID NO: 147245 - protein, 9 aa, Homo Sapiens
SADKPLSNM

SEQ ID NO: 147246 - protein, 9 aa, Homo Sapiens
SADKTVRVY

SEQ ID NO: 147247 - protein, 9 aa, Homo Sapiens
SADLIIQEF

SEQ ID NO: 147248 - protein, 9 aa, Homo Sapiens
SADLPESTL

SEQ ID NO: 147249 - protein, 9 aa, Homo Sapiens
SADMSHVAL

SEQ ID NO: 147250 - protein, 9 aa, Homo Sapiens
SADPNVVDL

SEQ ID NO: 147251 - protein, 9 aa, Homo Sapiens
SADPRPLAV

SEQ ID NO: 147252 - protein, 9 aa, Homo Sapiens
SADQAVAEL

SEQ ID NO: 147253 - protein, 9 aa, Homo Sapiens
SADQKTTLL

SEQ ID NO: 147254 - protein, 9 aa, Homo Sapiens
SADQSPSAL

SEQ ID NO: 147255 - protein, 9 aa, Homo Sapiens
SADQVTRAL

SEQ ID NO: 147256 - protein, 9 aa, Homo Sapiens
SADRFVTLL

SEQ ID NO: 147257 - protein, 9 aa, Homo Sapiens
SADSANDGF

SEQ ID NO: 147258 - protein, 9 aa, Homo Sapiens
SADSKPIDV

SEQ ID NO: 147259 - protein, 9 aa, Homo Sapiens
SADSKVLLF

SEQ ID NO: 147260 - protein, 9 aa, Homo Sapiens
SADSQRVVF

SEQ ID NO: 147261 - protein, 9 aa, Homo Sapiens
SADSRIAEL

SEQ ID NO: 147262 - protein, 9 aa, Homo Sapiens
SADSRIVKM

SEQ ID NO: 147263 - protein, 9 aa, Homo Sapiens
SADTFTRNL

SEQ ID NO: 147264 - protein, 9 aa, Homo Sapiens
SADTPEASL

SEQ ID NO: 147265 - protein, 9 aa, Homo Sapiens
SADTVVIFD

SEQ ID NO: 147266 - protein, 9 aa, Homo Sapiens
SADVAAVVM

SEQ ID NO: 147267 - protein, 9 aa, Homo Sapiens
SADVATPKM

SEQ ID NO: 147268 - protein, 9 aa, Homo Sapiens
SADVKEVLL

SEQ ID NO: 147269 - protein, 9 aa, Homo Sapiens
SADVRCSVF

SEQ ID NO: 147270 - protein, 9 aa, Homo Sapiens
SADVRQGEF

SEQ ID NO: 147271 - protein, 9 aa, Homo Sapiens
SAEAEASRL

SEQ ID NO: 147272 - protein, 9 aa, Homo Sapiens
SAEAVGVKI

SEQ ID NO: 147273 - protein, 9 aa, Homo Sapiens
SAEAVTTTL

SEQ ID NO: 147274 - protein, 9 aa, Homo Sapiens
SAEEMVTLL

SEQ ID NO: 147275 - protein, 9 aa, Homo Sapiens
SAEEVIVKL

SEQ ID NO: 147276 - protein, 9 aa, Homo Sapiens
SAEGHVTMF

SEQ ID NO: 147277 - protein, 9 aa, Homo Sapiens
SAEKAPVSV

SEQ ID NO: 147278 - protein, 9 aa, Homo Sapiens
SAEPKIMKV

SEQ ID NO: 147279 - protein, 9 aa, Homo Sapiens
SAEQAKVVL

SEQ ID NO: 147280 - protein, 9 aa, Homo Sapiens
SAESKTIEF

SEQ ID NO: 147281 - protein, 9 aa, Homo Sapiens
SDESLGIVI

SEQ ID NO: 147282 - protein, 9 aa, Homo Sapiens
SGDDGCVRL

SEQ ID NO: 147283 - protein, 9 aa, Homo Sapiens
SGDGVTHTV

SEQ ID NO: 147284 - protein, 9 aa, Homo Sapiens
SGDPKVIEV

SEQ ID NO: 147285 - protein, 9 aa, Homo Sapiens
SIDDLPTVL

SEQ ID NO: 147286 - protein, 9 aa, Homo Sapiens
SIDDVDSKL

SEQ ID NO: 147287 - protein, 9 aa, Homo Sapiens
SIDFGKTVV

SEQ ID NO: 147288 - protein, 9 aa, Homo Sapiens
SIDFKPSEI

SEQ ID NO: 147289 - protein, 9 aa, Homo Sapiens
SIDFPLTKV

SEQ ID NO: 147290 - protein, 9 aa, Homo Sapiens
SIDKAVTKL

SEQ ID NO: 147291 - protein, 9 aa, Homo Sapiens
SIDKKISRL

SEQ ID NO: 147292 - protein, 9 aa, Homo Sapiens
SIDKTGENF

SEQ ID NO: 147293 - protein, 9 aa, Homo Sapiens
SIDPVPTSI

SEQ ID NO: 147294 - protein, 9 aa, Homo Sapiens
SIDRNPPQL

SEQ ID NO: 147295 - protein, 9 aa, Homo Sapiens
SIDSEPALV

SEQ ID NO: 147296 - protein, 9 aa, Homo Sapiens
SIDTHGETF

SEQ ID NO: 147297 - protein, 9 aa, Homo Sapiens
SIDVGYERF

SEQ ID NO: 147298 - protein, 9 aa, Homo Sapiens
SLDDSCSQL

SEQ ID NO: 147299 - protein, 9 aa, Homo Sapiens
SLDIPATYL

SEQ ID NO: 147300 - protein, 9 aa, Homo Sapiens
SLDLPHSEL

SEQ ID NO: 147301 - protein, 9 aa, Homo Sapiens
SLDQPGGTL

SEQ ID NO: 147302 - protein, 9 aa, Homo Sapiens
SLDQPTQTV

SEQ ID NO: 147303 - protein, 9 aa, Homo Sapiens
SLDRPFTNL

SEQ ID NO: 147304 - protein, 9 aa, Homo Sapiens
SMDPLPVFL

SEQ ID NO: 147305 - protein, 9 aa, Homo Sapiens
SNDPDVIKL

SEQ ID NO: 147306 - protein, 9 aa, Homo Sapiens
SQDAKPTCL

SEQ ID NO: 147307 - protein, 9 aa, Homo Sapiens
SQDPGAVVL

SEQ ID NO: 147308 - protein, 9 aa, Homo Sapiens
SQDPGTHVV

SEQ ID NO: 147309 - protein, 9 aa, Homo Sapiens
SSDDGRVLI

SEQ ID NO: 147310 - protein, 9 aa, Homo Sapiens
SSDDGTVKI

SEQ ID NO: 147311 - protein, 9 aa, Homo Sapiens
SSDEPMTTF

SEQ ID NO: 147312 - protein, 9 aa, Homo Sapiens
SSDGHEFIV

SEQ ID NO: 147313 - protein, 9 aa, Homo Sapiens
SSDLPGGEF

SEQ ID NO: 147314 - protein, 9 aa, Homo Sapiens
SSDPKVLTL

SEQ ID NO: 147315 - protein, 9 aa, Homo Sapiens
SSDPMLSEF

SEQ ID NO: 147316 - protein, 9 aa, Homo Sapiens
SSDSSPPEV

SEQ ID NO: 147317 - protein, 9 aa, Homo Sapiens
SSDSTHVTF

SEQ ID NO: 147318 - protein, 9 aa, Homo Sapiens
SSDTGKVKL

SEQ ID NO: 147319 - protein, 9 aa, Homo Sapiens
STDEEVTSL

SEQ ID NO: 147320 - protein, 9 aa, Homo Sapiens
STDFPSTSI

SEQ ID NO: 147321 - protein, 9 aa, Homo Sapiens
STDNGRIFL

SEQ ID NO: 147322 - protein, 9 aa, Homo Sapiens
STDPAAPNL

SEQ ID NO: 147323 - protein, 9 aa, Homo Sapiens
STDQVGEFF

SEQ ID NO: 147324 - protein, 9 aa, Homo Sapiens
STDSRPVSV

SEQ ID NO: 147325 - protein, 9 aa, Homo Sapiens
STDVCGTKL

SEQ ID NO: 147326 - protein, 9 aa, Homo Sapiens
STDYETHEF

SEQ ID NO: 147327 - protein, 9 aa, Homo Sapiens
SVDAHTAEV

SEQ ID NO: 147328 - protein, 9 aa, Homo Sapiens
SVDETTQAM

SEQ ID NO: 147329 - protein, 9 aa, Homo Sapiens
SVDGDTRMV

SEQ ID NO: 147330 - protein, 9 aa, Homo Sapiens
SVDKPGIVV

SEQ ID NO: 147331 - protein, 9 aa, Homo Sapiens
SVDPAGVTM

SEQ ID NO: 147332 - protein, 9 aa, Homo Sapiens
SVDSKPPVI

SEQ ID NO: 147333 - protein, 9 aa, Homo Sapiens
SVDTRCSSL

SEQ ID NO: 147334 - protein, 9 aa, Homo Sapiens
SVDVTNTTF

SEQ ID NO: 147335 - protein, 9 aa, Homo Sapiens
SVDWPESSL

SEQ ID NO: 147336 - protein, 9 aa, Homo Sapiens
TADAFIVRF

SEQ ID NO: 147337 - protein, 9 aa, Homo Sapiens
TADAMNREV

SEQ ID NO: 147338 - protein, 9 aa, Homo Sapiens
TADCPGHGL

SEQ ID NO: 147339 - protein, 9 aa, Homo Sapiens
TADDKKLQF

SEQ ID NO: 147340 - protein, 9 aa, Homo Sapiens
TADDPSLSL

SEQ ID NO: 147341 - protein, 9 aa, Homo Sapiens
TADEFYSTM

SEQ ID NO: 147342 - protein, 9 aa, Homo Sapiens
TADEIQNTL

SEQ ID NO: 147343 - protein, 9 aa, Homo Sapiens
TADEVHYFL

SEQ ID NO: 147344 - protein, 9 aa, Homo Sapiens
TADFPPSKL

SEQ ID NO: 147345 - protein, 9 aa, Homo Sapiens
TADGAHFEL

SEQ ID NO: 147346 - protein, 9 aa, Homo Sapiens
TADGGQISL

SEQ ID NO: 147347 - protein, 9 aa, Homo Sapiens
TADGRVVKL

SEQ ID NO: 147348 - protein, 9 aa, Homo Sapiens
TADHGPPRL

SEQ ID NO: 147349 - protein, 9 aa, Homo Sapiens
TADIPALFL

SEQ ID NO: 147350 - protein, 9 aa, Homo Sapiens
TADISDVWL

SEQ ID NO: 147351 - protein, 9 aa, Homo Sapiens
TADKQSVHI

SEQ ID NO: 147352 - protein, 9 aa, Homo Sapiens
TADLDITEI

SEQ ID NO: 147353 - protein, 9 aa, Homo Sapiens
TADPLDYRL

SEQ ID NO: 147354 - protein, 9 aa, Homo Sapiens
TADRIPIAV

SEQ ID NO: 147355 - protein, 9 aa, Homo Sapiens
TADRWRVSL

SEQ ID NO: 147356 - protein, 9 aa, Homo Sapiens
TADSQPPVF

SEQ ID NO: 147357 - protein, 9 aa, Homo Sapiens
TADTKIQRM

SEQ ID NO: 147358 - protein, 9 aa, Homo Sapiens
TADTLFQEV

SEQ ID NO: 147359 - protein, 9 aa, Homo Sapiens
TADTSKVSL

SEQ ID NO: 147360 - protein, 9 aa, Homo Sapiens
TADVKASVL

SEQ ID NO: 147361 - protein, 9 aa, Homo Sapiens
TADVSHTNL

SEQ ID NO: 147362 - protein, 9 aa, Homo Sapiens
TAEHPGTRL

SEQ ID NO: 147363 - protein, 9 aa, Homo Sapiens
TAELDPHIL

SEQ ID NO: 147364 - protein, 9 aa, Homo Sapiens
TGDVPHTSV

SEQ ID NO: 147365 - protein, 9 aa, Homo Sapiens
TIDADAPEL

SEQ ID NO: 147366 - protein, 9 aa, Homo Sapiens
TIDCGLVRL

SEQ ID NO: 147367 - protein, 9 aa, Homo Sapiens
TIDDTISKF

SEQ ID NO: 147368 - protein, 9 aa, Homo Sapiens
TIDESLSEL

SEQ ID NO: 147369 - protein, 9 aa, Homo Sapiens
TIDGQQTII

SEQ ID NO: 147370 - protein, 9 aa, Homo Sapiens
TIDPIPHQL

SEQ ID NO: 147371 - protein, 9 aa, Homo Sapiens
TIDTENSTV

SEQ ID NO: 147372 - protein, 9 aa, Homo Sapiens
TIEDGIFEV

SEQ ID NO: 147373 - protein, 9 aa, Homo Sapiens
TLDAGNIKL

SEQ ID NO: 147374 - protein, 9 aa, Homo Sapiens
TQDELRSLF

SEQ ID NO: 147375 - protein, 9 aa, Homo Sapiens
TQDLPGVKL

SEQ ID NO: 147376 - protein, 9 aa, Homo Sapiens
TSDAQPHAF

SEQ ID NO: 147377 - protein, 9 aa, Homo Sapiens
TSDDVAKEF

SEQ ID NO: 147378 - protein, 9 aa, Homo Sapiens
TSDEQNHLV

SEQ ID NO: 147379 - protein, 9 aa, Homo Sapiens
TSDLPSSKV

SEQ ID NO: 147380 - protein, 9 aa, Homo Sapiens
TSDMGSYAL

SEQ ID NO: 147381 - protein, 9 aa, Homo Sapiens
TSDNPVVQL

SEQ ID NO: 147382 - protein, 9 aa, Homo Sapiens
TSDPAEVLV

SEQ ID NO: 147383 - protein, 9 aa, Homo Sapiens
TSDPALNHV

SEQ ID NO: 147384 - protein, 9 aa, Homo Sapiens
TSDPNAVVM

SEQ ID NO: 147385 - protein, 9 aa, Homo Sapiens
TTDPKLAHM

SEQ ID NO: 147386 - protein, 9 aa, Homo Sapiens
TVDADDVRL

SEQ ID NO: 147387 - protein, 9 aa, Homo Sapiens
TVDDPYATF

SEQ ID NO: 147388 - protein, 9 aa, Homo Sapiens
TVDGPSGKL

SEQ ID NO: 147389 - protein, 9 aa, Homo Sapiens
TVDGSPHEL

SEQ ID NO: 147390 - protein, 9 aa, Homo Sapiens
TVDTPHGIF

SEQ ID NO: 147391 - protein, 9 aa, Homo Sapiens
VADAFLSKF

SEQ ID NO: 147392 - protein, 9 aa, Homo Sapiens
VADAIRTSL

SEQ ID NO: 147393 - protein, 9 aa, Homo Sapiens
VADAVTYQL

SEQ ID NO: 147394 - protein, 9 aa, Homo Sapiens
VADDPIVMV

SEQ ID NO: 147395 - protein, 9 aa, Homo Sapiens
VADDQKLMI

SEQ ID NO: 147396 - protein, 9 aa, Homo Sapiens
VADDTPVLL

SEQ ID NO: 147397 - protein, 9 aa, Homo Sapiens
VADEAGQRL

SEQ ID NO: 147398 - protein, 9 aa, Homo Sapiens
VADEDSVKV

SEQ ID NO: 147399 - protein, 9 aa, Homo Sapiens
VADEELVHL

SEQ ID NO: 147400 - protein, 9 aa, Homo Sapiens
VADEGICYL

SEQ ID NO: 147401 - protein, 9 aa, Homo Sapiens
VADELVAEF

SEQ ID NO: 147402 - protein, 9 aa, Homo Sapiens
VADEMDVML

SEQ ID NO: 147403 - protein, 9 aa, Homo Sapiens
VADEQNRAL

SEQ ID NO: 147404 - protein, 9 aa, Homo Sapiens
VADEQQRLM

SEQ ID NO: 147405 - protein, 9 aa, Homo Sapiens
VADFGSATF

SEQ ID NO: 147406 - protein, 9 aa, Homo Sapiens
VADGLFSKF

SEQ ID NO: 147407 - protein, 9 aa, Homo Sapiens
VADGLITTL

SEQ ID NO: 147408 - protein, 9 aa, Homo Sapiens
VADGLVTTL

SEQ ID NO: 147409 - protein, 9 aa, Homo Sapiens
VADGPAVEV

SEQ ID NO: 147410 - protein, 9 aa, Homo Sapiens
VADGYPVRL

SEQ ID NO: 147411 - protein, 9 aa, Homo Sapiens
VADHPGIDF

SEQ ID NO: 147412 - protein, 9 aa, Homo Sapiens
VADIDGSTF

SEQ ID NO: 147413 - protein, 9 aa, Homo Sapiens
VADKDHPKF

SEQ ID NO: 147414 - protein, 9 aa, Homo Sapiens
VADKDTVLL

SEQ ID NO: 147415 - protein, 9 aa, Homo Sapiens
VADLQLIDF

SEQ ID NO: 147416 - protein, 9 aa, Homo Sapiens
VADLREAIL

SEQ ID NO: 147417 - protein, 9 aa, Homo Sapiens
VADLTGELM

SEQ ID NO: 147418 - protein, 9 aa, Homo Sapiens
VADMAAYQL

SEQ ID NO: 147419 - protein, 9 aa, Homo Sapiens
VADMVKQFF

SEQ ID NO: 147420 - protein, 9 aa, Homo Sapiens
VADPDNPLV

SEQ ID NO: 147421 - protein, 9 aa, Homo Sapiens
VADPIIYVL

SEQ ID NO: 147422 - protein, 9 aa, Homo Sapiens
VADPPIARL

SEQ ID NO: 147423 - protein, 9 aa, Homo Sapiens
VADPVEAVL

SEQ ID NO: 147424 - protein, 9 aa, Homo Sapiens
VADPVYRTF

SEQ ID NO: 147425 - protein, 9 aa, Homo Sapiens
VADPYVVIM

SEQ ID NO: 147426 - protein, 9 aa, Homo Sapiens
VADQIVTKL

SEQ ID NO: 147427 - protein, 9 aa, Homo Sapiens
VADRLGLEL

SEQ ID NO: 147428 - protein, 9 aa, Homo Sapiens
VADRLLVEL

SEQ ID NO: 147429 - protein, 9 aa, Homo Sapiens
VADSGSNQL

SEQ ID NO: 147430 - protein, 9 aa, Homo Sapiens
VADSTPAHF

SEQ ID NO: 147431 - protein, 9 aa, Homo Sapiens
VADTFQDYF

SEQ ID NO: 147432 - protein, 9 aa, Homo Sapiens
VADTVARVL

SEQ ID NO: 147433 - protein, 9 aa, Homo Sapiens
VADTVYRAL

SEQ ID NO: 147434 - protein, 9 aa, Homo Sapiens
VADVVVSRW

SEQ ID NO: 147435 - protein, 9 aa, Homo Sapiens
VADYEATTF

SEQ ID NO: 147436 - protein, 9 aa, Homo Sapiens
VAEAGGGQL

SEQ ID NO: 147437 - protein, 9 aa, Homo Sapiens
VAEERGAVL

SEQ ID NO: 147438 - protein, 9 aa, Homo Sapiens
VAEGPGAEL

SEQ ID NO: 147439 - protein, 9 aa, Homo Sapiens
VAEHHVATL

SEQ ID NO: 147440 - protein, 9 aa, Homo Sapiens
VAEQPPLKL

SEQ ID NO: 147441 - protein, 9 aa, Homo Sapiens
VAESAVSKL

SEQ ID NO: 147442 - protein, 9 aa, Homo Sapiens
VAETHIVLL

SEQ ID NO: 147443 - protein, 9 aa, Homo Sapiens
VAETPDIKL

SEQ ID NO: 147444 - protein, 9 aa, Homo Sapiens
VGDEGAGHF

SEQ ID NO: 147445 - protein, 9 aa, Homo Sapiens
VGDGYVVHL

SEQ ID NO: 147446 - protein, 9 aa, Homo Sapiens
VGDIPGVRF

SEQ ID NO: 147447 - protein, 9 aa, Homo Sapiens
VGDKPVNNF

SEQ ID NO: 147448 - protein, 9 aa, Homo Sapiens
VGDKPVSNF

SEQ ID NO: 147449 - protein, 9 aa, Homo Sapiens
VGDPHTVTV

SEQ ID NO: 147450 - protein, 9 aa, Homo Sapiens
VGDPSTTNL

SEQ ID NO: 147451 - protein, 9 aa, Homo Sapiens
VGDTQVVVF

SEQ ID NO: 147452 - protein, 9 aa, Homo Sapiens
VIDGHIYAV

SEQ ID NO: 147453 - protein, 9 aa, Homo Sapiens
VIDPVPAAV

SEQ ID NO: 147454 - protein, 9 aa, Homo Sapiens
VIDSGYCKL

SEQ ID NO: 147455 - protein, 9 aa, Homo Sapiens
VIDVVPPKF

SEQ ID NO: 147456 - protein, 9 aa, Homo Sapiens
VKDVPNSQL

SEQ ID NO: 147457 - protein, 9 aa, Homo Sapiens
VLDEAGSTV

SEQ ID NO: 147458 - protein, 9 aa, Homo Sapiens
VLDEGSASV

SEQ ID NO: 147459 - protein, 9 aa, Homo Sapiens
VLDEPGQDL

SEQ ID NO: 147460 - protein, 9 aa, Homo Sapiens
VLDEVVTVL

SEQ ID NO: 147461 - protein, 9 aa, Homo Sapiens
VLDNPTPEM

SEQ ID NO: 147462 - protein, 9 aa, Homo Sapiens
VLDVVERSL

SEQ ID NO: 147463 - protein, 9 aa, Homo Sapiens
VLEPYPSKL

SEQ ID NO: 147464 - protein, 9 aa, Homo Sapiens
VMDSKIVQV

SEQ ID NO: 147465 - protein, 9 aa, Homo Sapiens
VNDQGVVKV

SEQ ID NO: 147466 - protein, 9 aa, Homo Sapiens
VQDAVDALM

SEQ ID NO: 147467 - protein, 9 aa, Homo Sapiens
VQDEMLARF

SEQ ID NO: 147468 - protein, 9 aa, Homo Sapiens
VQDESHSEW

SEQ ID NO: 147469 - protein, 9 aa, Homo Sapiens
VQDLIEGHL

SEQ ID NO: 147470 - protein, 9 aa, Homo Sapiens
VQDPKVTYL

SEQ ID NO: 147471 - protein, 9 aa, Homo Sapiens
VQDRPESSL

SEQ ID NO: 147472 - protein, 9 aa, Homo Sapiens
VSDDGTLHM

SEQ ID NO: 147473 - protein, 9 aa, Homo Sapiens
VSDDTVMHL

SEQ ID NO: 147474 - protein, 9 aa, Homo Sapiens
VSDEKRTEL

SEQ ID NO: 147475 - protein, 9 aa, Homo Sapiens
VSDFGGRSL

SEQ ID NO: 147476 - protein, 9 aa, Homo Sapiens
VSDFGQSHL

SEQ ID NO: 147477 - protein, 9 aa, Homo Sapiens
VSDHFPVEF

SEQ ID NO: 147478 - protein, 9 aa, Homo Sapiens
VSDKPDIIS

SEQ ID NO: 147479 - protein, 9 aa, Homo Sapiens
VSDKPTVTF

SEQ ID NO: 147480 - protein, 9 aa, Homo Sapiens
VSDLGPVVL

SEQ ID NO: 147481 - protein, 9 aa, Homo Sapiens
VSDLQHVTL

SEQ ID NO: 147482 - protein, 9 aa, Homo Sapiens
VSDLSEHVF

SEQ ID NO: 147483 - protein, 9 aa, Homo Sapiens
VSDNIIAKL

SEQ ID NO: 147484 - protein, 9 aa, Homo Sapiens
VSDPEEMEL

SEQ ID NO: 147485 - protein, 9 aa, Homo Sapiens
VSDPNLIHV

SEQ ID NO: 147486 - protein, 9 aa, Homo Sapiens
VSDPVTVHF

SEQ ID NO: 147487 - protein, 9 aa, Homo Sapiens
VSDQANHVL

SEQ ID NO: 147488 - protein, 9 aa, Homo Sapiens
VSDSGAHVL

SEQ ID NO: 147489 - protein, 9 aa, Homo Sapiens
VSDVPSLSV

SEQ ID NO: 147490 - protein, 9 aa, Homo Sapiens
VSENDVIRL

SEQ ID NO: 147491 - protein, 9 aa, Homo Sapiens
VSEVHPSRL

SEQ ID NO: 147492 - protein, 9 aa, Homo Sapiens
VTDADRSIL

SEQ ID NO: 147493 - protein, 9 aa, Homo Sapiens
VTDGKEVLL

SEQ ID NO: 147494 - protein, 9 aa, Homo Sapiens
VTDHNLHEL

SEQ ID NO: 147495 - protein, 9 aa, Homo Sapiens
VTDLGTAEL

SEQ ID NO: 147496 - protein, 9 aa, Homo Sapiens
VTDPRVVDL

SEQ ID NO: 147497 - protein, 9 aa, Homo Sapiens
VTDSGRTVI

SEQ ID NO: 147498 - protein, 9 aa, Homo Sapiens
VTDTGALYL

SEQ ID NO: 147499 - protein, 9 aa, Homo Sapiens
VTEPDHPVL

SEQ ID NO: 147500 - protein, 9 aa, Homo Sapiens
VVDAGKVTL

SEQ ID NO: 147501 - protein, 9 aa, Homo Sapiens
VVDAIPVFL

SEQ ID NO: 147502 - protein, 9 aa, Homo Sapiens
VVDAVVTQV

SEQ ID NO: 147503 - protein, 9 aa, Homo Sapiens
VVDDIVSKL

SEQ ID NO: 147504 - protein, 9 aa, Homo Sapiens
VVDEADTML

SEQ ID NO: 147505 - protein, 9 aa, Homo Sapiens
VVDEKISAM

SEQ ID NO: 147506 - protein, 9 aa, Homo Sapiens
VVDKPEQTV

SEQ ID NO: 147507 - protein, 9 aa, Homo Sapiens
VVDKPPSTM

SEQ ID NO: 147508 - protein, 9 aa, Homo Sapiens
VVDPNDPQM

SEQ ID NO: 147509 - protein, 9 aa, Homo Sapiens
VVDQGSTNL

SEQ ID NO: 147510 - protein, 9 aa, Homo Sapiens
VVDVGSTEV

SEQ ID NO: 147511 - protein, 9 aa, Homo Sapiens
VVEDGILKL

SEQ ID NO: 147512 - protein, 9 aa, Homo Sapiens
YADGGGCKL

SEQ ID NO: 147513 - protein, 9 aa, Homo Sapiens
YADKEETKL

SEQ ID NO: 147514 - protein, 9 aa, Homo Sapiens
YADLNQNDF

SEQ ID NO: 147515 - protein, 9 aa, Homo Sapiens
YADPVSAQH

SEQ ID NO: 147516 - protein, 9 aa, Homo Sapiens
YADQHSVQV

SEQ ID NO: 147517 - protein, 9 aa, Homo Sapiens
YADQLKEYL

SEQ ID NO: 147518 - protein, 9 aa, Homo Sapiens
YADSSIAEL

SEQ ID NO: 147519 - protein, 9 aa, Homo Sapiens
YADTQEINL

SEQ ID NO: 147520 - protein, 9 aa, Homo Sapiens
YADVGGKQF

SEQ ID NO: 147521 - protein, 9 aa, Homo Sapiens
YADVQKDGV

SEQ ID NO: 147522 - protein, 9 aa, Homo Sapiens
YADYEESRM

SEQ ID NO: 147523 - protein, 9 aa, Homo Sapiens
YAECYPATM

SEQ ID NO: 147524 - protein, 9 aa, Homo Sapiens
YAEEFRTYL

SEQ ID NO: 147525 - protein, 9 aa, Homo Sapiens
YAEHPGDCL

SEQ ID NO: 147526 - protein, 9 aa, Homo Sapiens
YAEQLHVQL

SEQ ID NO: 147527 - protein, 9 aa, Homo Sapiens
YAERDIVQF

SEQ ID NO: 147528 - protein, 9 aa, Homo Sapiens
YAEVGRVLL

SEQ ID NO: 147529 - protein, 9 aa, Homo Sapiens
YGDIKDVRL

SEQ ID NO: 147530 - protein, 9 aa, Homo Sapiens
YGEDDFSRL

SEQ ID NO: 147531 - protein, 9 aa, Homo Sapiens
YIDEGRLVL

SEQ ID NO: 147532 - protein, 9 aa, Homo Sapiens
YIDHGDPQV

SEQ ID NO: 147533 - protein, 9 aa, Homo Sapiens
YIDLPPPRL

SEQ ID NO: 147534 - protein, 9 aa, Homo Sapiens
YIDQGIAEL

SEQ ID NO: 147535 - protein, 9 aa, Homo Sapiens
YIDRDSEYL

SEQ ID NO: 147536 - protein, 9 aa, Homo Sapiens
YLDEYIARM

SEQ ID NO: 147537 - protein, 9 aa, Homo Sapiens
YLDNGVVFV

SEQ ID NO: 147538 - protein, 9 aa, Homo Sapiens
YLEAGGTKV

SEQ ID NO: 147539 - protein, 9 aa, Homo Sapiens
YLEDSPLEL

SEQ ID NO: 147540 - protein, 9 aa, Homo Sapiens
YLEEPLTQV

SEQ ID NO: 147541 - protein, 9 aa, Homo Sapiens
YNDQGQVRL

SEQ ID NO: 147542 - protein, 9 aa, Homo Sapiens
YQDLLNVKM

SEQ ID NO: 147543 - protein, 9 aa, Homo Sapiens
YQDTHPERL

SEQ ID NO: 147544 - protein, 9 aa, Homo Sapiens
YQDTPGVKM

SEQ ID NO: 147545 - protein, 9 aa, Homo Sapiens
YSDAPVSEL

SEQ ID NO: 147546 - protein, 9 aa, Homo Sapiens
YSDATTSKI

SEQ ID NO: 147547 - protein, 9 aa, Homo Sapiens
YSDDIPHAL

SEQ ID NO: 147548 - protein, 9 aa, Homo Sapiens
YSDGKLQTV

SEQ ID NO: 147549 - protein, 9 aa, Homo Sapiens
YSDGPGEAL

SEQ ID NO: 147550 - protein, 9 aa, Homo Sapiens
YSDLRKESM

SEQ ID NO: 147551 - protein, 9 aa, Homo Sapiens
YSDPILVQT

SEQ ID NO: 147552 - protein, 9 aa, Homo Sapiens
YSDSFPMEL

SEQ ID NO: 147553 - protein, 9 aa, Homo Sapiens
YSDVEHTSV

SEQ ID NO: 147554 - protein, 9 aa, Homo Sapiens
YTDATPLRV

SEQ ID NO: 147555 - protein, 9 aa, Homo Sapiens
YTDEPVSKI

SEQ ID NO: 147556 - protein, 9 aa, Homo Sapiens
YTDFDGTRV

SEQ ID NO: 147557 - protein, 9 aa, Homo Sapiens
YTDHQFTEL

SEQ ID NO: 147558 - protein, 9 aa, Homo Sapiens
YTDLPNRQL

SEQ ID NO: 147559 - protein, 9 aa, Homo Sapiens
YTDVTPRQF

SEQ ID NO: 147560 - protein, 9 aa, Homo Sapiens
YVDDGLISL

SEQ ID NO: 147561 - protein, 9 aa, Homo Sapiens
YVDEHGTRL

SEQ ID NO: 147562 - protein, 9 aa, Homo Sapiens
YVDESRECV

SEQ ID NO: 147563 - protein, 9 aa, Homo Sapiens
YVDEVMTRL

SEQ ID NO: 147564 - protein, 9 aa, Homo Sapiens
YVDGRVLVV

SEQ ID NO: 147565 - protein, 9 aa, Homo Sapiens
YVDISENHL

SEQ ID NO: 147566 - protein, 9 aa, Homo Sapiens
YVDTAVRHV

SEQ ID NO: 147567 - protein, 9 aa, Homo Sapiens
YVDVVKVLL

SEQ ID NO: 147568 - protein, 10 aa, Homo Sapiens
AADAEMTTRM

SEQ ID NO: 147569 - protein, 10 aa, Homo Sapiens
AADDCAKAVM

SEQ ID NO: 147570 - protein, 10 aa, Homo Sapiens
AADFEIGHFL

SEQ ID NO: 147571 - protein, 10 aa, Homo Sapiens
AADGGLRASV

SEQ ID NO: 147572 - protein, 10 aa, Homo Sapiens
AADGGPRVSF

SEQ ID NO: 147573 - protein, 10 aa, Homo Sapiens
AADGKGVVVV

SEQ ID NO: 147574 - protein, 10 aa, Homo Sapiens
AADGRGLQTV

SEQ ID NO: 147575 - protein, 10 aa, Homo Sapiens
AADGTNVVKL

SEQ ID NO: 147576 - protein, 10 aa, Homo Sapiens
AADIDTRSEF

SEQ ID NO: 147577 - protein, 10 aa, Homo Sapiens
AADKAAVVKF

SEQ ID NO: 147578 - protein, 10 aa, Homo Sapiens
AADPGLHETL

SEQ ID NO: 147579 - protein, 10 aa, Homo Sapiens
AADPGLPARL

SEQ ID NO: 147580 - protein, 10 aa, Homo Sapiens
AADTPPLETL

SEQ ID NO: 147581 - protein, 10 aa, Homo Sapiens
AADVAQSTHV

SEQ ID NO: 147582 - protein, 10 aa, Homo Sapiens
ASDKPSQETL

SEQ ID NO: 147583 - protein, 10 aa, Homo Sapiens
AVDESNDHML

SEQ ID NO: 147584 - protein, 10 aa, Homo Sapiens
AVDGKEMVTM

SEQ ID NO: 147585 - protein, 10 aa, Homo Sapiens
EEQLQQIRAE

SEQ ID NO: 147586 - protein, 10 aa, Homo Sapiens
ESDSAKPASL

SEQ ID NO: 147587 - protein, 10 aa, Homo Sapiens
FADDNRFDFL

SEQ ID NO: 147588 - protein, 10 aa, Homo Sapiens
FADDPCSSVK

SEQ ID NO: 147589 - protein, 10 aa, Homo Sapiens
FADGHVLELL

SEQ ID NO: 147590 - protein, 10 aa, Homo Sapiens
FADGVPREGL

SEQ ID NO: 147591 - protein, 10 aa, Homo Sapiens
FADKETLIQF

SEQ ID NO: 147592 - protein, 10 aa, Homo Sapiens
FADSDSHSSF

SEQ ID NO: 147593 - protein, 10 aa, Homo Sapiens
FIDGGGSVLV

SEQ ID NO: 147594 - protein, 10 aa, Homo Sapiens
FIDKNGETEL

SEQ ID NO: 147595 - protein, 10 aa, Homo Sapiens
FSETGAGKHV

SEQ ID NO: 147596 - protein, 10 aa, Homo Sapiens
FTDEESRVFL

SEQ ID NO: 147597 - protein, 10 aa, Homo Sapiens
FTDTDCVVRF

SEQ ID NO: 147598 - protein, 10 aa, Homo Sapiens
FVDCPGHDIL

SEQ ID NO: 147599 - protein, 10 aa, Homo Sapiens
FVDDGTETHF

SEQ ID NO: 147600 - protein, 10 aa, Homo Sapiens
FVDTDADTRL

SEQ ID NO: 147601 - protein, 10 aa, Homo Sapiens
FVDTSDCTVM

SEQ ID NO: 147602 - protein, 10 aa, Homo Sapiens
FVEDASGKGL

SEQ ID NO: 147603 - protein, 10 aa, Homo Sapiens
GADLPNLLFY

SEQ ID NO: 147604 - protein, 10 aa, Homo Sapiens
GPSIVHRKCF

SEQ ID NO: 147605 - protein, 10 aa, Homo Sapiens
HADDCVGLEL

SEQ ID NO: 147606 - protein, 10 aa, Homo Sapiens
HADSNIVIML

SEQ ID NO: 147607 - protein, 10 aa, Homo Sapiens
HIDGDHLTLL

SEQ ID NO: 147608 - protein, 10 aa, Homo Sapiens
HIDPKTGVAV

SEQ ID NO: 147609 - protein, 10 aa, Homo Sapiens
HIDPNVDYQF

SEQ ID NO: 147610 - protein, 10 aa, Homo Sapiens
HLDLPSNNNL

SEQ ID NO: 147611 - protein, 10 aa, Homo Sapiens
IADNRPSVEF

SEQ ID NO: 147612 - protein, 10 aa, Homo Sapiens
IADPKTDHRL

SEQ ID NO: 147613 - protein, 10 aa, Homo Sapiens
IADSPTGQKV

SEQ ID NO: 147614 - protein, 10 aa, Homo Sapiens
IADTGANVVV

SEQ ID NO: 147615 - protein, 10 aa, Homo Sapiens
IAEEASKVCL

SEQ ID NO: 147616 - protein, 10 aa, Homo Sapiens
IIDDPSGNSF

SEQ ID NO: 147617 - protein, 10 aa, Homo Sapiens
IIDKSGSTVF

SEQ ID NO: 147618 - protein, 10 aa, Homo Sapiens
IIDTPGHESF

SEQ ID NO: 147619 - protein, 10 aa, Homo Sapiens
IIDTPGHVDF

SEQ ID NO: 147620 - protein, 10 aa, Homo Sapiens
ILDDVSLTHL

SEQ ID NO: 147621 - protein, 10 aa, Homo Sapiens
IMDTPGHVNF

SEQ ID NO: 147622 - protein, 10 aa, Homo Sapiens
ISDGPSKVTL

SEQ ID NO: 147623 - protein, 10 aa, Homo Sapiens
IVDGRGKATI

SEQ ID NO: 147624 - protein, 10 aa, Homo Sapiens
KADAASSLTV

SEQ ID NO: 147625 - protein, 10 aa, Homo Sapiens
KADAISKSEL

SEQ ID NO: 147626 - protein, 10 aa, Homo Sapiens
KADEANDNLF

SEQ ID NO: 147627 - protein, 10 aa, Homo Sapiens
KADGIVSKNF

SEQ ID NO: 147628 - protein, 10 aa, Homo Sapiens
KADLPEGVAV

SEQ ID NO: 147629 - protein, 10 aa, Homo Sapiens
KADTISKSEL

SEQ ID NO: 147630 - protein, 10 aa, Homo Sapiens
KADTVSKTEL

SEQ ID NO: 147631 - protein, 10 aa, Homo Sapiens
KADVQSIIGL

SEQ ID NO: 147632 - protein, 10 aa, Homo Sapiens
KSDAPDTLLL

SEQ ID NO: 147633 - protein, 10 aa, Homo Sapiens
KSDDTAEHLL

SEQ ID NO: 147634 - protein, 10 aa, Homo Sapiens
KSDEGGKVLL

SEQ ID NO: 147635 - protein, 10 aa, Homo Sapiens
LIDSPGHVDF

SEQ ID NO: 147636 - protein, 10 aa, Homo Sapiens
LTDMSRPVEL

SEQ ID NO: 147637 - protein, 10 aa, Homo Sapiens
LVDGEEHVGF

SEQ ID NO: 147638 - protein, 10 aa, Homo Sapiens
NADGKLSVKF

SEQ ID NO: 147639 - protein, 10 aa, Homo Sapiens
NADGPAPLEL

SEQ ID NO: 147640 - protein, 10 aa, Homo Sapiens
NADGPNPWML

SEQ ID NO: 147641 - protein, 10 aa, Homo Sapiens
NAENPRGTFL

SEQ ID NO: 147642 - protein, 10 aa, Homo Sapiens
NAESGRGQVM

SEQ ID NO: 147643 - protein, 10 aa, Homo Sapiens
NSDDSSRNLF

SEQ ID NO: 147644 - protein, 10 aa, Homo Sapiens
PKKAKKPAAT

SEQ ID NO: 147645 - protein, 10 aa, Homo Sapiens
QADEANKRLL

SEQ ID NO: 147646 - protein, 10 aa, Homo Sapiens
RADGENTAFL

SEQ ID NO: 147647 - protein, 10 aa, Homo Sapiens
SADDKTVRLW

SEQ ID NO: 147648 - protein, 10 aa, Homo Sapiens
SADEGQTVFY

SEQ ID NO: 147649 - protein, 10 aa, Homo Sapiens
SADEPMTTFV

SEQ ID NO: 147650 - protein, 10 aa, Homo Sapiens
SADEPMTTFY

SEQ ID NO: 147651 - protein, 10 aa, Homo Sapiens
SADESGQIFI

SEQ ID NO: 147652 - protein, 10 aa, Homo Sapiens
SLDEPSVKTM

SEQ ID NO: 147653 - protein, 10 aa, Homo Sapiens
TADDPSLSLI

SEQ ID NO: 147654 - protein, 10 aa, Homo Sapiens
TADGGHYYSF

SEQ ID NO: 147655 - protein, 10 aa, Homo Sapiens
TADPPDGIKV

SEQ ID NO: 147656 - protein, 10 aa, Homo Sapiens
TAEDPSKSYV

SEQ ID NO: 147657 - protein, 10 aa, Homo Sapiens
TIDGPSKVKM

SEQ ID NO: 147658 - protein, 10 aa, Homo Sapiens
TTDNNPPMKL

SEQ ID NO: 147659 - protein, 10 aa, Homo Sapiens
TVDDPYATFV

SEQ ID NO: 147660 - protein, 10 aa, Homo Sapiens
TVEEQRPPEL

SEQ ID NO: 147661 - protein, 10 aa, Homo Sapiens
VADDIMDSSL

SEQ ID NO: 147662 - protein, 10 aa, Homo Sapiens
VADDYQPVRL

SEQ ID NO: 147663 - protein, 10 aa, Homo Sapiens
VADKHRPLEM

SEQ ID NO: 147664 - protein, 10 aa, Homo Sapiens
VADKTGSITI

SEQ ID NO: 147665 - protein, 10 aa, Homo Sapiens
VADPDNPLVL

SEQ ID NO: 147666 - protein, 10 aa, Homo Sapiens
VAEDGSRVYV

SEQ ID NO: 147667 - protein, 10 aa, Homo Sapiens
VIDDSNEHML

SEQ ID NO: 147668 - protein, 10 aa, Homo Sapiens
VIDRPNGTKV

SEQ ID NO: 147669 - protein, 10 aa, Homo Sapiens
VLSAADKGNV

SEQ ID NO: 147670 - protein, 10 aa, Homo Sapiens
VTDEPVYIDL

SEQ ID NO: 147671 - protein, 10 aa, Homo Sapiens
VVDDSNEHML

SEQ ID NO: 147672 - protein, 10 aa, Homo Sapiens
VVDGKERTLL

SEQ ID NO: 147673 - protein, 10 aa, Homo Sapiens
YADASGRNTL

SEQ ID NO: 147674 - protein, 10 aa, Homo Sapiens
YADPGAEVKI

SEQ ID NO: 147675 - protein, 10 aa, Homo Sapiens
YADQHSVQVF

SEQ ID NO: 147676 - protein, 10 aa, Homo Sapiens
YLDGHLITTV

SEQ ID NO: 147677 - protein, 10 aa, Homo Sapiens
YTDVTPRQFF

SEQ ID NO: 147678 - protein, 10 aa, Homo Sapiens
YTEDSPGLKV

SEQ ID NO: 147679 - protein, 10 aa, Homo Sapiens
YVDDTQFLRF

SEQ ID NO: 147680 - protein, 10 aa, Homo Sapiens
YVDDTQFVRF

SEQ ID NO: 147681 - protein, 10 aa, Homo Sapiens
YVDEAGTVKL

SEQ ID NO: 147682 - protein, 10 aa, Homo Sapiens
YVDEASKKEI

SEQ ID NO: 147683 - protein, 10 aa, Homo Sapiens
YVDGPASTAF

SEQ ID NO: 147684 - protein, 11 aa, Homo Sapiens
AACDPRHGRYL

SEQ ID NO: 147685 - protein, 11 aa, Homo Sapiens
AADDPLVHESL

SEQ ID NO: 147686 - protein, 11 aa, Homo Sapiens
AVEAKKTYVRD

SEQ ID NO: 147687 - protein, 11 aa, Homo Sapiens
FADDPCSSVKR

SEQ ID NO: 147688 - protein, 11 aa, Homo Sapiens
FADECPKPELL

SEQ ID NO: 147689 - protein, 11 aa, Homo Sapiens
FADFVEGSSHL

SEQ ID NO: 147690 - protein, 11 aa, Homo Sapiens
FADGERKVEHL

SEQ ID NO: 147691 - protein, 11 aa, Homo Sapiens
FADGSIRTSEL

SEQ ID NO: 147692 - protein, 11 aa, Homo Sapiens
FSDDPNVTKTL

SEQ ID NO: 147693 - protein, 11 aa, Homo Sapiens
IADLSNIINKL

SEQ ID NO: 147694 - protein, 11 aa, Homo Sapiens
ISDDSRTASQL

SEQ ID NO: 147695 - protein, 11 aa, Homo Sapiens
KADGQGSTTML

SEQ ID NO: 147696 - protein, 11 aa, Homo Sapiens
KADQVDTQQLM

SEQ ID NO: 147697 - protein, 11 aa, Homo Sapiens
LVEALKRKQQC

SEQ ID NO: 147698 - protein, 11 aa, Homo Sapiens
PKFEVIEKPQA

SEQ ID NO: 147699 - protein, 11 aa, Homo Sapiens
RADEDARMIHM

SEQ ID NO: 147700 - protein, 11 aa, Homo Sapiens
SGPSIVHRKCF

SEQ ID NO: 147701 - protein, 11 aa, Homo Sapiens
VADNLDQATRV

SEQ ID NO: 147702 - protein, 11 aa, Homo Sapiens
VGDGGTGKTTF

SEQ ID NO: 147703 - protein, 11 aa, Homo Sapiens
VIDQGETDVYV

SEQ ID NO: 147704 - protein, 11 aa, Homo Sapiens
VLSAADKGNVK

SEQ ID NO: 147705 - protein, 11 aa, Homo Sapiens
VVDLGKTSSTV

SEQ ID NO: 147706 - protein, 11 aa, Homo Sapiens
VVSEVDIAKAD

SEQ ID NO: 147707 - protein, 11 aa, Homo Sapiens
YADGEAKVEQL

SEQ ID NO: 147708 - protein, 11 aa, Homo Sapiens
YTDVGEKGSQL

SEQ ID NO: 147709 - protein, 8 aa, Homo Sapiens
ALGHVRYV

SEQ ID NO: 147710 - protein, 8 aa, Homo Sapiens
ALGPIREL

SEQ ID NO: 147711 - protein, 8 aa, Homo Sapiens
ARGPIQIL

SEQ ID NO: 147712 - protein, 8 aa, Homo Sapiens
ASGLIHRV

SEQ ID NO: 147713 - protein, 8 aa, Homo Sapiens
AVFVNVRV

SEQ ID NO: 147714 - protein, 8 aa, Homo Sapiens
AYGLSREV

SEQ ID NO: 147715 - protein, 8 aa, Homo Sapiens
EIFLRELI

SEQ ID NO: 147716 - protein, 8 aa, Homo Sapiens
EQGPLRLI

SEQ ID NO: 147717 - protein, 8 aa, Homo Sapiens
EVGPLRLV

SEQ ID NO: 147718 - protein, 8 aa, Homo Sapiens
FAMPHSIM

SEQ ID NO: 147719 - protein, 8 aa, Homo Sapiens
FGGLTRAL

SEQ ID NO: 147720 - protein, 8 aa, Homo Sapiens
FQGDIRLL

SEQ ID NO: 147721 - protein, 8 aa, Homo Sapiens
FRAPSRIF

SEQ ID NO: 147722 - protein, 8 aa, Homo Sapiens
FSFVRPKL

SEQ ID NO: 147723 - protein, 8 aa, Homo Sapiens
FSGVIRLL

SEQ ID NO: 147724 - protein, 8 aa, Homo Sapiens
FSPVGSVL

SEQ ID NO: 147725 - protein, 8 aa, Homo Sapiens
FVGPSRYL

SEQ ID NO: 147726 - protein, 8 aa, Homo Sapiens
FVNVVPTF

SEQ ID NO: 147727 - protein, 8 aa, Homo Sapiens
FVPVANEL

SEQ ID NO: 147728 - protein, 8 aa, Homo Sapiens
FYGIIRNV

SEQ ID NO: 147729 - protein, 8 aa, Homo Sapiens
FYKDGRIV

SEQ ID NO: 147730 - protein, 8 aa, Homo Sapiens
GGLRAELL

SEQ ID NO: 147731 - protein, 8 aa, Homo Sapiens
GVGPIRDV

SEQ ID NO: 147732 - protein, 8 aa, Homo Sapiens
GVGPIRKV

SEQ ID NO: 147733 - protein, 8 aa, Homo Sapiens
HSGPIHVL

SEQ ID NO: 147734 - protein, 8 aa, Homo Sapiens
IIHLHSQL

SEQ ID NO: 147735 - protein, 8 aa, Homo Sapiens
IRFKIQRL

SEQ ID NO: 147736 - protein, 8 aa, Homo Sapiens
IRGVINQL

SEQ ID NO: 147737 - protein, 8 aa, Homo Sapiens
ITGPWRSL

SEQ ID NO: 147738 - protein, 8 aa, Homo Sapiens
KYGPIRQI

SEQ ID NO: 147739 - protein, 8 aa, Homo Sapiens
LRGPVLRL

SEQ ID NO: 147740 - protein, 8 aa, Homo Sapiens
LRTERLKI

SEQ ID NO: 147741 - protein, 8 aa, Homo Sapiens
MVQIHSIL

SEQ ID NO: 147742 - protein, 8 aa, Homo Sapiens
NIGPTRIL

SEQ ID NO: 147743 - protein, 8 aa, Homo Sapiens
NVGLIRKL

SEQ ID NO: 147744 - protein, 8 aa, Homo Sapiens
QFTGIKKY

SEQ ID NO: 147745 - protein, 8 aa, Homo Sapiens
QIGPLRSL

SEQ ID NO: 147746 - protein, 8 aa, Homo Sapiens
QILVGVNK

SEQ ID NO: 147747 - protein, 8 aa, Homo Sapiens
QQGPLRSI

SEQ ID NO: 147748 - protein, 8 aa, Homo Sapiens
RIPKIQKL

SEQ ID NO: 147749 - protein, 8 aa, Homo Sapiens
RPEHVLRL

SEQ ID NO: 147750 - protein, 8 aa, Homo Sapiens
RQAFIRKV

SEQ ID NO: 147751 - protein, 8 aa, Homo Sapiens
RQGLIRVL

SEQ ID NO: 147752 - protein, 8 aa, Homo Sapiens
RTGLVRLL

SEQ ID NO: 147753 - protein, 8 aa, Homo Sapiens
SPVDIDTK

SEQ ID NO: 147754 - protein, 8 aa, Homo Sapiens
SRYTEQFL

SEQ ID NO: 147755 - protein, 8 aa, Homo Sapiens
SSGPERIL

SEQ ID NO: 147756 - protein, 8 aa, Homo Sapiens
SSGPQRLV

SEQ ID NO: 147757 - protein, 8 aa, Homo Sapiens
TRFKIQQL

SEQ ID NO: 147758 - protein, 8 aa, Homo Sapiens
TRGPVVRL

SEQ ID NO: 147759 - protein, 8 aa, Homo Sapiens
TVGLIRNL

SEQ ID NO: 147760 - protein, 8 aa, Homo Sapiens
VAMVHPLL

SEQ ID NO: 147761 - protein, 8 aa, Homo Sapiens
VRFKVVKV

SEQ ID NO: 147762 - protein, 8 aa, Homo Sapiens
VRNLPQYV

SEQ ID NO: 147763 - protein, 8 aa, Homo Sapiens
YAFLHRTL

SEQ ID NO: 147764 - protein, 8 aa, Homo Sapiens
YGMPRQIL

SEQ ID NO: 147765 - protein, 8 aa, Homo Sapiens
YIAHLRQI

SEQ ID NO: 147766 - protein, 8 aa, Homo Sapiens
YIDRVRSL

SEQ ID NO: 147767 - protein, 8 aa, Homo Sapiens
YRAPEIII

SEQ ID NO: 147768 - protein, 8 aa, Homo Sapiens
YRAPEIML

SEQ ID NO: 147769 - protein, 8 aa, Homo Sapiens
YYGPLRSV

SEQ ID NO: 147770 - protein, 8 aa, Homo Sapiens
YYGPLRTV

SEQ ID NO: 147771 - protein, 9 aa, Homo Sapiens
AAAEITRKL

SEQ ID NO: 147772 - protein, 9 aa, Homo Sapiens
AAALIIHHV

SEQ ID NO: 147773 - protein, 9 aa, Homo Sapiens
AAANVVRNI

SEQ ID NO: 147774 - protein, 9 aa, Homo Sapiens
AAASLIRLV

SEQ ID NO: 147775 - protein, 9 aa, Homo Sapiens
AAFAYTVKY

SEQ ID NO: 147776 - protein, 9 aa, Homo Sapiens
AAFLLVRKL

SEQ ID NO: 147777 - protein, 9 aa, Homo Sapiens
AAFPGASLY

SEQ ID NO: 147778 - protein, 9 aa, Homo Sapiens
AAFPRLRTI

SEQ ID NO: 147779 - protein, 9 aa, Homo Sapiens
AAFREPRLL

SEQ ID NO: 147780 - protein, 9 aa, Homo Sapiens
AAGPIRVVL

SEQ ID NO: 147781 - protein, 9 aa, Homo Sapiens
AAIGLVIYY

SEQ ID NO: 147782 - protein, 9 aa, Homo Sapiens
AAIKIIRQL

SEQ ID NO: 147783 - protein, 9 aa, Homo Sapiens
AAKDLISKL

SEQ ID NO: 147784 - protein, 9 aa, Homo Sapiens
AALGPIREL

SEQ ID NO: 147785 - protein, 9 aa, Homo Sapiens
AAMSLLRRV

SEQ ID NO: 147786 - protein, 9 aa, Homo Sapiens
AASPIITLV

SEQ ID NO: 147787 - protein, 9 aa, Homo Sapiens
AASSIQRVL

SEQ ID NO: 147788 - protein, 9 aa, Homo Sapiens
AAYFTHSNL

SEQ ID NO: 147789 - protein, 9 aa, Homo Sapiens
AAYGYGIRY

SEQ ID NO: 147790 - protein, 9 aa, Homo Sapiens
AAYQSVRIL

SEQ ID NO: 147791 - protein, 9 aa, Homo Sapiens
AAYTEIRAL

SEQ ID NO: 147792 - protein, 9 aa, Homo Sapiens
AAYYLPRHL

SEQ ID NO: 147793 - protein, 9 aa, Homo Sapiens
AERTLGNIL

SEQ ID NO: 147794 - protein, 9 aa, Homo Sapiens
AGSSVLREL

SEQ ID NO: 147795 - protein, 9 aa, Homo Sapiens
AGYNRVRIV

SEQ ID NO: 147796 - protein, 9 aa, Homo Sapiens
AGYPHIRYI

SEQ ID NO: 147797 - protein, 9 aa, Homo Sapiens
AIPAFISLL

SEQ ID NO: 147798 - protein, 9 aa, Homo Sapiens
AIVDFVRWL

SEQ ID NO: 147799 - protein, 9 aa, Homo Sapiens
AKIKWVISV

SEQ ID NO: 147800 - protein, 9 aa, Homo Sapiens
AKPPVVQHF

SEQ ID NO: 147801 - protein, 9 aa, Homo Sapiens
AKVDHVQMI

SEQ ID NO: 147802 - protein, 9 aa, Homo Sapiens
ALPDLTKVI

SEQ ID NO: 147803 - protein, 9 aa, Homo Sapiens
ALPLLVRVI

SEQ ID NO: 147804 - protein, 9 aa, Homo Sapiens
ALPPKPRFL

SEQ ID NO: 147805 - protein, 9 aa, Homo Sapiens
ALRRLLLLL

SEQ ID NO: 147806 - protein, 9 aa, Homo Sapiens
ALYPNVVQV

SEQ ID NO: 147807 - protein, 9 aa, Homo Sapiens
AMAPIKVRL

SEQ ID NO: 147808 - protein, 9 aa, Homo Sapiens
AMAPLVRKI

SEQ ID NO: 147809 - protein, 9 aa, Homo Sapiens
AMASIINRL

SEQ ID NO: 147810 - protein, 9 aa, Homo Sapiens
AQFEHTILL

SEQ ID NO: 147811 - protein, 9 aa, Homo Sapiens
ARADFQKVL

SEQ ID NO: 147812 - protein, 9 aa, Homo Sapiens
ARAELEMRL

SEQ ID NO: 147813 - protein, 9 aa, Homo Sapiens
ARAFFPNMV

SEQ ID NO: 147814 - protein, 9 aa, Homo Sapiens
ARAFIILSV

SEQ ID NO: 147815 - protein, 9 aa, Homo Sapiens
ARAPISNYI

SEQ ID NO: 147816 - protein, 9 aa, Homo Sapiens
ARAWALFWL

SEQ ID NO: 147817 - protein, 9 aa, Homo Sapiens
ARAYEPQEL

SEQ ID NO: 147818 - protein, 9 aa, Homo Sapiens
ARFEREQLL

SEQ ID NO: 147819 - protein, 9 aa, Homo Sapiens
ARFGLIQSM

SEQ ID NO: 147820 - protein, 9 aa, Homo Sapiens
ARFGSVNEL

SEQ ID NO: 147821 - protein, 9 aa, Homo Sapiens
ARFNDLRFV

SEQ ID NO: 147822 - protein, 9 aa, Homo Sapiens
ARFPGNLLL

SEQ ID NO: 147823 - protein, 9 aa, Homo Sapiens
ARFPMPRYI

SEQ ID NO: 147824 - protein, 9 aa, Homo Sapiens
ARFSGNLLV

SEQ ID NO: 147825 - protein, 9 aa, Homo Sapiens
ARFYAVQKL

SEQ ID NO: 147826 - protein, 9 aa, Homo Sapiens
ARFYLPILV

SEQ ID NO: 147827 - protein, 9 aa, Homo Sapiens
ARHSLLQTL

SEQ ID NO: 147828 - protein, 9 aa, Homo Sapiens
ARIGGVRML

SEQ ID NO: 147829 - protein, 9 aa, Homo Sapiens
ARKDNVIRL

SEQ ID NO: 147830 - protein, 9 aa, Homo Sapiens
ARKEIADYL

SEQ ID NO: 147831 - protein, 9 aa, Homo Sapiens
ARLDLERKV

SEQ ID NO: 147832 - protein, 9 aa, Homo Sapiens
ARLQTALLV

SEQ ID NO: 147833 - protein, 9 aa, Homo Sapiens
ARNDYLLTL

SEQ ID NO: 147834 - protein, 9 aa, Homo Sapiens
ARNFYENLI

SEQ ID NO: 147835 - protein, 9 aa, Homo Sapiens
ARNTVTQVL

SEQ ID NO: 147836 - protein, 9 aa, Homo Sapiens
ARPGFEQAI

SEQ ID NO: 147837 - protein, 9 aa, Homo Sapiens
ARPGLGQYL

SEQ ID NO: 147838 - protein, 9 aa, Homo Sapiens
ARPHFMSQF

SEQ ID NO: 147839 - protein, 9 aa, Homo Sapiens
ARPMRAIFL

SEQ ID NO: 147840 - protein, 9 aa, Homo Sapiens
ARPPFVICV

SEQ ID NO: 147841 - protein, 9 aa, Homo Sapiens
ARQSIIRKV

SEQ ID NO: 147842 - protein, 9 aa, Homo Sapiens
ARSELYLRF

SEQ ID NO: 147843 - protein, 9 aa, Homo Sapiens
ARTDIVSWF

SEQ ID NO: 147844 - protein, 9 aa, Homo Sapiens
ARVERVIVV

SEQ ID NO: 147845 - protein, 9 aa, Homo Sapiens
ARVPHSLDL

SEQ ID NO: 147846 - protein, 9 aa, Homo Sapiens
ARWQQVWLL

SEQ ID NO: 147847 - protein, 9 aa, Homo Sapiens
ARYGHELLI

SEQ ID NO: 147848 - protein, 9 aa, Homo Sapiens
ARYHLVQQL

SEQ ID NO: 147849 - protein, 9 aa, Homo Sapiens
ARYLTVPEI

SEQ ID NO: 147850 - protein, 9 aa, Homo Sapiens
ARYNFIRSM

SEQ ID NO: 147851 - protein, 9 aa, Homo Sapiens
ARYPDTIAL

SEQ ID NO: 147852 - protein, 9 aa, Homo Sapiens
ARYPNGVVV

SEQ ID NO: 147853 - protein, 9 aa, Homo Sapiens
ASGPIRPIV

SEQ ID NO: 147854 - protein, 9 aa, Homo Sapiens
ASLDWPRMV

SEQ ID NO: 147855 - protein, 9 aa, Homo Sapiens
ASSPVLRQM

SEQ ID NO: 147856 - protein, 9 aa, Homo Sapiens
ATIDGVRFL

SEQ ID NO: 147857 - protein, 9 aa, Homo Sapiens
ATSFILRAV

SEQ ID NO: 147858 - protein, 9 aa, Homo Sapiens
AVKDLVVLL

SEQ ID NO: 147859 - protein, 9 aa, Homo Sapiens
AVNPLLRVI

SEQ ID NO: 147860 - protein, 9 aa, Homo Sapiens
AVSWVLRSV

SEQ ID NO: 147861 - protein, 9 aa, Homo Sapiens
AYSDIVKMI

SEQ ID NO: 147862 - protein, 9 aa, Homo Sapiens
AYVQLIRSL

SEQ ID NO: 147863 - protein, 9 aa, Homo Sapiens
CGSVLVRLI

SEQ ID NO: 147864 - protein, 9 aa, Homo Sapiens
CKPHFQQLF

SEQ ID NO: 147865 - protein, 9 aa, Homo Sapiens
CQYPGLQWV

SEQ ID NO: 147866 - protein, 9 aa, Homo Sapiens
CRFQIVQVL

SEQ ID NO: 147867 - protein, 9 aa, Homo Sapiens
CRMEIIHEI

SEQ ID NO: 147868 - protein, 9 aa, Homo Sapiens
CSRYLYTLV

SEQ ID NO: 147869 - protein, 9 aa, Homo Sapiens
DRYFRIQEV

SEQ ID NO: 147870 - protein, 9 aa, Homo Sapiens
DYFEFPREL

SEQ ID NO: 147871 - protein, 9 aa, Homo Sapiens
DYSPLIRVI

SEQ ID NO: 147872 - protein, 9 aa, Homo Sapiens
EAAQILRLL

SEQ ID NO: 147873 - protein, 9 aa, Homo Sapiens
EGYPFPREV

SEQ ID NO: 147874 - protein, 9 aa, Homo Sapiens
EKPDIFQLV

SEQ ID NO: 147875 - protein, 9 aa, Homo Sapiens
ERADLIAYL

SEQ ID NO: 147876 - protein, 9 aa, Homo Sapiens
ERAGVVREL

SEQ ID NO: 147877 - protein, 9 aa, Homo Sapiens
ERAYILNLV

SEQ ID NO: 147878 - protein, 9 aa, Homo Sapiens
ERFNVPVSL

SEQ ID NO: 147879 - protein, 9 aa, Homo Sapiens
ERFPYPFQV

SEQ ID NO: 147880 - protein, 9 aa, Homo Sapiens
ERIPKALEV

SEQ ID NO: 147881 - protein, 9 aa, Homo Sapiens
ERIPKTIEI

SEQ ID NO: 147882 - protein, 9 aa, Homo Sapiens
ERPLFPQIL

SEQ ID NO: 147883 - protein, 9 aa, Homo Sapiens
ERPTFKILL

SEQ ID NO: 147884 - protein, 9 aa, Homo Sapiens
ERSGVIREV

SEQ ID NO: 147885 - protein, 9 aa, Homo Sapiens
ERVPFILTY

SEQ ID NO: 147886 - protein, 9 aa, Homo Sapiens
ERYAKIVEI

SEQ ID NO: 147887 - protein, 9 aa, Homo Sapiens
EYIKFLRSI

SEQ ID NO: 147888 - protein, 9 aa, Homo Sapiens
EYLNFIRGV

SEQ ID NO: 147889 - protein, 9 aa, Homo Sapiens
FAADIISVL

SEQ ID NO: 147890 - protein, 9 aa, Homo Sapiens
FAFFDPVMY

SEQ ID NO: 147891 - protein, 9 aa, Homo Sapiens
FAFPGEILM

SEQ ID NO: 147892 - protein, 9 aa, Homo Sapiens
FAGDLVRNL

SEQ ID NO: 147893 - protein, 9 aa, Homo Sapiens
FAGLVPRLL

SEQ ID NO: 147894 - protein, 9 aa, Homo Sapiens
FAKDFMTYL

SEQ ID NO: 147895 - protein, 9 aa, Homo Sapiens
FAKPFLASL

SEQ ID NO: 147896 - protein, 9 aa, Homo Sapiens
FAKVHILYV

SEQ ID NO: 147897 - protein, 9 aa, Homo Sapiens
FALPFGRTA

SEQ ID NO: 147898 - protein, 9 aa, Homo Sapiens
FALPYIRDV

SEQ ID NO: 147899 - protein, 9 aa, Homo Sapiens
FAMEFVKYY

SEQ ID NO: 147900 - protein, 9 aa, Homo Sapiens
FASGLIHRV

SEQ ID NO: 147901 - protein, 9 aa, Homo Sapiens
FASPMKSVV

SEQ ID NO: 147902 - protein, 9 aa, Homo Sapiens
FASTILHLV

SEQ ID NO: 147903 - protein, 9 aa, Homo Sapiens
FAYEGPMYL

SEQ ID NO: 147904 - protein, 9 aa, Homo Sapiens
FAYPAIRYL

SEQ ID NO: 147905 - protein, 9 aa, Homo Sapiens
FAYPAPLEV

SEQ ID NO: 147906 - protein, 9 aa, Homo Sapiens
FFPDFIWTV

SEQ ID NO: 147907 - protein, 9 aa, Homo Sapiens
FFSANPKEL

SEQ ID NO: 147908 - protein, 9 aa, Homo Sapiens
FFSEYEKLL

SEQ ID NO: 147909 - protein, 9 aa, Homo Sapiens
FGFHKPKMY

SEQ ID NO: 147910 - protein, 9 aa, Homo Sapiens
FGSAVPRNV

SEQ ID NO: 147911 - protein, 9 aa, Homo Sapiens
FGVDRAILY

SEQ ID NO: 147912 - protein, 9 aa, Homo Sapiens
FGVPLIVHV

SEQ ID NO: 147913 - protein, 9 aa, Homo Sapiens
FGYPDPTYL

SEQ ID NO: 147914 - protein, 9 aa, Homo Sapiens
FHIDFGHFL

SEQ ID NO: 147915 - protein, 9 aa, Homo Sapiens
FHPTMPLIV

SEQ ID NO: 147916 - protein, 9 aa, Homo Sapiens
FHYPGVQNL

SEQ ID NO: 147917 - protein, 9 aa, Homo Sapiens
FIKSFLVFI

SEQ ID NO: 147918 - protein, 9 aa, Homo Sapiens
FKFIIPQIV

SEQ ID NO: 147919 - protein, 9 aa, Homo Sapiens
FKFPGRQKI

SEQ ID NO: 147920 - protein, 9 aa, Homo Sapiens
FKMTIPLLV

SEQ ID NO: 147921 - protein, 9 aa, Homo Sapiens
FKPAMPRSV

SEQ ID NO: 147922 - protein, 9 aa, Homo Sapiens
FKPDDPNLL

SEQ ID NO: 147923 - protein, 9 aa, Homo Sapiens
FKPPVLVFV

SEQ ID NO: 147924 - protein, 9 aa, Homo Sapiens
FKPTRIIFY

SEQ ID NO: 147925 - protein, 9 aa, Homo Sapiens
FKSHLIRLI

SEQ ID NO: 147926 - protein, 9 aa, Homo Sapiens
FKYDGEIRV

SEQ ID NO: 147927 - protein, 9 aa, Homo Sapiens
FLADIVQKL

SEQ ID NO: 147928 - protein, 9 aa, Homo Sapiens
FLFDHLLTL

SEQ ID NO: 147929 - protein, 9 aa, Homo Sapiens
FLFGYPKRL

SEQ ID NO: 147930 - protein, 9 aa, Homo Sapiens
FLFPHSVLV

SEQ ID NO: 147931 - protein, 9 aa, Homo Sapiens
FLFQEPRSI

SEQ ID NO: 147932 - protein, 9 aa, Homo Sapiens
FLFQGFRLV

SEQ ID NO: 147933 - protein, 9 aa, Homo Sapiens
FLIPFVITV

SEQ ID NO: 147934 - protein, 9 aa, Homo Sapiens
FLIPLVRTL

SEQ ID NO: 147935 - protein, 9 aa, Homo Sapiens
FLLEHIRIL

SEQ ID NO: 147936 - protein, 9 aa, Homo Sapiens
FLPAFVKKM

SEQ ID NO: 147937 - protein, 9 aa, Homo Sapiens
FLPDHPIVL

SEQ ID NO: 147938 - protein, 9 aa, Homo Sapiens
FLPITPHYV

SEQ ID NO: 147939 - protein, 9 aa, Homo Sapiens
FLPLFDRVL

SEQ ID NO: 147940 - protein, 9 aa, Homo Sapiens
FLPNFVKML

SEQ ID NO: 147941 - protein, 9 aa, Homo Sapiens
FLYPFPLAL

SEQ ID NO: 147942 - protein, 9 aa, Homo Sapiens
FMADLERVL

SEQ ID NO: 147943 - protein, 9 aa, Homo Sapiens
FQAEIAQLM

SEQ ID NO: 147944 - protein, 9 aa, Homo Sapiens
FQFQNLRQL

SEQ ID NO: 147945 - protein, 9 aa, Homo Sapiens
FQIGKMRYV

SEQ ID NO: 147946 - protein, 9 aa, Homo Sapiens
FQIVNPHLL

SEQ ID NO: 147947 - protein, 9 aa, Homo Sapiens
FQKERAIFL

SEQ ID NO: 147948 - protein, 9 aa, Homo Sapiens
FQKIQVRLV

SEQ ID NO: 147949 - protein, 9 aa, Homo Sapiens
FQPDLVKRI

SEQ ID NO: 147950 - protein, 9 aa, Homo Sapiens
FQPFLKKWY

SEQ ID NO: 147951 - protein, 9 aa, Homo Sapiens
FQYESKVFY

SEQ ID NO: 147952 - protein, 9 aa, Homo Sapiens
FQYPDTRYL

SEQ ID NO: 147953 - protein, 9 aa, Homo Sapiens
FRADNLNKL

SEQ ID NO: 147954 - protein, 9 aa, Homo Sapiens
FRAEINILL

SEQ ID NO: 147955 - protein, 9 aa, Homo Sapiens
FRAFLKSEF

SEQ ID NO: 147956 - protein, 9 aa, Homo Sapiens
FRAPSMKEL

SEQ ID NO: 147957 - protein, 9 aa, Homo Sapiens
FRAQRNLYI

SEQ ID NO: 147958 - protein, 9 aa, Homo Sapiens
FRASSTLKV

SEQ ID NO: 147959 - protein, 9 aa, Homo Sapiens
FREPRLLVV

SEQ ID NO: 147960 - protein, 9 aa, Homo Sapiens
FRFDGVTSM

SEQ ID NO: 147961 - protein, 9 aa, Homo Sapiens
FRFEEPVVL

SEQ ID NO: 147962 - protein, 9 aa, Homo Sapiens
FRFEMQRDL

SEQ ID NO: 147963 - protein, 9 aa, Homo Sapiens
FRFENVNGY

SEQ ID NO: 147964 - protein, 9 aa, Homo Sapiens
FRFGNPLHI

SEQ ID NO: 147965 - protein, 9 aa, Homo Sapiens
FRFIEVQTL

SEQ ID NO: 147966 - protein, 9 aa, Homo Sapiens
FRFMATNDL

SEQ ID NO: 147967 - protein, 9 aa, Homo Sapiens
FRFNHPVEV

SEQ ID NO: 147968 - protein, 9 aa, Homo Sapiens
FRFPAAVVV

SEQ ID NO: 147969 - protein, 9 aa, Homo Sapiens
FRFPETTFI

SEQ ID NO: 147970 - protein, 9 aa, Homo Sapiens
FRFPHIDLV

SEQ ID NO: 147971 - protein, 9 aa, Homo Sapiens
FRFPKDRAV

SEQ ID NO: 147972 - protein, 9 aa, Homo Sapiens
FRFPSGAEL

SEQ ID NO: 147973 - protein, 9 aa, Homo Sapiens
FRGPTVSNI

SEQ ID NO: 147974 - protein, 9 aa, Homo Sapiens
FRHENIAEL

SEQ ID NO: 147975 - protein, 9 aa, Homo Sapiens
FRHPHIIKL

SEQ ID NO: 147976 - protein, 9 aa, Homo Sapiens
FRHPVLIFI

SEQ ID NO: 147977 - protein, 9 aa, Homo Sapiens
FRIAFEQQL

SEQ ID NO: 147978 - protein, 9 aa, Homo Sapiens
FRIEGVKSV

SEQ ID NO: 147979 - protein, 9 aa, Homo Sapiens
FRIEYEPLV

SEQ ID NO: 147980 - protein, 9 aa, Homo Sapiens
FRINEANQL

SEQ ID NO: 147981 - protein, 9 aa, Homo Sapiens
FRKDFISRI

SEQ ID NO: 147982 - protein, 9 aa, Homo Sapiens
FRKEFQPFL

SEQ ID NO: 147983 - protein, 9 aa, Homo Sapiens
FRKEFYEVV

SEQ ID NO: 147984 - protein, 9 aa, Homo Sapiens
FRKPGEKTF

SEQ ID NO: 147985 - protein, 9 aa, Homo Sapiens
FRLDTPLYF

SEQ ID NO: 147986 - protein, 9 aa, Homo Sapiens
FRMINEQQV

SEQ ID NO: 147987 - protein, 9 aa, Homo Sapiens
FRMPIINNL

SEQ ID NO: 147988 - protein, 9 aa, Homo Sapiens
FRMPVLREY

SEQ ID NO: 147989 - protein, 9 aa, Homo Sapiens
FRNDFLELL

SEQ ID NO: 147990 - protein, 9 aa, Homo Sapiens
FRNEFQNLL

SEQ ID NO: 147991 - protein, 9 aa, Homo Sapiens
FRNFFSNMF

SEQ ID NO: 147992 - protein, 9 aa, Homo Sapiens
FRNGLGNQL

SEQ ID NO: 147993 - protein, 9 aa, Homo Sapiens
FRNNRFPNL

SEQ ID NO: 147994 - protein, 9 aa, Homo Sapiens
FRNPKTSFY

SEQ ID NO: 147995 - protein, 9 aa, Homo Sapiens
FRNPLAPAV

SEQ ID NO: 147996 - protein, 9 aa, Homo Sapiens
FRPDLIEMV

SEQ ID NO: 147997 - protein, 9 aa, Homo Sapiens
FRPEHVSRL

SEQ ID NO: 147998 - protein, 9 aa, Homo Sapiens
FRPEKVLQI

SEQ ID NO: 147999 - protein, 9 aa, Homo Sapiens
FRPELKVLV

SEQ ID NO: 148000 - protein, 9 aa, Homo Sapiens
FRPEWTQRY

SEQ ID NO: 148001 - protein, 9 aa, Homo Sapiens
FRPLYTHEY

SEQ ID NO: 148002 - protein, 9 aa, Homo Sapiens
FRPPGTSDL

SEQ ID NO: 148003 - protein, 9 aa, Homo Sapiens
FRPPITQEI

SEQ ID NO: 148004 - protein, 9 aa, Homo Sapiens
FRPPKEVHL

SEQ ID NO: 148005 - protein, 9 aa, Homo Sapiens
FRPQRPQSL

SEQ ID NO: 148006 - protein, 9 aa, Homo Sapiens
FRPTFENLI

SEQ ID NO: 148007 - protein, 9 aa, Homo Sapiens
FRQEKAVWI

SEQ ID NO: 148008 - protein, 9 aa, Homo Sapiens
FRQGLIRVL

SEQ ID NO: 148009 - protein, 9 aa, Homo Sapiens
FRQIIAVVL

SEQ ID NO: 148010 - protein, 9 aa, Homo Sapiens
FRSAEPNAL

SEQ ID NO: 148011 - protein, 9 aa, Homo Sapiens
FRSEDIKRL

SEQ ID NO: 148012 - protein, 9 aa, Homo Sapiens
FRSEHELDV

SEQ ID NO: 148013 - protein, 9 aa, Homo Sapiens
FRSFVVSKF

SEQ ID NO: 148014 - protein, 9 aa, Homo Sapiens
FRSLLINAV

SEQ ID NO: 148015 - protein, 9 aa, Homo Sapiens
FRSPLARQL

SEQ ID NO: 148016 - protein, 9 aa, Homo Sapiens
FRSVFPLSV

SEQ ID NO: 148017 - protein, 9 aa, Homo Sapiens
FRTEKIRKL

SEQ ID NO: 148018 - protein, 9 aa, Homo Sapiens
FRTPFPLAF

SEQ ID NO: 148019 - protein, 9 aa, Homo Sapiens
FRVDYILSV

SEQ ID NO: 148020 - protein, 9 aa, Homo Sapiens
FRVEYASKV

SEQ ID NO: 148021 - protein, 9 aa, Homo Sapiens
FRYEGEWKA

SEQ ID NO: 148022 - protein, 9 aa, Homo Sapiens
FRYFSKQEL

SEQ ID NO: 148023 - protein, 9 aa, Homo Sapiens
FRYHGLSSL

SEQ ID NO: 148024 - protein, 9 aa, Homo Sapiens
FRYPFAPMY

SEQ ID NO: 148025 - protein, 9 aa, Homo Sapiens
FRYPQDYQF

SEQ ID NO: 148026 - protein, 9 aa, Homo Sapiens
FRYPTTEEL

SEQ ID NO: 148027 - protein, 9 aa, Homo Sapiens
FSATLPKLL

SEQ ID NO: 148028 - protein, 9 aa, Homo Sapiens
FSFQLPRRL

SEQ ID NO: 148029 - protein, 9 aa, Homo Sapiens
FSPFHASVL

SEQ ID NO: 148030 - protein, 9 aa, Homo Sapiens
FSQNIGRQV

SEQ ID NO: 148031 - protein, 9 aa, Homo Sapiens
FSYAFPKAV

SEQ ID NO: 148032 - protein, 9 aa, Homo Sapiens
FSYSCPKFL

SEQ ID NO: 148033 - protein, 9 aa, Homo Sapiens
FTAAFPRML

SEQ ID NO: 148034 - protein, 9 aa, Homo Sapiens
FTADFVRQL

SEQ ID NO: 148035 - protein, 9 aa, Homo Sapiens
FTHDWMVFV

SEQ ID NO: 148036 - protein, 9 aa, Homo Sapiens
FTPNNIKQV

SEQ ID NO: 148037 - protein, 9 aa, Homo Sapiens
FTSPAVKRL

SEQ ID NO: 148038 - protein, 9 aa, Homo Sapiens
FTSQVIRNL

SEQ ID NO: 148039 - protein, 9 aa, Homo Sapiens
FTTSNIRKV

SEQ ID NO: 148040 - protein, 9 aa, Homo Sapiens
FTVDQIRAI

SEQ ID NO: 148041 - protein, 9 aa, Homo Sapiens
FTVPFLRDV

SEQ ID NO: 148042 - protein, 9 aa, Homo Sapiens
FTYKGLRAL

SEQ ID NO: 148043 - protein, 9 aa, Homo Sapiens
FVADLQRVI

SEQ ID NO: 148044 - protein, 9 aa, Homo Sapiens
FVADRLRAV

SEQ ID NO: 148045 - protein, 9 aa, Homo Sapiens
FVFFLPRLI

SEQ ID NO: 148046 - protein, 9 aa, Homo Sapiens
FVFPGELLL

SEQ ID NO: 148047 - protein, 9 aa, Homo Sapiens
FVIETARQL

SEQ ID NO: 148048 - protein, 9 aa, Homo Sapiens
FVKDSIRLV

SEQ ID NO: 148049 - protein, 9 aa, Homo Sapiens
FVNPSLRVL

SEQ ID NO: 148050 - protein, 9 aa, Homo Sapiens
FVRDMIREV

SEQ ID NO: 148051 - protein, 9 aa, Homo Sapiens
FVSPLVKYL

SEQ ID NO: 148052 - protein, 9 aa, Homo Sapiens
FVTGIARYI

SEQ ID NO: 148053 - protein, 9 aa, Homo Sapiens
FVTPHPRRI

SEQ ID NO: 148054 - protein, 9 aa, Homo Sapiens
FVVDHVIKI

SEQ ID NO: 148055 - protein, 9 aa, Homo Sapiens
FVYDEVRKL

SEQ ID NO: 148056 - protein, 9 aa, Homo Sapiens
FVYPWYRDV

SEQ ID NO: 148057 - protein, 9 aa, Homo Sapiens
FYAELYHII

SEQ ID NO: 148058 - protein, 9 aa, Homo Sapiens
FYATLVRYV

SEQ ID NO: 148059 - protein, 9 aa, Homo Sapiens
FYHQLLREL

SEQ ID NO: 148060 - protein, 9 aa, Homo Sapiens
FYIDRGRQL

SEQ ID NO: 148061 - protein, 9 aa, Homo Sapiens
FYIPQRPYM

SEQ ID NO: 148062 - protein, 9 aa, Homo Sapiens
FYNERVVIM

SEQ ID NO: 148063 - protein, 9 aa, Homo Sapiens
FYNEYVREL

SEQ ID NO: 148064 - protein, 9 aa, Homo Sapiens
FYVDTVRAF

SEQ ID NO: 148065 - protein, 9 aa, Homo Sapiens
FYVGQPRFL

SEQ ID NO: 148066 - protein, 9 aa, Homo Sapiens
FYVPFAKAL

SEQ ID NO: 148067 - protein, 9 aa, Homo Sapiens
FYVPLPRHL

SEQ ID NO: 148068 - protein, 9 aa, Homo Sapiens
GAFGEVRLV

SEQ ID NO: 148069 - protein, 9 aa, Homo Sapiens
GFAGDDAPR

SEQ ID NO: 148070 - protein, 9 aa, Homo Sapiens
GQPDVVRLL

SEQ ID NO: 148071 - protein, 9 aa, Homo Sapiens
GRADALRVL

SEQ ID NO: 148072 - protein, 9 aa, Homo Sapiens
GRAFIFPSY

SEQ ID NO: 148073 - protein, 9 aa, Homo Sapiens
GRAFLFNKV

SEQ ID NO: 148074 - protein, 9 aa, Homo Sapiens
GRAYLFNSV

SEQ ID NO: 148075 - protein, 9 aa, Homo Sapiens
GRFFWIVRV

SEQ ID NO: 148076 - protein, 9 aa, Homo Sapiens
GRFPQVQAF

SEQ ID NO: 148077 - protein, 9 aa, Homo Sapiens
GRIDIKQLI

SEQ ID NO: 148078 - protein, 9 aa, Homo Sapiens
GRIDRIIYV

SEQ ID NO: 148079 - protein, 9 aa, Homo Sapiens
GRMVQVHEL

SEQ ID NO: 148080 - protein, 9 aa, Homo Sapiens
GRNPFVHEL

SEQ ID NO: 148081 - protein, 9 aa, Homo Sapiens
GRPEFVIKV

SEQ ID NO: 148082 - protein, 9 aa, Homo Sapiens
GRPERQFFV

SEQ ID NO: 148083 - protein, 9 aa, Homo Sapiens
GRPLFPHVL

SEQ ID NO: 148084 - protein, 9 aa, Homo Sapiens
GRPMNIQLV

SEQ ID NO: 148085 - protein, 9 aa, Homo Sapiens
GRPVFVIRI

SEQ ID NO: 148086 - protein, 9 aa, Homo Sapiens
GRPVYVTLI

SEQ ID NO: 148087 - protein, 9 aa, Homo Sapiens
GRSLIINHL

SEQ ID NO: 148088 - protein, 9 aa, Homo Sapiens
GRSPLIHAV

SEQ ID NO: 148089 - protein, 9 aa, Homo Sapiens
GRTEILKWY

SEQ ID NO: 148090 - protein, 9 aa, Homo Sapiens
GRTSLTNLL

SEQ ID NO: 148091 - protein, 9 aa, Homo Sapiens
GRYPEAQSV

SEQ ID NO: 148092 - protein, 9 aa, Homo Sapiens
GRYTGVRII

SEQ ID NO: 148093 - protein, 9 aa, Homo Sapiens
HAAPFQNIL

SEQ ID NO: 148094 - protein, 9 aa, Homo Sapiens
HAFLYIRQL

SEQ ID NO: 148095 - protein, 9 aa, Homo Sapiens
HAPFTATSL

SEQ ID NO: 148096 - protein, 9 aa, Homo Sapiens
HAPLTNIPL

SEQ ID NO: 148097 - protein, 9 aa, Homo Sapiens
HFPELVKII

SEQ ID NO: 148098 - protein, 9 aa, Homo Sapiens
HFPGLASEL

SEQ ID NO: 148099 - protein, 9 aa, Homo Sapiens
HGFAGVILI

SEQ ID NO: 148100 - protein, 9 aa, Homo Sapiens
HGVAQVRFV

SEQ ID NO: 148101 - protein, 9 aa, Homo Sapiens
HHIPDVITY

SEQ ID NO: 148102 - protein, 9 aa, Homo Sapiens
HLPDFVKQL

SEQ ID NO: 148103 - protein, 9 aa, Homo Sapiens
HLPSHIRIL

SEQ ID NO: 148104 - protein, 9 aa, Homo Sapiens
HLVDIVRSL

SEQ ID NO: 148105 - protein, 9 aa, Homo Sapiens
HQSGIVQLL

SEQ ID NO: 148106 - protein, 9 aa, Homo Sapiens
HRAVFPIYL

SEQ ID NO: 148107 - protein, 9 aa, Homo Sapiens
HRFQTQQLL

SEQ ID NO: 148108 - protein, 9 aa, Homo Sapiens
HRFVSVSKL

SEQ ID NO: 148109 - protein, 9 aa, Homo Sapiens
HRFYMIQSF

SEQ ID NO: 148110 - protein, 9 aa, Homo Sapiens
HRGDIVSLV

SEQ ID NO: 148111 - protein, 9 aa, Homo Sapiens
HRLPHVLLL

SEQ ID NO: 148112 - protein, 9 aa, Homo Sapiens
HRNEVTVEL

SEQ ID NO: 148113 - protein, 9 aa, Homo Sapiens
HRNPLPEYL

SEQ ID NO: 148114 - protein, 9 aa, Homo Sapiens
HRPEFSSCL

SEQ ID NO: 148115 - protein, 9 aa, Homo Sapiens
HRPELVTKL

SEQ ID NO: 148116 - protein, 9 aa, Homo Sapiens
HRPESVVLV

SEQ ID NO: 148117 - protein, 9 aa, Homo Sapiens
HRPGIVVDY

SEQ ID NO: 148118 - protein, 9 aa, Homo Sapiens
HRPVNVVNV

SEQ ID NO: 148119 - protein, 9 aa, Homo Sapiens
HRSPLVLAY

SEQ ID NO: 148120 - protein, 9 aa, Homo Sapiens
HRYEVVTEL

SEQ ID NO: 148121 - protein, 9 aa, Homo Sapiens
HRYPNQVYY

SEQ ID NO: 148122 - protein, 9 aa, Homo Sapiens
HYIDIERKL

SEQ ID NO: 148123 - protein, 9 aa, Homo Sapiens
HYIDRVRAL

SEQ ID NO: 148124 - protein, 9 aa, Homo Sapiens
HYIDVARLL

SEQ ID NO: 148125 - protein, 9 aa, Homo Sapiens
HYSEKLREL

SEQ ID NO: 148126 - protein, 9 aa, Homo Sapiens
IAFEFPVLV

SEQ ID NO: 148127 - protein, 9 aa, Homo Sapiens
IAFPTSISV

SEQ ID NO: 148128 - protein, 9 aa, Homo Sapiens
IAFSRPVKY

SEQ ID NO: 148129 - protein, 9 aa, Homo Sapiens
IAINISRNL

SEQ ID NO: 148130 - protein, 9 aa, Homo Sapiens
IAIPFLIKL

SEQ ID NO: 148131 - protein, 9 aa, Homo Sapiens
IASAIVNEL

SEQ ID NO: 148132 - protein, 9 aa, Homo Sapiens
IASTILRLI

SEQ ID NO: 148133 - protein, 9 aa, Homo Sapiens
IAVHVVRVL

SEQ ID NO: 148134 - protein, 9 aa, Homo Sapiens
IAVSIVRAL

SEQ ID NO: 148135 - protein, 9 aa, Homo Sapiens
IERVTLPYL

SEQ ID NO: 148136 - protein, 9 aa, Homo Sapiens
IFPEFLKEL

SEQ ID NO: 148137 - protein, 9 aa, Homo Sapiens
IGYGHVRAV

SEQ ID NO: 148138 - protein, 9 aa, Homo Sapiens
IHPDIFPLL

SEQ ID NO: 148139 - protein, 9 aa, Homo Sapiens
IHSPVVNEL

SEQ ID NO: 148140 - protein, 9 aa, Homo Sapiens
IHVDFPVIL

SEQ ID NO: 148141 - protein, 9 aa, Homo Sapiens
IIFEQIRFV

SEQ ID NO: 148142 - protein, 9 aa, Homo Sapiens
IIINHVISV

SEQ ID NO: 148143 - protein, 9 aa, Homo Sapiens
IITAFIRAL

SEQ ID NO: 148144 - protein, 9 aa, Homo Sapiens
IITDLLRSV

SEQ ID NO: 148145 - protein, 9 aa, Homo Sapiens
IIVDLARYV

SEQ ID NO: 148146 - protein, 9 aa, Homo Sapiens
ILAEIARIL

SEQ ID NO: 148147 - protein, 9 aa, Homo Sapiens
ILPDDPRQM

SEQ ID NO: 148148 - protein, 9 aa, Homo Sapiens
ILPGFQRTV

SEQ ID NO: 148149 - protein, 9 aa, Homo Sapiens
ILPKWLRFI

SEQ ID NO: 148150 - protein, 9 aa, Homo Sapiens
ILPQRIREL

SEQ ID NO: 148151 - protein, 9 aa, Homo Sapiens
ILPSSIKEL

SEQ ID NO: 148152 - protein, 9 aa, Homo Sapiens
ILPTLVRLL

SEQ ID NO: 148153 - protein, 9 aa, Homo Sapiens
ILPWYPKVL

SEQ ID NO: 148154 - protein, 9 aa, Homo Sapiens
ILSGVIRSV

SEQ ID NO: 148155 - protein, 9 aa, Homo Sapiens
ILTEIYRIV

SEQ ID NO: 148156 - protein, 9 aa, Homo Sapiens
IPGVRSVVL

SEQ ID NO: 148157 - protein, 9 aa, Homo Sapiens
IPSRLPLLL

SEQ ID NO: 148158 - protein, 9 aa, Homo Sapiens
IQPDNIVYV

SEQ ID NO: 148159 - protein, 9 aa, Homo Sapiens
IQYIRPVFV

SEQ ID NO: 148160 - protein, 9 aa, Homo Sapiens
IRAAWTRAL

SEQ ID NO: 148161 - protein, 9 aa, Homo Sapiens
IRADLTHLL

SEQ ID NO: 148162 - protein, 9 aa, Homo Sapiens
IRAEPLNSV

SEQ ID NO: 148163 - protein, 9 aa, Homo Sapiens
IRAERDILV

SEQ ID NO: 148164 - protein, 9 aa, Homo Sapiens
IRASALRVL

SEQ ID NO: 148165 - protein, 9 aa, Homo Sapiens
IRASLYNAV

SEQ ID NO: 148166 - protein, 9 aa, Homo Sapiens
IRDDHIRFI

SEQ ID NO: 148167 - protein, 9 aa, Homo Sapiens
IRFPDILRV

SEQ ID NO: 148168 - protein, 9 aa, Homo Sapiens
IRFPMQRNL

SEQ ID NO: 148169 - protein, 9 aa, Homo Sapiens
IRGSKIRFL

SEQ ID NO: 148170 - protein, 9 aa, Homo Sapiens
IRGSTIKYL

SEQ ID NO: 148171 - protein, 9 aa, Homo Sapiens
IRHDVIVSI

SEQ ID NO: 148172 - protein, 9 aa, Homo Sapiens
IRHPNIITL

SEQ ID NO: 148173 - protein, 9 aa, Homo Sapiens
IRIRVVQML

SEQ ID NO: 148174 - protein, 9 aa, Homo Sapiens
IRKAEIIKL

SEQ ID NO: 148175 - protein, 9 aa, Homo Sapiens
IRLEKVLLV

SEQ ID NO: 148176 - protein, 9 aa, Homo Sapiens
IRLPETIDL

SEQ ID NO: 148177 - protein, 9 aa, Homo Sapiens
IRMEHVKIV

SEQ ID NO: 148178 - protein, 9 aa, Homo Sapiens
IRNDYINWV

SEQ ID NO: 148179 - protein, 9 aa, Homo Sapiens
IRNDYYLNL

SEQ ID NO: 148180 - protein, 9 aa, Homo Sapiens
IRNILLHQL

SEQ ID NO: 148181 - protein, 9 aa, Homo Sapiens
IRNQIIREL

SEQ ID NO: 148182 - protein, 9 aa, Homo Sapiens
IRPDINVDV

SEQ ID NO: 148183 - protein, 9 aa, Homo Sapiens
IRPDIVNFV

SEQ ID NO: 148184 - protein, 9 aa, Homo Sapiens
IRPDRQTLM

SEQ ID NO: 148185 - protein, 9 aa, Homo Sapiens
IRPEHVLRL

SEQ ID NO: 148186 - protein, 9 aa, Homo Sapiens
IRPENVIIY

SEQ ID NO: 148187 - protein, 9 aa, Homo Sapiens
IRPEYAWIV

SEQ ID NO: 148188 - protein, 9 aa, Homo Sapiens
IRPGLTTVL

SEQ ID NO: 148189 - protein, 9 aa, Homo Sapiens
IRPLIVALI

SEQ ID NO: 148190 - protein, 9 aa, Homo Sapiens
IRPNIILVL

SEQ ID NO: 148191 - protein, 9 aa, Homo Sapiens
IRPQMQQIL

SEQ ID NO: 148192 - protein, 9 aa, Homo Sapiens
IRPVSASFL

SEQ ID NO: 148193 - protein, 9 aa, Homo Sapiens
IRQGKITEL

SEQ ID NO: 148194 - protein, 9 aa, Homo Sapiens
IRRDYLHYI

SEQ ID NO: 148195 - protein, 9 aa, Homo Sapiens
IRSLILNNI

SEQ ID NO: 148196 - protein, 9 aa, Homo Sapiens
IRSSYIRVL

SEQ ID NO: 148197 - protein, 9 aa, Homo Sapiens
IRSVELQLV

SEQ ID NO: 148198 - protein, 9 aa, Homo Sapiens
IRTESIRWL

SEQ ID NO: 148199 - protein, 9 aa, Homo Sapiens
IRTGLVRLL

SEQ ID NO: 148200 - protein, 9 aa, Homo Sapiens
IRVGKIITV

SEQ ID NO: 148201 - protein, 9 aa, Homo Sapiens
IRVGWEQLL

SEQ ID NO: 148202 - protein, 9 aa, Homo Sapiens
IRVPFLRQV

SEQ ID NO: 148203 - protein, 9 aa, Homo Sapiens
IRYIDNQVV

SEQ ID NO: 148204 - protein, 9 aa, Homo Sapiens
IRYPDSHQL

SEQ ID NO: 148205 - protein, 9 aa, Homo Sapiens
ISAELIRSL

SEQ ID NO: 148206 - protein, 9 aa, Homo Sapiens
ISAPLVKTL

SEQ ID NO: 148207 - protein, 9 aa, Homo Sapiens
ISFPDPKML

SEQ ID NO: 148208 - protein, 9 aa, Homo Sapiens
ISTPVIRTF

SEQ ID NO: 148209 - protein, 9 aa, Homo Sapiens
ITAEILREL

SEQ ID NO: 148210 - protein, 9 aa, Homo Sapiens
ITAGLIHWI

SEQ ID NO: 148211 - protein, 9 aa, Homo Sapiens
ITFPGIKLI

SEQ ID NO: 148212 - protein, 9 aa, Homo Sapiens
ITFPGLHEL

SEQ ID NO: 148213 - protein, 9 aa, Homo Sapiens
ITKGFPVLL

SEQ ID NO: 148214 - protein, 9 aa, Homo Sapiens
ITRSIINII

SEQ ID NO: 148215 - protein, 9 aa, Homo Sapiens
ITSASVRLV

SEQ ID NO: 148216 - protein, 9 aa, Homo Sapiens
ITTTVTRVL

SEQ ID NO: 148217 - protein, 9 aa, Homo Sapiens
ITVALPRLV

SEQ ID NO: 148218 - protein, 9 aa, Homo Sapiens
IVIDHLRSL

SEQ ID NO: 148219 - protein, 9 aa, Homo Sapiens
IVIGIIKTV

SEQ ID NO: 148220 - protein, 9 aa, Homo Sapiens
IVINHVISV

SEQ ID NO: 148221 - protein, 9 aa, Homo Sapiens
IYQSKVREL

SEQ ID NO: 148222 - protein, 9 aa, Homo Sapiens
KAAVMVHQL

SEQ ID NO: 148223 - protein, 9 aa, Homo Sapiens
KAMELIREL

SEQ ID NO: 148224 - protein, 9 aa, Homo Sapiens
KATNVVRLL

SEQ ID NO: 148225 - protein, 9 aa, Homo Sapiens
KAVDIVKQV

SEQ ID NO: 148226 - protein, 9 aa, Homo Sapiens
KAYPKRPLL

SEQ ID NO: 148227 - protein, 9 aa, Homo Sapiens
KEEVVTVET

SEQ ID NO: 148228 - protein, 9 aa, Homo Sapiens
KKINWIVQY

SEQ ID NO: 148229 - protein, 9 aa, Homo Sapiens
KKPELVISY

SEQ ID NO: 148230 - protein, 9 aa, Homo Sapiens
KKPEWVILI

SEQ ID NO: 148231 - protein, 9 aa, Homo Sapiens
KKPNFILLL

SEQ ID NO: 148232 - protein, 9 aa, Homo Sapiens
KKPNLILNV

SEQ ID NO: 148233 - protein, 9 aa, Homo Sapiens
KKYPFILEV

SEQ ID NO: 148234 - protein, 9 aa, Homo Sapiens
KLASYVKFY

SEQ ID NO: 148235 - protein, 9 aa, Homo Sapiens
KLPAFVRVV

SEQ ID NO: 148236 - protein, 9 aa, Homo Sapiens
KLPDLERLL

SEQ ID NO: 148237 - protein, 9 aa, Homo Sapiens
KLPEFSRKL

SEQ ID NO: 148238 - protein, 9 aa, Homo Sapiens
KQAEIVKRL

SEQ ID NO: 148239 - protein, 9 aa, Homo Sapiens
KQFPEVIKY

SEQ ID NO: 148240 - protein, 9 aa, Homo Sapiens
KRAAILTKL

SEQ ID NO: 148241 - protein, 9 aa, Homo Sapiens
KRAAVPRFV

SEQ ID NO: 148242 - protein, 9 aa, Homo Sapiens
KRAEEILRL

SEQ ID NO: 148243 - protein, 9 aa, Homo Sapiens
KRAITVQEI

SEQ ID NO: 148244 - protein, 9 aa, Homo Sapiens
KRFSGTVRL

SEQ ID NO: 148245 - protein, 9 aa, Homo Sapiens
KRIDIIHNL

SEQ ID NO: 148246 - protein, 9 aa, Homo Sapiens
KRNDYVHAL

SEQ ID NO: 148247 - protein, 9 aa, Homo Sapiens
KRNELVIRV

SEQ ID NO: 148248 - protein, 9 aa, Homo Sapiens
KRPEIISTV

SEQ ID NO: 148249 - protein, 9 aa, Homo Sapiens
KRPSSVKVF

SEQ ID NO: 148250 - protein, 9 aa, Homo Sapiens
KRPVIVKVL

SEQ ID NO: 148251 - protein, 9 aa, Homo Sapiens
KRSELVNWY

SEQ ID NO: 148252 - protein, 9 aa, Homo Sapiens
KRVTWIVEF

SEQ ID NO: 148253 - protein, 9 aa, Homo Sapiens
KTPDFILQV

SEQ ID NO: 148254 - protein, 9 aa, Homo Sapiens
KTYPLGRIL

SEQ ID NO: 148255 - protein, 9 aa, Homo Sapiens
KVPAFVRMI

SEQ ID NO: 148256 - protein, 9 aa, Homo Sapiens
KVPELIRTI

SEQ ID NO: 148257 - protein, 9 aa, Homo Sapiens
KVPTFVRML

SEQ ID NO: 148258 - protein, 9 aa, Homo Sapiens
KVVDVVRNL

SEQ ID NO: 148259 - protein, 9 aa, Homo Sapiens
KYIDKTIRV

SEQ ID NO: 148260 - protein, 9 aa, Homo Sapiens
KYPDIISRI

SEQ ID NO: 148261 - protein, 9 aa, Homo Sapiens
KYPLLLREI

SEQ ID NO: 148262 - protein, 9 aa, Homo Sapiens
LAAAMVRVL

SEQ ID NO: 148263 - protein, 9 aa, Homo Sapiens
LAATFIRSL

SEQ ID NO: 148264 - protein, 9 aa, Homo Sapiens
LAPLKYLAL

SEQ ID NO: 148265 - protein, 9 aa, Homo Sapiens
LASPVLRSV

SEQ ID NO: 148266 - protein, 9 aa, Homo Sapiens
LAVNLTRVL

SEQ ID NO: 148267 - protein, 9 aa, Homo Sapiens
LFVDRIIYI

SEQ ID NO: 148268 - protein, 9 aa, Homo Sapiens
LKPDLVNVI

SEQ ID NO: 148269 - protein, 9 aa, Homo Sapiens
LKPGMVVTF

SEQ ID NO: 148270 - protein, 9 aa, Homo Sapiens
LKPNLVLDI

SEQ ID NO: 148271 - protein, 9 aa, Homo Sapiens
LKPPHVILV

SEQ ID NO: 148272 - protein, 9 aa, Homo Sapiens
LKPSNILYV

SEQ ID NO: 148273 - protein, 9 aa, Homo Sapiens
LLARSPFLV

SEQ ID NO: 148274 - protein, 9 aa, Homo Sapiens
LLFMLVLTV

SEQ ID NO: 148275 - protein, 9 aa, Homo Sapiens
LLLHLPRYL

SEQ ID NO: 148276 - protein, 9 aa, Homo Sapiens
LLNPHLRQL

SEQ ID NO: 148277 - protein, 9 aa, Homo Sapiens
LLPDIISRL

SEQ ID NO: 148278 - protein, 9 aa, Homo Sapiens
LLPDIVTCV

SEQ ID NO: 148279 - protein, 9 aa, Homo Sapiens
LLPDLIQKV

SEQ ID NO: 148280 - protein, 9 aa, Homo Sapiens
LLPDNVHYV

SEQ ID NO: 148281 - protein, 9 aa, Homo Sapiens
LLPKHPHLV

SEQ ID NO: 148282 - protein, 9 aa, Homo Sapiens
LLPVITKEL

SEQ ID NO: 148283 - protein, 9 aa, Homo Sapiens
LLRTASLHL

SEQ ID NO: 148284 - protein, 9 aa, Homo Sapiens
LPINGNGKQ

SEQ ID NO: 148285 - protein, 9 aa, Homo Sapiens
LQNAQVHQL

SEQ ID NO: 148286 - protein, 9 aa, Homo Sapiens
LQPSILREV

SEQ ID NO: 148287 - protein, 9 aa, Homo Sapiens
LRAALEVHV

SEQ ID NO: 148288 - protein, 9 aa, Homo Sapiens
LRAEMVAQL

SEQ ID NO: 148289 - protein, 9 aa, Homo Sapiens
LRAGKPHLV

SEQ ID NO: 148290 - protein, 9 aa, Homo Sapiens
LRAVIVRVL

SEQ ID NO: 148291 - protein, 9 aa, Homo Sapiens
LRFDGALNV

SEQ ID NO: 148292 - protein, 9 aa, Homo Sapiens
LRFGNPLLV

SEQ ID NO: 148293 - protein, 9 aa, Homo Sapiens
LRFKKPQSL

SEQ ID NO: 148294 - protein, 9 aa, Homo Sapiens
LRFLFENKL

SEQ ID NO: 148295 - protein, 9 aa, Homo Sapiens
LRFLHENQL

SEQ ID NO: 148296 - protein, 9 aa, Homo Sapiens
LRFNKTVRV

SEQ ID NO: 148297 - protein, 9 aa, Homo Sapiens
LRFPNGVQL

SEQ ID NO: 148298 - protein, 9 aa, Homo Sapiens
LRGDFVRRL

SEQ ID NO: 148299 - protein, 9 aa, Homo Sapiens
LRGDIINEV

SEQ ID NO: 148300 - protein, 9 aa, Homo Sapiens
LRHPAIRVL

SEQ ID NO: 148301 - protein, 9 aa, Homo Sapiens
LRHPGIVNL

SEQ ID NO: 148302 - protein, 9 aa, Homo Sapiens
LRHPNILRL

SEQ ID NO: 148303 - protein, 9 aa, Homo Sapiens
LRHPNIVSL

SEQ ID NO: 148304 - protein, 9 aa, Homo Sapiens
LRHVGLNEV

SEQ ID NO: 148305 - protein, 9 aa, Homo Sapiens
LRIEFEQNL

SEQ ID NO: 148306 - protein, 9 aa, Homo Sapiens
LRIEFEQTL

SEQ ID NO: 148307 - protein, 9 aa, Homo Sapiens
LRIPAVRTV

SEQ ID NO: 148308 - protein, 9 aa, Homo Sapiens
LRIYHEQQV

SEQ ID NO: 148309 - protein, 9 aa, Homo Sapiens
LRMPGVQEY

SEQ ID NO: 148310 - protein, 9 aa, Homo Sapiens
LRNPFVQVF

SEQ ID NO: 148311 - protein, 9 aa, Homo Sapiens
LRNPVLQQV

SEQ ID NO: 148312 - protein, 9 aa, Homo Sapiens
LRPEIAVYV

SEQ ID NO: 148313 - protein, 9 aa, Homo Sapiens
LRPESLHQV

SEQ ID NO: 148314 - protein, 9 aa, Homo Sapiens
LRPFFLLSV

SEQ ID NO: 148315 - protein, 9 aa, Homo Sapiens
LRPLLVKKI

SEQ ID NO: 148316 - protein, 9 aa, Homo Sapiens
LRPNFTIAM

SEQ ID NO: 148317 - protein, 9 aa, Homo Sapiens
LRPPIMIMM

SEQ ID NO: 148318 - protein, 9 aa, Homo Sapiens
LRPPQPRFL

SEQ ID NO: 148319 - protein, 9 aa, Homo Sapiens
LRPQMSQFL

SEQ ID NO: 148320 - protein, 9 aa, Homo Sapiens
LRPVFQQRF

SEQ ID NO: 148321 - protein, 9 aa, Homo Sapiens
LRRPAVVYI

SEQ ID NO: 148322 - protein, 9 aa, Homo Sapiens
LRSDIQKRL

SEQ ID NO: 148323 - protein, 9 aa, Homo Sapiens
LRSDLVLLY

SEQ ID NO: 148324 - protein, 9 aa, Homo Sapiens
LRSEILHRV

SEQ ID NO: 148325 - protein, 9 aa, Homo Sapiens
LRSGKFNVL

SEQ ID NO: 148326 - protein, 9 aa, Homo Sapiens
LRSGVIVRL

SEQ ID NO: 148327 - protein, 9 aa, Homo Sapiens
LRSGVLQRL

SEQ ID NO: 148328 - protein, 9 aa, Homo Sapiens
LRSISSNAL

SEQ ID NO: 148329 - protein, 9 aa, Homo Sapiens
LRSPSVLEV

SEQ ID NO: 148330 - protein, 9 aa, Homo Sapiens
LRSPVYLTV

SEQ ID NO: 148331 - protein, 9 aa, Homo Sapiens
LRTDFAQKL

SEQ ID NO: 148332 - protein, 9 aa, Homo Sapiens
LRVPFVVDI

SEQ ID NO: 148333 - protein, 9 aa, Homo Sapiens
LRYAAVRTL

SEQ ID NO: 148334 - protein, 9 aa, Homo Sapiens
LRYDHQQRL

SEQ ID NO: 148335 - protein, 9 aa, Homo Sapiens
LRYEIPESL

SEQ ID NO: 148336 - protein, 9 aa, Homo Sapiens
LRYGLPVNF

SEQ ID NO: 148337 - protein, 9 aa, Homo Sapiens
LRYPMAVGL

SEQ ID NO: 148338 - protein, 9 aa, Homo Sapiens
LSFMNPRLL

SEQ ID NO: 148339 - protein, 9 aa, Homo Sapiens
LSFPTTKTY

SEQ ID NO: 148340 - protein, 9 aa, Homo Sapiens
LSSSVIREL

SEQ ID NO: 148341 - protein, 9 aa, Homo Sapiens
LSTTVKREL

SEQ ID NO: 148342 - protein, 9 aa, Homo Sapiens
LTFPHPVYY

SEQ ID NO: 148343 - protein, 9 aa, Homo Sapiens
LTIDGIRYV

SEQ ID NO: 148344 - protein, 9 aa, Homo Sapiens
LTMEVIRQV

SEQ ID NO: 148345 - protein, 9 aa, Homo Sapiens
LTPAFPRSL

SEQ ID NO: 148346 - protein, 9 aa, Homo Sapiens
LTPNIVRAL

SEQ ID NO: 148347 - protein, 9 aa, Homo Sapiens
LTVPFARYL

SEQ ID NO: 148348 - protein, 9 aa, Homo Sapiens
LVIDAVREI

SEQ ID NO: 148349 - protein, 9 aa, Homo Sapiens
LVVPFAKVV

SEQ ID NO: 148350 - protein, 9 aa, Homo Sapiens
LVYDGIRDI

SEQ ID NO: 148351 - protein, 9 aa, Homo Sapiens
LYKWFTSQV

SEQ ID NO: 148352 - protein, 9 aa, Homo Sapiens
LYNGATRKL

SEQ ID NO: 148353 - protein, 9 aa, Homo Sapiens
LYPEIPRKL

SEQ ID NO: 148354 - protein, 9 aa, Homo Sapiens
LYSTMVRFL

SEQ ID NO: 148355 - protein, 9 aa, Homo Sapiens
LYTVVPRLV

SEQ ID NO: 148356 - protein, 9 aa, Homo Sapiens
MAAGLARLL

SEQ ID NO: 148357 - protein, 9 aa, Homo Sapiens
MAAGRLLEL

SEQ ID NO: 148358 - protein, 9 aa, Homo Sapiens
MAYAGARFV

SEQ ID NO: 148359 - protein, 9 aa, Homo Sapiens
MKPGKVVLV

SEQ ID NO: 148360 - protein, 9 aa, Homo Sapiens
MLPEFYKTV

SEQ ID NO: 148361 - protein, 9 aa, Homo Sapiens
MLPSILNQL

SEQ ID NO: 148362 - protein, 9 aa, Homo Sapiens
MLPTFVRSI

SEQ ID NO: 148363 - protein, 9 aa, Homo Sapiens
MMAGLLRSL

SEQ ID NO: 148364 - protein, 9 aa, Homo Sapiens
MQFSKPRKL

SEQ ID NO: 148365 - protein, 9 aa, Homo Sapiens
MQGPYRAMV

SEQ ID NO: 148366 - protein, 9 aa, Homo Sapiens
MQIELARYI

SEQ ID NO: 148367 - protein, 9 aa, Homo Sapiens
MQPTHPIRL

SEQ ID NO: 148368 - protein, 9 aa, Homo Sapiens
MRAAINQKL

SEQ ID NO: 148369 - protein, 9 aa, Homo Sapiens
MRALLARLL

SEQ ID NO: 148370 - protein, 9 aa, Homo Sapiens
MRFLAATFL

SEQ ID NO: 148371 - protein, 9 aa, Homo Sapiens
MRPDIVALL

SEQ ID NO: 148372 - protein, 9 aa, Homo Sapiens
MRPLDIVEL

SEQ ID NO: 148373 - protein, 9 aa, Homo Sapiens
MRPTLLWSL

SEQ ID NO: 148374 - protein, 9 aa, Homo Sapiens
MRSVLTQVL

SEQ ID NO: 148375 - protein, 9 aa, Homo Sapiens
MRYLHRIYV

SEQ ID NO: 148376 - protein, 9 aa, Homo Sapiens
MRYLLPSVV

SEQ ID NO: 148377 - protein, 9 aa, Homo Sapiens
MSSSVVRRL

SEQ ID NO: 148378 - protein, 9 aa, Homo Sapiens
MSVYLVRQL

SEQ ID NO: 148379 - protein, 9 aa, Homo Sapiens
MTPEIIQKL

SEQ ID NO: 148380 - protein, 9 aa, Homo Sapiens
MTSNIVQCL

SEQ ID NO: 148381 - protein, 9 aa, Homo Sapiens
MVSAIVRTM

SEQ ID NO: 148382 - protein, 9 aa, Homo Sapiens
MVYGGVRIV

SEQ ID NO: 148383 - protein, 9 aa, Homo Sapiens
MYPGLPSRL

SEQ ID NO: 148384 - protein, 9 aa, Homo Sapiens
NALGHVRYV

SEQ ID NO: 148385 - protein, 9 aa, Homo Sapiens
NAMGYVRMI

SEQ ID NO: 148386 - protein, 9 aa, Homo Sapiens
NAYTGIVLL

SEQ ID NO: 148387 - protein, 9 aa, Homo Sapiens
NGVPFVRTI

SEQ ID NO: 148388 - protein, 9 aa, Homo Sapiens
NHIGWVQEF

SEQ ID NO: 148389 - protein, 9 aa, Homo Sapiens
NHPEIVQLV

SEQ ID NO: 148390 - protein, 9 aa, Homo Sapiens
NHPNIVKLY

SEQ ID NO: 148391 - protein, 9 aa, Homo Sapiens
NHPNVIKYY

SEQ ID NO: 148392 - protein, 9 aa, Homo Sapiens
NIFVRPSLV

SEQ ID NO: 148393 - protein, 9 aa, Homo Sapiens
NKPEYIQML

SEQ ID NO: 148394 - protein, 9 aa, Homo Sapiens
NKYPQAVFL

SEQ ID NO: 148395 - protein, 9 aa, Homo Sapiens
NLPYFLRYI

SEQ ID NO: 148396 - protein, 9 aa, Homo Sapiens
NLYPFVKTV

SEQ ID NO: 148397 - protein, 9 aa, Homo Sapiens
NMASFVRQL

SEQ ID NO: 148398 - protein, 9 aa, Homo Sapiens
NQIPFIIQY

SEQ ID NO: 148399 - protein, 9 aa, Homo Sapiens
NRADLIRHF

SEQ ID NO: 148400 - protein, 9 aa, Homo Sapiens
NRADLLIWL

SEQ ID NO: 148401 - protein, 9 aa, Homo Sapiens
NRAELYQHL

SEQ ID NO: 148402 - protein, 9 aa, Homo Sapiens
NRAEYYHLL

SEQ ID NO: 148403 - protein, 9 aa, Homo Sapiens
NRFKGVKYF

SEQ ID NO: 148404 - protein, 9 aa, Homo Sapiens
NRFNYPFEL

SEQ ID NO: 148405 - protein, 9 aa, Homo Sapiens
NRFPAVNSL

SEQ ID NO: 148406 - protein, 9 aa, Homo Sapiens
NRFPWPKVL

SEQ ID NO: 148407 - protein, 9 aa, Homo Sapiens
NRFWPIIQI

SEQ ID NO: 148408 - protein, 9 aa, Homo Sapiens
NRIAYIHLV

SEQ ID NO: 148409 - protein, 9 aa, Homo Sapiens
NRIDLVKYY

SEQ ID NO: 148410 - protein, 9 aa, Homo Sapiens
NRINTIRQL

SEQ ID NO: 148411 - protein, 9 aa, Homo Sapiens
NRIPKEITV

SEQ ID NO: 148412 - protein, 9 aa, Homo Sapiens
NRLPKPVLL

SEQ ID NO: 148413 - protein, 9 aa, Homo Sapiens
NRLQWVQLV

SEQ ID NO: 148414 - protein, 9 aa, Homo Sapiens
NRMPIARKI

SEQ ID NO: 148415 - protein, 9 aa, Homo Sapiens
NRNETIQWL

SEQ ID NO: 148416 - protein, 9 aa, Homo Sapiens
NRPEFITEF

SEQ ID NO: 148417 - protein, 9 aa, Homo Sapiens
NRPKALNAL

SEQ ID NO: 148418 - protein, 9 aa, Homo Sapiens
NRPKFEQIV

SEQ ID NO: 148419 - protein, 9 aa, Homo Sapiens
NRPKFLNAL

SEQ ID NO: 148420 - protein, 9 aa, Homo Sapiens
NRPNLYYEV

SEQ ID NO: 148421 - protein, 9 aa, Homo Sapiens
NRVKIVQLL

SEQ ID NO: 148422 - protein, 9 aa, Homo Sapiens
NRVWWQILL

SEQ ID NO: 148423 - protein, 9 aa, Homo Sapiens
NRYDGIYKV

SEQ ID NO: 148424 - protein, 9 aa, Homo Sapiens
NRYHVPVVV

SEQ ID NO: 148425 - protein, 9 aa, Homo Sapiens
NRYLVVLYY

SEQ ID NO: 148426 - protein, 9 aa, Homo Sapiens
NRYPASSLV

SEQ ID NO: 148427 - protein, 9 aa, Homo Sapiens
NSFGFPQYV

SEQ ID NO: 148428 - protein, 9 aa, Homo Sapiens
NSTYIMRVL

SEQ ID NO: 148429 - protein, 9 aa, Homo Sapiens
NSYVSPRIL

SEQ ID NO: 148430 - protein, 9 aa, Homo Sapiens
NTIPFIIRY

SEQ ID NO: 148431 - protein, 9 aa, Homo Sapiens
NVFFYPRLL

SEQ ID NO: 148432 - protein, 9 aa, Homo Sapiens
NVKAFISNV

SEQ ID NO: 148433 - protein, 9 aa, Homo Sapiens
NVTPLARIV

SEQ ID NO: 148434 - protein, 9 aa, Homo Sapiens
NVVNIARYL

SEQ ID NO: 148435 - protein, 9 aa, Homo Sapiens
NYIDIVKYV

SEQ ID NO: 148436 - protein, 9 aa, Homo Sapiens
NYIDKIKVV

SEQ ID NO: 148437 - protein, 9 aa, Homo Sapiens
NYIDKVRFL

SEQ ID NO: 148438 - protein, 9 aa, Homo Sapiens
NYIEFTRIL

SEQ ID NO: 148439 - protein, 9 aa, Homo Sapiens
NYLPFIMEL

SEQ ID NO: 148440 - protein, 9 aa, Homo Sapiens
NYMNILRFL

SEQ ID NO: 148441 - protein, 9 aa, Homo Sapiens
NYRWWPAEI

SEQ ID NO: 148442 - protein, 9 aa, Homo Sapiens
NYRWWPAEV

SEQ ID NO: 148443 - protein, 9 aa, Homo Sapiens
NYVSLTRIL

SEQ ID NO: 148444 - protein, 9 aa, Homo Sapiens
PIRLLAAAA

SEQ ID NO: 148445 - protein, 9 aa, Homo Sapiens
PKREIQKIL

SEQ ID NO: 148446 - protein, 9 aa, Homo Sapiens
PYLDIVREV

SEQ ID NO: 148447 - protein, 9 aa, Homo Sapiens
QAAPNLRKL

SEQ ID NO: 148448 - protein, 9 aa, Homo Sapiens
QALPWVRYI

SEQ ID NO: 148449 - protein, 9 aa, Homo Sapiens
QAPNFSRLL

SEQ ID NO: 148450 - protein, 9 aa, Homo Sapiens
QASGKIRLL

SEQ ID NO: 148451 - protein, 9 aa, Homo Sapiens
QAYPEVRIV

SEQ ID NO: 148452 - protein, 9 aa, Homo Sapiens
QFINFPIYV

SEQ ID NO: 148453 - protein, 9 aa, Homo Sapiens
QGVGPIRKV

SEQ ID NO: 148454 - protein, 9 aa, Homo Sapiens
QHIDFAIQY

SEQ ID NO: 148455 - protein, 9 aa, Homo Sapiens
QKPNFVIIL

SEQ ID NO: 148456 - protein, 9 aa, Homo Sapiens
QKYPFPILI

SEQ ID NO: 148457 - protein, 9 aa, Homo Sapiens
QLPNFAFSV

SEQ ID NO: 148458 - protein, 9 aa, Homo Sapiens
QLPPFPREL

SEQ ID NO: 148459 - protein, 9 aa, Homo Sapiens
QMPDIMRLI

SEQ ID NO: 148460 - protein, 9 aa, Homo Sapiens
QRAAMMNLL

SEQ ID NO: 148461 - protein, 9 aa, Homo Sapiens
QRAEVVVQV

SEQ ID NO: 148462 - protein, 9 aa, Homo Sapiens
QRAHQILVL

SEQ ID NO: 148463 - protein, 9 aa, Homo Sapiens
QRALALHVL

SEQ ID NO: 148464 - protein, 9 aa, Homo Sapiens
QRALLVHDL

SEQ ID NO: 148465 - protein, 9 aa, Homo Sapiens
QRAMMANRL

SEQ ID NO: 148466 - protein, 9 aa, Homo Sapiens
QRAVAINRL

SEQ ID NO: 148467 - protein, 9 aa, Homo Sapiens
QRFLEVQYL

SEQ ID NO: 148468 - protein, 9 aa, Homo Sapiens
QRFPNALFV

SEQ ID NO: 148469 - protein, 9 aa, Homo Sapiens
QRFPPPQEL

SEQ ID NO: 148470 - protein, 9 aa, Homo Sapiens
QRGDLIRIL

SEQ ID NO: 148471 - protein, 9 aa, Homo Sapiens
QRNEFLLLL

SEQ ID NO: 148472 - protein, 9 aa, Homo Sapiens
QRNEVVVEL

SEQ ID NO: 148473 - protein, 9 aa, Homo Sapiens
QRNPEISHL

SEQ ID NO: 148474 - protein, 9 aa, Homo Sapiens
QRNQAIQAL

SEQ ID NO: 148475 - protein, 9 aa, Homo Sapiens
QRPGFVIDI

SEQ ID NO: 148476 - protein, 9 aa, Homo Sapiens
QRPPLIAAV

SEQ ID NO: 148477 - protein, 9 aa, Homo Sapiens
QRPSAIQLL

SEQ ID NO: 148478 - protein, 9 aa, Homo Sapiens
QRSEIMMFI

SEQ ID NO: 148479 - protein, 9 aa, Homo Sapiens
QRSLLLLQL

SEQ ID NO: 148480 - protein, 9 aa, Homo Sapiens
QRSLVLFSV

SEQ ID NO: 148481 - protein, 9 aa, Homo Sapiens
QRSRFIVVV

SEQ ID NO: 148482 - protein, 9 aa, Homo Sapiens
QRSYLVQYM

SEQ ID NO: 148483 - protein, 9 aa, Homo Sapiens
QRTSLIVHV

SEQ ID NO: 148484 - protein, 9 aa, Homo Sapiens
QRYPEIRFF

SEQ ID NO: 148485 - protein, 9 aa, Homo Sapiens
QRYPMPQNL

SEQ ID NO: 148486 - protein, 9 aa, Homo Sapiens
QSPAFTRQL

SEQ ID NO: 148487 - protein, 9 aa, Homo Sapiens
QSPDFVRTV

SEQ ID NO: 148488 - protein, 9 aa, Homo Sapiens
QSTDIIRYL

SEQ ID NO: 148489 - protein, 9 aa, Homo Sapiens
QTAALVRQL

SEQ ID NO: 148490 - protein, 9 aa, Homo Sapiens
QTFQHPRYL

SEQ ID NO: 148491 - protein, 9 aa, Homo Sapiens
QTHGFIIRV

SEQ ID NO: 148492 - protein, 9 aa, Homo Sapiens
QTPNFVRGL

SEQ ID NO: 148493 - protein, 9 aa, Homo Sapiens
QYPVIIHLI

SEQ ID NO: 148494 - protein, 9 aa, Homo Sapiens
QYSNNIRQL

SEQ ID NO: 148495 - protein, 9 aa, Homo Sapiens
QYTDLLRLF

SEQ ID NO: 148496 - protein, 9 aa, Homo Sapiens
QYYPNGIRL

SEQ ID NO: 148497 - protein, 9 aa, Homo Sapiens
RAFPGLRYV

SEQ ID NO: 148498 - protein, 9 aa, Homo Sapiens
RAFPLARDV

SEQ ID NO: 148499 - protein, 9 aa, Homo Sapiens
RDYSAILYL

SEQ ID NO: 148500 - protein, 9 aa, Homo Sapiens
RFPEHVREI

SEQ ID NO: 148501 - protein, 9 aa, Homo Sapiens
RGYDFPAVL

SEQ ID NO: 148502 - protein, 9 aa, Homo Sapiens
RIENRILIL

SEQ ID NO: 148503 - protein, 9 aa, Homo Sapiens
RLPDLIKEV

SEQ ID NO: 148504 - protein, 9 aa, Homo Sapiens
RLPELARVL

SEQ ID NO: 148505 - protein, 9 aa, Homo Sapiens
RLPVNVREL

SEQ ID NO: 148506 - protein, 9 aa, Homo Sapiens
RLTPKIQKL

SEQ ID NO: 148507 - protein, 9 aa, Homo Sapiens
RMPELVRQL

SEQ ID NO: 148508 - protein, 9 aa, Homo Sapiens
RQADFVQVL

SEQ ID NO: 148509 - protein, 9 aa, Homo Sapiens
RQINWTVLY

SEQ ID NO: 148510 - protein, 9 aa, Homo Sapiens
RQPDLVLRL

SEQ ID NO: 148511 - protein, 9 aa, Homo Sapiens
RRAPVVVRL

SEQ ID NO: 148512 - protein, 9 aa, Homo Sapiens
RRFPDLNRL

SEQ ID NO: 148513 - protein, 9 aa, Homo Sapiens
RRFPEQVRV

SEQ ID NO: 148514 - protein, 9 aa, Homo Sapiens
RRFPLEQRL

SEQ ID NO: 148515 - protein, 9 aa, Homo Sapiens
RRIDITAKL

SEQ ID NO: 148516 - protein, 9 aa, Homo Sapiens
RRNPDTQWI

SEQ ID NO: 148517 - protein, 9 aa, Homo Sapiens
RRPDLLTMV

SEQ ID NO: 148518 - protein, 9 aa, Homo Sapiens
RRPEFQTLL

SEQ ID NO: 148519 - protein, 9 aa, Homo Sapiens
RRPLLLNSV

SEQ ID NO: 148520 - protein, 9 aa, Homo Sapiens
RRSFIIQNI

SEQ ID NO: 148521 - protein, 9 aa, Homo Sapiens
RRSPFLQVF

SEQ ID NO: 148522 - protein, 9 aa, Homo Sapiens
RRSSIPITV

SEQ ID NO: 148523 - protein, 9 aa, Homo Sapiens
RRYEIAVNL

SEQ ID NO: 148524 - protein, 9 aa, Homo Sapiens
RRYQDAIRV

SEQ ID NO: 148525 - protein, 9 aa, Homo Sapiens
RSFPSVREL

SEQ ID NO: 148526 - protein, 9 aa, Homo Sapiens
RSVDIINML

SEQ ID NO: 148527 - protein, 9 aa, Homo Sapiens
RTTDIVIRI

SEQ ID NO: 148528 - protein, 9 aa, Homo Sapiens
RVFPYSVFY

SEQ ID NO: 148529 - protein, 9 aa, Homo Sapiens
RVIDLLRVI

SEQ ID NO: 148530 - protein, 9 aa, Homo Sapiens
RVSDILRYL

SEQ ID NO: 148531 - protein, 9 aa, Homo Sapiens
RYPDRITLI

SEQ ID NO: 148532 - protein, 9 aa, Homo Sapiens
RYYSDPRFL

SEQ ID NO: 148533 - protein, 9 aa, Homo Sapiens
SAFALVRTI

SEQ ID NO: 148534 - protein, 9 aa, Homo Sapiens
SAFGNVKLV

SEQ ID NO: 148535 - protein, 9 aa, Homo Sapiens
SAFPEVRSL

SEQ ID NO: 148536 - protein, 9 aa, Homo Sapiens
SAFPFPVTV

SEQ ID NO: 148537 - protein, 9 aa, Homo Sapiens
SAFPHLRVL

SEQ ID NO: 148538 - protein, 9 aa, Homo Sapiens
SAGPVHPLV

SEQ ID NO: 148539 - protein, 9 aa, Homo Sapiens
SAKPFMSLV

SEQ ID NO: 148540 - protein, 9 aa, Homo Sapiens
SAKSWPIFL

SEQ ID NO: 148541 - protein, 9 aa, Homo Sapiens
SALSHVRKI

SEQ ID NO: 148542 - protein, 9 aa, Homo Sapiens
SAMESHSLL

SEQ ID NO: 148543 - protein, 9 aa, Homo Sapiens
SAMVRVISV

SEQ ID NO: 148544 - protein, 9 aa, Homo Sapiens
SAPIFTTSL

SEQ ID NO: 148545 - protein, 9 aa, Homo Sapiens
SATELMNIL

SEQ ID NO: 148546 - protein, 9 aa, Homo Sapiens
SATSIMRNL

SEQ ID NO: 148547 - protein, 9 aa, Homo Sapiens
SAVDFIRTL

SEQ ID NO: 148548 - protein, 9 aa, Homo Sapiens
SAVPFLILV

SEQ ID NO: 148549 - protein, 9 aa, Homo Sapiens
SFYEHIITV

SEQ ID NO: 148550 - protein, 9 aa, Homo Sapiens
SGAGILRLV

SEQ ID NO: 148551 - protein, 9 aa, Homo Sapiens
SGAGILRMV

SEQ ID NO: 148552 - protein, 9 aa, Homo Sapiens
SGFSGVIRL

SEQ ID NO: 148553 - protein, 9 aa, Homo Sapiens
SGSQLIRLI

SEQ ID NO: 148554 - protein, 9 aa, Homo Sapiens
SGTDIVRQI

SEQ ID NO: 148555 - protein, 9 aa, Homo Sapiens
SIFPVVRIL

SEQ ID NO: 148556 - protein, 9 aa, Homo Sapiens
SIINHIRIL

SEQ ID NO: 148557 - protein, 9 aa, Homo Sapiens
SIPDFPMHL

SEQ ID NO: 148558 - protein, 9 aa, Homo Sapiens
SIRNFLIYV

SEQ ID NO: 148559 - protein, 9 aa, Homo Sapiens
SKIDFVLSV

SEQ ID NO: 148560 - protein, 9 aa, Homo Sapiens
SKPAFASLL

SEQ ID NO: 148561 - protein, 9 aa, Homo Sapiens
SKPDIISQL

SEQ ID NO: 148562 - protein, 9 aa, Homo Sapiens
SKPGIWREI

SEQ ID NO: 148563 - protein, 9 aa, Homo Sapiens
SLADIAQKL

SEQ ID NO: 148564 - protein, 9 aa, Homo Sapiens
SLANIIRQL

SEQ ID NO: 148565 - protein, 9 aa, Homo Sapiens
SLIDFLRVV

SEQ ID NO: 148566 - protein, 9 aa, Homo Sapiens
SLIEQTTAL

SEQ ID NO: 148567 - protein, 9 aa, Homo Sapiens
SLPEILKEV

SEQ ID NO: 148568 - protein, 9 aa, Homo Sapiens
SLPMLVRQL

SEQ ID NO: 148569 - protein, 9 aa, Homo Sapiens
SLPPLPRKV

SEQ ID NO: 148570 - protein, 9 aa, Homo Sapiens
SLPQLPREL

SEQ ID NO: 148571 - protein, 9 aa, Homo Sapiens
SLPSMIRKI

SEQ ID NO: 148572 - protein, 9 aa, Homo Sapiens
SLSNIVRNL

SEQ ID NO: 148573 - protein, 9 aa, Homo Sapiens
SMAEILRSL

SEQ ID NO: 148574 - protein, 9 aa, Homo Sapiens
SMKAFISKV

SEQ ID NO: 148575 - protein, 9 aa, Homo Sapiens
SNSDVIRQV

SEQ ID NO: 148576 - protein, 9 aa, Homo Sapiens
SNSELIRLI

SEQ ID NO: 148577 - protein, 9 aa, Homo Sapiens
SPVTKELLL

SEQ ID NO: 148578 - protein, 9 aa, Homo Sapiens
SQAPLLRWV

SEQ ID NO: 148579 - protein, 9 aa, Homo Sapiens
SQYPEIIFL

SEQ ID NO: 148580 - protein, 9 aa, Homo Sapiens
SQYPFPVTL

SEQ ID NO: 148581 - protein, 9 aa, Homo Sapiens
SQYPGAKYI

SEQ ID NO: 148582 - protein, 9 aa, Homo Sapiens
SQYQGVVVY

SEQ ID NO: 148583 - protein, 9 aa, Homo Sapiens
SRAALQRYL

SEQ ID NO: 148584 - protein, 9 aa, Homo Sapiens
SRADLIKQY

SEQ ID NO: 148585 - protein, 9 aa, Homo Sapiens
SRADTILCL

SEQ ID NO: 148586 - protein, 9 aa, Homo Sapiens
SRAELEQKI

SEQ ID NO: 148587 - protein, 9 aa, Homo Sapiens
SRAELVQLV

SEQ ID NO: 148588 - protein, 9 aa, Homo Sapiens
SRAFLAQAL

SEQ ID NO: 148589 - protein, 9 aa, Homo Sapiens
SRANVLNKV

SEQ ID NO: 148590 - protein, 9 aa, Homo Sapiens
SRAPFIRNI

SEQ ID NO: 148591 - protein, 9 aa, Homo Sapiens
SRAQFFLHL

SEQ ID NO: 148592 - protein, 9 aa, Homo Sapiens
SRASPVRLL

SEQ ID NO: 148593 - protein, 9 aa, Homo Sapiens
SRFARLQKL

SEQ ID NO: 148594 - protein, 9 aa, Homo Sapiens
SRFDLLWLI

SEQ ID NO: 148595 - protein, 9 aa, Homo Sapiens
SRFDMIFIV

SEQ ID NO: 148596 - protein, 9 aa, Homo Sapiens
SRFEEAMKL

SEQ ID NO: 148597 - protein, 9 aa, Homo Sapiens
SRFGKFIRI

SEQ ID NO: 148598 - protein, 9 aa, Homo Sapiens
SRFGKFVEI

SEQ ID NO: 148599 - protein, 9 aa, Homo Sapiens
SRFIKFQEM

SEQ ID NO: 148600 - protein, 9 aa, Homo Sapiens
SRFPEALRL

SEQ ID NO: 148601 - protein, 9 aa, Homo Sapiens
SRFPMPRYI

SEQ ID NO: 148602 - protein, 9 aa, Homo Sapiens
SRFPYYNSL

SEQ ID NO: 148603 - protein, 9 aa, Homo Sapiens
SRFSRVVLV

SEQ ID NO: 148604 - protein, 9 aa, Homo Sapiens
SRFYYEQRL

SEQ ID NO: 148605 - protein, 9 aa, Homo Sapiens
SRGDFVVEY

SEQ ID NO: 148606 - protein, 9 aa, Homo Sapiens
SRHGLEQYL

SEQ ID NO: 148607 - protein, 9 aa, Homo Sapiens
SRIGHIAHL

SEQ ID NO: 148608 - protein, 9 aa, Homo Sapiens
SRIPFNQAL

SEQ ID NO: 148609 - protein, 9 aa, Homo Sapiens
SRKQGVIKL

SEQ ID NO: 148610 - protein, 9 aa, Homo Sapiens
SRLDHPFFV

SEQ ID NO: 148611 - protein, 9 aa, Homo Sapiens
SRNEDLLEV

SEQ ID NO: 148612 - protein, 9 aa, Homo Sapiens
SRNELLQKL

SEQ ID NO: 148613 - protein, 9 aa, Homo Sapiens
SRNENLRLL

SEQ ID NO: 148614 - protein, 9 aa, Homo Sapiens
SRNWNVREM

SEQ ID NO: 148615 - protein, 9 aa, Homo Sapiens
SRPDFLSYL

SEQ ID NO: 148616 - protein, 9 aa, Homo Sapiens
SRPDLILFL

SEQ ID NO: 148617 - protein, 9 aa, Homo Sapiens
SRPDLLKVV

SEQ ID NO: 148618 - protein, 9 aa, Homo Sapiens
SRPDLPLLV

SEQ ID NO: 148619 - protein, 9 aa, Homo Sapiens
SRPDLYLNL

SEQ ID NO: 148620 - protein, 9 aa, Homo Sapiens
SRPEIIFLL

SEQ ID NO: 148621 - protein, 9 aa, Homo Sapiens
SRPELIFRL

SEQ ID NO: 148622 - protein, 9 aa, Homo Sapiens
SRPGFELVI

SEQ ID NO: 148623 - protein, 9 aa, Homo Sapiens
SRPHFLIEL

SEQ ID NO: 148624 - protein, 9 aa, Homo Sapiens
SRPLLENKL

SEQ ID NO: 148625 - protein, 9 aa, Homo Sapiens
SRSDIFNDV

SEQ ID NO: 148626 - protein, 9 aa, Homo Sapiens
SRSEYLNRL

SEQ ID NO: 148627 - protein, 9 aa, Homo Sapiens
SRSHAVLLV

SEQ ID NO: 148628 - protein, 9 aa, Homo Sapiens
SRSHSIFTV

SEQ ID NO: 148629 - protein, 9 aa, Homo Sapiens
SRSLVLNRL

SEQ ID NO: 148630 - protein, 9 aa, Homo Sapiens
SRSPKVLVL

SEQ ID NO: 148631 - protein, 9 aa, Homo Sapiens
SRSPSLNLL

SEQ ID NO: 148632 - protein, 9 aa, Homo Sapiens
SRSPVVITI

SEQ ID NO: 148633 - protein, 9 aa, Homo Sapiens
SRSVIIREL

SEQ ID NO: 148634 - protein, 9 aa, Homo Sapiens
SRVLKVLSV

SEQ ID NO: 148635 - protein, 9 aa, Homo Sapiens
SRYEHVMKL

SEQ ID NO: 148636 - protein, 9 aa, Homo Sapiens
SRYGDIRRL

SEQ ID NO: 148637 - protein, 9 aa, Homo Sapiens
SRYLYTLVI

SEQ ID NO: 148638 - protein, 9 aa, Homo Sapiens
SRYPDLSLV

SEQ ID NO: 148639 - protein, 9 aa, Homo Sapiens
SRYPDQWIV

SEQ ID NO: 148640 - protein, 9 aa, Homo Sapiens
SRYPNGHFV

SEQ ID NO: 148641 - protein, 9 aa, Homo Sapiens
SRYPTISMV

SEQ ID NO: 148642 - protein, 9 aa, Homo Sapiens
SRYQGVNLY

SEQ ID NO: 148643 - protein, 9 aa, Homo Sapiens
SRYSFIQAL

SEQ ID NO: 148644 - protein, 9 aa, Homo Sapiens
SSADLIRHV

SEQ ID NO: 148645 - protein, 9 aa, Homo Sapiens
SSASLVLKR

SEQ ID NO: 148646 - protein, 9 aa, Homo Sapiens
SSFPTVVIY

SEQ ID NO: 148647 - protein, 9 aa, Homo Sapiens
SSVHLVRNV

SEQ ID NO: 148648 - protein, 9 aa, Homo Sapiens
SSVPGVRLL

SEQ ID NO: 148649 - protein, 9 aa, Homo Sapiens
SSYGNIRAV

SEQ ID NO: 148650 - protein, 9 aa, Homo Sapiens
STFSGIKEL

SEQ ID NO: 148651 - protein, 9 aa, Homo Sapiens
STPDHIREI

SEQ ID NO: 148652 - protein, 9 aa, Homo Sapiens
STYAGIRKV

SEQ ID NO: 148653 - protein, 9 aa, Homo Sapiens
SVADVVRFI

SEQ ID NO: 148654 - protein, 9 aa, Homo Sapiens
SVAELLREL

SEQ ID NO: 148655 - protein, 9 aa, Homo Sapiens
SVFPGARLL

SEQ ID NO: 148656 - protein, 9 aa, Homo Sapiens
SVIDHIHLI

SEQ ID NO: 148657 - protein, 9 aa, Homo Sapiens
SVKDLVILL

SEQ ID NO: 148658 - protein, 9 aa, Homo Sapiens
SVPAFASSL

SEQ ID NO: 148659 - protein, 9 aa, Homo Sapiens
SVYGKLRKV

SEQ ID NO: 148660 - protein, 9 aa, Homo Sapiens
SVYPMPRVI

SEQ ID NO: 148661 - protein, 9 aa, Homo Sapiens
SYAEVMRLV

SEQ ID NO: 148662 - protein, 9 aa, Homo Sapiens
SYGLTPRLL

SEQ ID NO: 148663 - protein, 9 aa, Homo Sapiens
SYIAHLRQI

SEQ ID NO: 148664 - protein, 9 aa, Homo Sapiens
SYIEHIFEI

SEQ ID NO: 148665 - protein, 9 aa, Homo Sapiens
SYKYFPSSL

SEQ ID NO: 148666 - protein, 9 aa, Homo Sapiens
SYNYLIRYL

SEQ ID NO: 148667 - protein, 9 aa, Homo Sapiens
SYPDFLRMM

SEQ ID NO: 148668 - protein, 9 aa, Homo Sapiens
SYPGYLRIV

SEQ ID NO: 148669 - protein, 9 aa, Homo Sapiens
SYPTKVRLI

SEQ ID NO: 148670 - protein, 9 aa, Homo Sapiens
SYTEVIRDV

SEQ ID NO: 148671 - protein, 9 aa, Homo Sapiens
SYVNLKRTI

SEQ ID NO: 148672 - protein, 9 aa, Homo Sapiens
SYVTFPREL

SEQ ID NO: 148673 - protein, 9 aa, Homo Sapiens
TAFAHLREV

SEQ ID NO: 148674 - protein, 9 aa, Homo Sapiens
TAFPALRFV

SEQ ID NO: 148675 - protein, 9 aa, Homo Sapiens
TAQTLVRIL

SEQ ID NO: 148676 - protein, 9 aa, Homo Sapiens
TAVALLRLL

SEQ ID NO: 148677 - protein, 9 aa, Homo Sapiens
TAYLFSRFV

SEQ ID NO: 148678 - protein, 9 aa, Homo Sapiens
TAYPSLRLI

SEQ ID NO: 148679 - protein, 9 aa, Homo Sapiens
TGYGMPRQI

SEQ ID NO: 148680 - protein, 9 aa, Homo Sapiens
THFLQPIYL

SEQ ID NO: 148681 - protein, 9 aa, Homo Sapiens
TISPIIKLL

SEQ ID NO: 148682 - protein, 9 aa, Homo Sapiens
TKADLINNL

SEQ ID NO: 148683 - protein, 9 aa, Homo Sapiens
TKPAIIFRI

SEQ ID NO: 148684 - protein, 9 aa, Homo Sapiens
TKPDIIFKL

SEQ ID NO: 148685 - protein, 9 aa, Homo Sapiens
TKPNFISTL

SEQ ID NO: 148686 - protein, 9 aa, Homo Sapiens
TKVPFPLTL

SEQ ID NO: 148687 - protein, 9 aa, Homo Sapiens
TLANVIRQL

SEQ ID NO: 148688 - protein, 9 aa, Homo Sapiens
TLPDNIKFV

SEQ ID NO: 148689 - protein, 9 aa, Homo Sapiens
TLPPFPTRL

SEQ ID NO: 148690 - protein, 9 aa, Homo Sapiens
TLPSMVHLI

SEQ ID NO: 148691 - protein, 9 aa, Homo Sapiens
TLPYFPHVL

SEQ ID NO: 148692 - protein, 9 aa, Homo Sapiens
TPLKIHPLV

SEQ ID NO: 148693 - protein, 9 aa, Homo Sapiens
TQVHVIREV

SEQ ID NO: 148694 - protein, 9 aa, Homo Sapiens
TRAAIMQAL

SEQ ID NO: 148695 - protein, 9 aa, Homo Sapiens
TRADYLIKL

SEQ ID NO: 148696 - protein, 9 aa, Homo Sapiens
TRAEMILKV

SEQ ID NO: 148697 - protein, 9 aa, Homo Sapiens
TRAKLVSKI

SEQ ID NO: 148698 - protein, 9 aa, Homo Sapiens
TRFDMVQLI

SEQ ID NO: 148699 - protein, 9 aa, Homo Sapiens
TRFDQVMKF

SEQ ID NO: 148700 - protein, 9 aa, Homo Sapiens
TRFPSSRMV

SEQ ID NO: 148701 - protein, 9 aa, Homo Sapiens
TRFSLARQV

SEQ ID NO: 148702 - protein, 9 aa, Homo Sapiens
TRFWPIIQI

SEQ ID NO: 148703 - protein, 9 aa, Homo Sapiens
TRHGVPISV

SEQ ID NO: 148704 - protein, 9 aa, Homo Sapiens
TRIDLIQKL

SEQ ID NO: 148705 - protein, 9 aa, Homo Sapiens
TRIEAVKSL

SEQ ID NO: 148706 - protein, 9 aa, Homo Sapiens
TRILVIREI

SEQ ID NO: 148707 - protein, 9 aa, Homo Sapiens
TRIPKIQKL

SEQ ID NO: 148708 - protein, 9 aa, Homo Sapiens
TRIPKIQQL

SEQ ID NO: 148709 - protein, 9 aa, Homo Sapiens
TRIPKVQKL

SEQ ID NO: 148710 - protein, 9 aa, Homo Sapiens
TRIPRVRVL

SEQ ID NO: 148711 - protein, 9 aa, Homo Sapiens
TRIPVINKV

SEQ ID NO: 148712 - protein, 9 aa, Homo Sapiens
TRLPTPVLL

SEQ ID NO: 148713 - protein, 9 aa, Homo Sapiens
TRNDIVNML

SEQ ID NO: 148714 - protein, 9 aa, Homo Sapiens
TRNGRIVLI

SEQ ID NO: 148715 - protein, 9 aa, Homo Sapiens
TRNLDVQLL

SEQ ID NO: 148716 - protein, 9 aa, Homo Sapiens
TRPDMIRIL

SEQ ID NO: 148717 - protein, 9 aa, Homo Sapiens
TRPLILKTL

SEQ ID NO: 148718 - protein, 9 aa, Homo Sapiens
TRPPHVFAI

SEQ ID NO: 148719 - protein, 9 aa, Homo Sapiens
TRPPHVQLL

SEQ ID NO: 148720 - protein, 9 aa, Homo Sapiens
TRPPLIKNL

SEQ ID NO: 148721 - protein, 9 aa, Homo Sapiens
TRPQLLFSL

SEQ ID NO: 148722 - protein, 9 aa, Homo Sapiens
TRPVIIQAL

SEQ ID NO: 148723 - protein, 9 aa, Homo Sapiens
TRPVRAVFV

SEQ ID NO: 148724 - protein, 9 aa, Homo Sapiens
TRPWLSQHL

SEQ ID NO: 148725 - protein, 9 aa, Homo Sapiens
TRSAIILHL

SEQ ID NO: 148726 - protein, 9 aa, Homo Sapiens
TRSEFYKHI

SEQ ID NO: 148727 - protein, 9 aa, Homo Sapiens
TRSGLIQWV

SEQ ID NO: 148728 - protein, 9 aa, Homo Sapiens
TRSPKLFVV

SEQ ID NO: 148729 - protein, 9 aa, Homo Sapiens
TRSPVFSHL

SEQ ID NO: 148730 - protein, 9 aa, Homo Sapiens
TRTNMLLEL

SEQ ID NO: 148731 - protein, 9 aa, Homo Sapiens
TRVDLVTMV

SEQ ID NO: 148732 - protein, 9 aa, Homo Sapiens
TRVKAVRIL

SEQ ID NO: 148733 - protein, 9 aa, Homo Sapiens
TRVPRVQEV

SEQ ID NO: 148734 - protein, 9 aa, Homo Sapiens
TRYHFLILL

SEQ ID NO: 148735 - protein, 9 aa, Homo Sapiens
TRYLFALQL

SEQ ID NO: 148736 - protein, 9 aa, Homo Sapiens
TRYQGVNLY

SEQ ID NO: 148737 - protein, 9 aa, Homo Sapiens
TSATFLRVV

SEQ ID NO: 148738 - protein, 9 aa, Homo Sapiens
TSIGWLRLL

SEQ ID NO: 148739 - protein, 9 aa, Homo Sapiens
TSPEAFLAL

SEQ ID NO: 148740 - protein, 9 aa, Homo Sapiens
TSSWVIRDL

SEQ ID NO: 148741 - protein, 9 aa, Homo Sapiens
TSYPDPILL

SEQ ID NO: 148742 - protein, 9 aa, Homo Sapiens
TTAAFIRVV

SEQ ID NO: 148743 - protein, 9 aa, Homo Sapiens
TTFPRPVTV

SEQ ID NO: 148744 - protein, 9 aa, Homo Sapiens
TVFPKAKQV

SEQ ID NO: 148745 - protein, 9 aa, Homo Sapiens
TVKEFIVFL

SEQ ID NO: 148746 - protein, 9 aa, Homo Sapiens
TVTDVVRFI

SEQ ID NO: 148747 - protein, 9 aa, Homo Sapiens
TVYPMERLL

SEQ ID NO: 148748 - protein, 9 aa, Homo Sapiens
TVYPMERLV

SEQ ID NO: 148749 - protein, 9 aa, Homo Sapiens
TYFGLPRWV

SEQ ID NO: 148750 - protein, 9 aa, Homo Sapiens
TYINHVVSV

SEQ ID NO: 148751 - protein, 9 aa, Homo Sapiens
TYPEVVRMV

SEQ ID NO: 148752 - protein, 9 aa, Homo Sapiens
TYSEFAREL

SEQ ID NO: 148753 - protein, 9 aa, Homo Sapiens
TYTQLVRLI

SEQ ID NO: 148754 - protein, 9 aa, Homo Sapiens
TYVENLRLL

SEQ ID NO: 148755 - protein, 9 aa, Homo Sapiens
TYVPWPLML

SEQ ID NO: 148756 - protein, 9 aa, Homo Sapiens
VAAMQPRML

SEQ ID NO: 148757 - protein, 9 aa, Homo Sapiens
VAAPRPRLL

SEQ ID NO: 148758 - protein, 9 aa, Homo Sapiens
VALAHIRHV

SEQ ID NO: 148759 - protein, 9 aa, Homo Sapiens
VAPVAQVAL

SEQ ID NO: 148760 - protein, 9 aa, Homo Sapiens
VAYPCAILY

SEQ ID NO: 148761 - protein, 9 aa, Homo Sapiens
VFYPYPQYF

SEQ ID NO: 148762 - protein, 9 aa, Homo Sapiens
VGHPFVIQL

SEQ ID NO: 148763 - protein, 9 aa, Homo Sapiens
VHFIKPLLL

SEQ ID NO: 148764 - protein, 9 aa, Homo Sapiens
VHVGHVVRF

SEQ ID NO: 148765 - protein, 9 aa, Homo Sapiens
VIFATVREL

SEQ ID NO: 148766 - protein, 9 aa, Homo Sapiens
VIKTGVRMI

SEQ ID NO: 148767 - protein, 9 aa, Homo Sapiens
VIPTNVPEL

SEQ ID NO: 148768 - protein, 9 aa, Homo Sapiens
VKPEFSFNI

SEQ ID NO: 148769 - protein, 9 aa, Homo Sapiens
VKPNFPFLL

SEQ ID NO: 148770 - protein, 9 aa, Homo Sapiens
VKYNDPIYV

SEQ ID NO: 148771 - protein, 9 aa, Homo Sapiens
VLIDYQRNV

SEQ ID NO: 148772 - protein, 9 aa, Homo Sapiens
VLPGLIHKV

SEQ ID NO: 148773 - protein, 9 aa, Homo Sapiens
VLPQRIREL

SEQ ID NO: 148774 - protein, 9 aa, Homo Sapiens
VNFTVDQIR

SEQ ID NO: 148775 - protein, 9 aa, Homo Sapiens
VNHPFVVKL

SEQ ID NO: 148776 - protein, 9 aa, Homo Sapiens
VNSGIYRVL

SEQ ID NO: 148777 - protein, 9 aa, Homo Sapiens
VQNPALRLV

SEQ ID NO: 148778 - protein, 9 aa, Homo Sapiens
VQPQFTRFL

SEQ ID NO: 148779 - protein, 9 aa, Homo Sapiens
VRAELIRAF

SEQ ID NO: 148780 - protein, 9 aa, Homo Sapiens
VRAEVEQKL

SEQ ID NO: 148781 - protein, 9 aa, Homo Sapiens
VRAKMAIKL

SEQ ID NO: 148782 - protein, 9 aa, Homo Sapiens
VRAKWFPEV

SEQ ID NO: 148783 - protein, 9 aa, Homo Sapiens
VRALPLLRV

SEQ ID NO: 148784 - protein, 9 aa, Homo Sapiens
VRALSIQRL

SEQ ID NO: 148785 - protein, 9 aa, Homo Sapiens
VRANLPQSF

SEQ ID NO: 148786 - protein, 9 aa, Homo Sapiens
VRAWVVFKL

SEQ ID NO: 148787 - protein, 9 aa, Homo Sapiens
VRFDQVTVY

SEQ ID NO: 148788 - protein, 9 aa, Homo Sapiens
VRFGEYQFL

SEQ ID NO: 148789 - protein, 9 aa, Homo Sapiens
VRFGFEVLY

SEQ ID NO: 148790 - protein, 9 aa, Homo Sapiens
VRFKVPQQI

SEQ ID NO: 148791 - protein, 9 aa, Homo Sapiens
VRFLEQQTL

SEQ ID NO: 148792 - protein, 9 aa, Homo Sapiens
VRFSNIMEI

SEQ ID NO: 148793 - protein, 9 aa, Homo Sapiens
VRISKPKTF

SEQ ID NO: 148794 - protein, 9 aa, Homo Sapiens
VRNLFEQLV

SEQ ID NO: 148795 - protein, 9 aa, Homo Sapiens
VRNNVIIVM

SEQ ID NO: 148796 - protein, 9 aa, Homo Sapiens
VRNPFTVTV

SEQ ID NO: 148797 - protein, 9 aa, Homo Sapiens
VRNPRITSL

SEQ ID NO: 148798 - protein, 9 aa, Homo Sapiens
VRPAEPAFL

SEQ ID NO: 148799 - protein, 9 aa, Homo Sapiens
VRPALQHVV

SEQ ID NO: 148800 - protein, 9 aa, Homo Sapiens
VRPDLRQDL

SEQ ID NO: 148801 - protein, 9 aa, Homo Sapiens
VRPDNTYEV

SEQ ID NO: 148802 - protein, 9 aa, Homo Sapiens
VRPDTVRNL

SEQ ID NO: 148803 - protein, 9 aa, Homo Sapiens
VRPFGVSLL

SEQ ID NO: 148804 - protein, 9 aa, Homo Sapiens
VRPGFPVSL

SEQ ID NO: 148805 - protein, 9 aa, Homo Sapiens
VRPGILVLI

SEQ ID NO: 148806 - protein, 9 aa, Homo Sapiens
VRPKVVRSV

SEQ ID NO: 148807 - protein, 9 aa, Homo Sapiens
VRPLFCALL

SEQ ID NO: 148808 - protein, 9 aa, Homo Sapiens
VRPLLPSEL

SEQ ID NO: 148809 - protein, 9 aa, Homo Sapiens
VRPNLPQLL

SEQ ID NO: 148810 - protein, 9 aa, Homo Sapiens
VRPPIVKQL

SEQ ID NO: 148811 - protein, 9 aa, Homo Sapiens
VRPPQIKSL

SEQ ID NO: 148812 - protein, 9 aa, Homo Sapiens
VRPPRPHVV

SEQ ID NO: 148813 - protein, 9 aa, Homo Sapiens
VRPSVIQKL

SEQ ID NO: 148814 - protein, 9 aa, Homo Sapiens
VRPVFLISI

SEQ ID NO: 148815 - protein, 9 aa, Homo Sapiens
VRSDKPKLF

SEQ ID NO: 148816 - protein, 9 aa, Homo Sapiens
VRSPVVHSV

SEQ ID NO: 148817 - protein, 9 aa, Homo Sapiens
VRTSFLLNL

SEQ ID NO: 148818 - protein, 9 aa, Homo Sapiens
VRWPGVKLL

SEQ ID NO: 148819 - protein, 9 aa, Homo Sapiens
VRYPDRITL

SEQ ID NO: 148820 - protein, 9 aa, Homo Sapiens
VRYPERITI

SEQ ID NO: 148821 - protein, 9 aa, Homo Sapiens
VRYPGTTRV

SEQ ID NO: 148822 - protein, 9 aa, Homo Sapiens
VSLDFIRAI

SEQ ID NO: 148823 - protein, 9 aa, Homo Sapiens
VSVSFIRTI

SEQ ID NO: 148824 - protein, 9 aa, Homo Sapiens
VTFPGIKLI

SEQ ID NO: 148825 - protein, 9 aa, Homo Sapiens
VTIDGIRFV

SEQ ID NO: 148826 - protein, 9 aa, Homo Sapiens
VTYNYPVHY

SEQ ID NO: 148827 - protein, 9 aa, Homo Sapiens
VVAFILRQV

SEQ ID NO: 148828 - protein, 9 aa, Homo Sapiens
VVAPLLRKV

SEQ ID NO: 148829 - protein, 9 aa, Homo Sapiens
VVFIGVRYV

SEQ ID NO: 148830 - protein, 9 aa, Homo Sapiens
VVPQFVVFY

SEQ ID NO: 148831 - protein, 9 aa, Homo Sapiens
VVPQLVKLL

SEQ ID NO: 148832 - protein, 9 aa, Homo Sapiens
VVSNITRLI

SEQ ID NO: 148833 - protein, 9 aa, Homo Sapiens
VVVAWERRL

SEQ ID NO: 148834 - protein, 9 aa, Homo Sapiens
VVYPWMRKV

SEQ ID NO: 148835 - protein, 9 aa, Homo Sapiens
VVYPWTQRF

SEQ ID NO: 148836 - protein, 9 aa, Homo Sapiens
VYADWQRWL

SEQ ID NO: 148837 - protein, 9 aa, Homo Sapiens
VYFWLERTM

SEQ ID NO: 148838 - protein, 9 aa, Homo Sapiens
VYHPNVKVV

SEQ ID NO: 148839 - protein, 9 aa, Homo Sapiens
VYIDKVRSL

SEQ ID NO: 148840 - protein, 9 aa, Homo Sapiens
VYIDRVRSL

SEQ ID NO: 148841 - protein, 9 aa, Homo Sapiens
VYPDGIRHI

SEQ ID NO: 148842 - protein, 9 aa, Homo Sapiens
VYPDIIRMI

SEQ ID NO: 148843 - protein, 9 aa, Homo Sapiens
VYSQILRKL

SEQ ID NO: 148844 - protein, 9 aa, Homo Sapiens
VYYLKNREV

SEQ ID NO: 148845 - protein, 9 aa, Homo Sapiens
WAYPRQVFI

SEQ ID NO: 148846 - protein, 9 aa, Homo Sapiens
WRNPHLSML

SEQ ID NO: 148847 - protein, 9 aa, Homo Sapiens
YAFDFARQS

SEQ ID NO: 148848 - protein, 9 aa, Homo Sapiens
YAFNGTQRF

SEQ ID NO: 148849 - protein, 9 aa, Homo Sapiens
YAFNMKATV

SEQ ID NO: 148850 - protein, 9 aa, Homo Sapiens
YAFPKAVSV

SEQ ID NO: 148851 - protein, 9 aa, Homo Sapiens
YAFPKAVTV

SEQ ID NO: 148852 - protein, 9 aa, Homo Sapiens
YAFPKSITV

SEQ ID NO: 148853 - protein, 9 aa, Homo Sapiens
YAFPLAHSL

SEQ ID NO: 148854 - protein, 9 aa, Homo Sapiens
YAFVRPVIL

SEQ ID NO: 148855 - protein, 9 aa, Homo Sapiens
YAIEKVREI

SEQ ID NO: 148856 - protein, 9 aa, Homo Sapiens
YAISMARKI

SEQ ID NO: 148857 - protein, 9 aa, Homo Sapiens
YAYEKPHVV

SEQ ID NO: 148858 - protein, 9 aa, Homo Sapiens
YAYLYIRML

SEQ ID NO: 148859 - protein, 9 aa, Homo Sapiens
YAYPGVLLI

SEQ ID NO: 148860 - protein, 9 aa, Homo Sapiens
YFVPLVKRL

SEQ ID NO: 148861 - protein, 9 aa, Homo Sapiens
YFVPYVHLV

SEQ ID NO: 148862 - protein, 9 aa, Homo Sapiens
YGINNIREL

SEQ ID NO: 148863 - protein, 9 aa, Homo Sapiens
YGMALVRFV

SEQ ID NO: 148864 - protein, 9 aa, Homo Sapiens
YGSFVTRAL

SEQ ID NO: 148865 - protein, 9 aa, Homo Sapiens
YGYEHILTL

SEQ ID NO: 148866 - protein, 9 aa, Homo Sapiens
YIPHGYMEL

SEQ ID NO: 148867 - protein, 9 aa, Homo Sapiens
YKAPILLAL

SEQ ID NO: 148868 - protein, 9 aa, Homo Sapiens
YKAPITNEF

SEQ ID NO: 148869 - protein, 9 aa, Homo Sapiens
YKFDFLQEV

SEQ ID NO: 148870 - protein, 9 aa, Homo Sapiens
YKFDFPVSY

SEQ ID NO: 148871 - protein, 9 aa, Homo Sapiens
YKFERPQYA

SEQ ID NO: 148872 - protein, 9 aa, Homo Sapiens
YKIDHKLLL

SEQ ID NO: 148873 - protein, 9 aa, Homo Sapiens
YKKQFSQYI

SEQ ID NO: 148874 - protein, 9 aa, Homo Sapiens
YKNGWIVMI

SEQ ID NO: 148875 - protein, 9 aa, Homo Sapiens
YKPNLIQAL

SEQ ID NO: 148876 - protein, 9 aa, Homo Sapiens
YKPTYVVYY

SEQ ID NO: 148877 - protein, 9 aa, Homo Sapiens
YKPVFVTEI

SEQ ID NO: 148878 - protein, 9 aa, Homo Sapiens
YKVEYPIMY

SEQ ID NO: 148879 - protein, 9 aa, Homo Sapiens
YKYPFELIM

SEQ ID NO: 148880 - protein, 9 aa, Homo Sapiens
YLADLYHFV

SEQ ID NO: 148881 - protein, 9 aa, Homo Sapiens
YLAPFLRNV

SEQ ID NO: 148882 - protein, 9 aa, Homo Sapiens
YLAPHVRTL

SEQ ID NO: 148883 - protein, 9 aa, Homo Sapiens
YLASLIRSV

SEQ ID NO: 148884 - protein, 9 aa, Homo Sapiens
YLFERIKEL

SEQ ID NO: 148885 - protein, 9 aa, Homo Sapiens
YLSDNVHLV

SEQ ID NO: 148886 - protein, 9 aa, Homo Sapiens
YLVPLLRSL

SEQ ID NO: 148887 - protein, 9 aa, Homo Sapiens
YMPQNPHII

SEQ ID NO: 148888 - protein, 9 aa, Homo Sapiens
YQFTGIKKY

SEQ ID NO: 148889 - protein, 9 aa, Homo Sapiens
YQYPRPLLI

SEQ ID NO: 148890 - protein, 9 aa, Homo Sapiens
YQYPVIIHL

SEQ ID NO: 148891 - protein, 9 aa, Homo Sapiens
YRAENQILL

SEQ ID NO: 148892 - protein, 9 aa, Homo Sapiens
YRAGPMRQI

SEQ ID NO: 148893 - protein, 9 aa, Homo Sapiens
YRAITVRKL

SEQ ID NO: 148894 - protein, 9 aa, Homo Sapiens
YRANVIANI

SEQ ID NO: 148895 - protein, 9 aa, Homo Sapiens
YRAQQIIQL

SEQ ID NO: 148896 - protein, 9 aa, Homo Sapiens
YRDTWVRYL

SEQ ID NO: 148897 - protein, 9 aa, Homo Sapiens
YREILVKEL

SEQ ID NO: 148898 - protein, 9 aa, Homo Sapiens
YRFDAIRTF

SEQ ID NO: 148899 - protein, 9 aa, Homo Sapiens
YRFETVQKL

SEQ ID NO: 148900 - protein, 9 aa, Homo Sapiens
YRFGDSQQL

SEQ ID NO: 148901 - protein, 9 aa, Homo Sapiens
YRFLQTAEM

SEQ ID NO: 148902 - protein, 9 aa, Homo Sapiens
YRFPNMVVA

SEQ ID NO: 148903 - protein, 9 aa, Homo Sapiens
YRFPSSLCV

SEQ ID NO: 148904 - protein, 9 aa, Homo Sapiens
YRGERINQL

SEQ ID NO: 148905 - protein, 9 aa, Homo Sapiens
YRGPAIRAL

SEQ ID NO: 148906 - protein, 9 aa, Homo Sapiens
YRHDLINQL

SEQ ID NO: 148907 - protein, 9 aa, Homo Sapiens
YRHPDPREL

SEQ ID NO: 148908 - protein, 9 aa, Homo Sapiens
YRIELLRKV

SEQ ID NO: 148909 - protein, 9 aa, Homo Sapiens
YRINLQMRL

SEQ ID NO: 148910 - protein, 9 aa, Homo Sapiens
YRIPLNPYL

SEQ ID NO: 148911 - protein, 9 aa, Homo Sapiens
YRIQIQNQI

SEQ ID NO: 148912 - protein, 9 aa, Homo Sapiens
YRKDFQQLL

SEQ ID NO: 148913 - protein, 9 aa, Homo Sapiens
YRMVGGVLV

SEQ ID NO: 148914 - protein, 9 aa, Homo Sapiens
YRNAYTMVL

SEQ ID NO: 148915 - protein, 9 aa, Homo Sapiens
YRNEFTAWY

SEQ ID NO: 148916 - protein, 9 aa, Homo Sapiens
YRNIEPVYL

SEQ ID NO: 148917 - protein, 9 aa, Homo Sapiens
YRNPKLVVT

SEQ ID NO: 148918 - protein, 9 aa, Homo Sapiens
YRNQLLNIF

SEQ ID NO: 148919 - protein, 9 aa, Homo Sapiens
YRPAYLVTL

SEQ ID NO: 148920 - protein, 9 aa, Homo Sapiens
YRPEFLKSY

SEQ ID NO: 148921 - protein, 9 aa, Homo Sapiens
YRPFEPQAL

SEQ ID NO: 148922 - protein, 9 aa, Homo Sapiens
YRPGSVAYV

SEQ ID NO: 148923 - protein, 9 aa, Homo Sapiens
YRPHTITLL

SEQ ID NO: 148924 - protein, 9 aa, Homo Sapiens
YRPISASVL

SEQ ID NO: 148925 - protein, 9 aa, Homo Sapiens
YRPLFENFV

SEQ ID NO: 148926 - protein, 9 aa, Homo Sapiens
YRPLWALLI

SEQ ID NO: 148927 - protein, 9 aa, Homo Sapiens
YRPLYPFSL

SEQ ID NO: 148928 - protein, 9 aa, Homo Sapiens
YRPVKLNEI

SEQ ID NO: 148929 - protein, 9 aa, Homo Sapiens
YRQKQVVIL

SEQ ID NO: 148930 - protein, 9 aa, Homo Sapiens
YRQLLVRTL

SEQ ID NO: 148931 - protein, 9 aa, Homo Sapiens
YRSDGALLL

SEQ ID NO: 148932 - protein, 9 aa, Homo Sapiens
YRSLTLNVV

SEQ ID NO: 148933 - protein, 9 aa, Homo Sapiens
YRTDMIQAL

SEQ ID NO: 148934 - protein, 9 aa, Homo Sapiens
YRVFTTQEL

SEQ ID NO: 148935 - protein, 9 aa, Homo Sapiens
YRVPNMRFL

SEQ ID NO: 148936 - protein, 9 aa, Homo Sapiens
YRVVFPLEL

SEQ ID NO: 148937 - protein, 9 aa, Homo Sapiens
YRYDDMLVV

SEQ ID NO: 148938 - protein, 9 aa, Homo Sapiens
YRYDEQLNL

SEQ ID NO: 148939 - protein, 9 aa, Homo Sapiens
YRYGQLIEI

SEQ ID NO: 148940 - protein, 9 aa, Homo Sapiens
YRYKMPRLI

SEQ ID NO: 148941 - protein, 9 aa, Homo Sapiens
YRYLNTQFI

SEQ ID NO: 148942 - protein, 9 aa, Homo Sapiens
YRYMNPAIV

SEQ ID NO: 148943 - protein, 9 aa, Homo Sapiens
YRYPIVLGY

SEQ ID NO: 148944 - protein, 9 aa, Homo Sapiens
YRYPRPASV

SEQ ID NO: 148945 - protein, 9 aa, Homo Sapiens
YRYVTKLLV

SEQ ID NO: 148946 - protein, 9 aa, Homo Sapiens
YSAPVIHVL

SEQ ID NO: 148947 - protein, 9 aa, Homo Sapiens
YSHPHVRLL

SEQ ID NO: 148948 - protein, 9 aa, Homo Sapiens
YSSMVIRDL

SEQ ID NO: 148949 - protein, 9 aa, Homo Sapiens
YSSPLFRSL

SEQ ID NO: 148950 - protein, 9 aa, Homo Sapiens
YSYFSPRTM

SEQ ID NO: 148951 - protein, 9 aa, Homo Sapiens
YTFGRIVIY

SEQ ID NO: 148952 - protein, 9 aa, Homo Sapiens
YTIEFLRHL

SEQ ID NO: 148953 - protein, 9 aa, Homo Sapiens
YTPDWIFLL

SEQ ID NO: 148954 - protein, 9 aa, Homo Sapiens
YVAPLKREV

SEQ ID NO: 148955 - protein, 9 aa, Homo Sapiens
YVFPGVTRL

SEQ ID NO: 148956 - protein, 9 aa, Homo Sapiens
YVPDIVRCV

SEQ ID NO: 148957 - protein, 9 aa, Homo Sapiens
YYFEGIKQT

SEQ ID NO: 148958 - protein, 9 aa, Homo Sapiens
YYGPLRSVW

SEQ ID NO: 148959 - protein, 9 aa, Homo Sapiens
YYIDCIRQV

SEQ ID NO: 148960 - protein, 9 aa, Homo Sapiens
YYISFLKTL

SEQ ID NO: 148961 - protein, 9 aa, Homo Sapiens
YYITRAKLV

SEQ ID NO: 148962 - protein, 9 aa, Homo Sapiens
YYKDALRFL

SEQ ID NO: 148963 - protein, 9 aa, Homo Sapiens
YYKERLLYL

SEQ ID NO: 148964 - protein, 9 aa, Homo Sapiens
YYLTFVQEL

SEQ ID NO: 148965 - protein, 9 aa, Homo Sapiens
YYRDYPTLV

SEQ ID NO: 148966 - protein, 10 aa, Homo Sapiens
AKSDVPIQLL

SEQ ID NO: 148967 - protein, 10 aa, Homo Sapiens
ARFGPGGQLI

SEQ ID NO: 148968 - protein, 10 aa, Homo Sapiens
ARVFMKSVKL

SEQ ID NO: 148969 - protein, 10 aa, Homo Sapiens
AVVAALSSHK

SEQ ID NO: 148970 - protein, 10 aa, Homo Sapiens
CRAEILHEIA

SEQ ID NO: 148971 - protein, 10 aa, Homo Sapiens
FAYPAIRYLL

SEQ ID NO: 148972 - protein, 10 aa, Homo Sapiens
FLFDGSPTYV

SEQ ID NO: 148973 - protein, 10 aa, Homo Sapiens
FLPARFYQAL

SEQ ID NO: 148974 - protein, 10 aa, Homo Sapiens
FLPEEAWCDL

SEQ ID NO: 148975 - protein, 10 aa, Homo Sapiens
FRMPVLREYL

SEQ ID NO: 148976 - protein, 10 aa, Homo Sapiens
FRNPDTIFIL

SEQ ID NO: 148977 - protein, 10 aa, Homo Sapiens
FRPTFENLIP

SEQ ID NO: 148978 - protein, 10 aa, Homo Sapiens
FRYDLSPITV

SEQ ID NO: 148979 - protein, 10 aa, Homo Sapiens
FYVPFAKALY

SEQ ID NO: 148980 - protein, 10 aa, Homo Sapiens
FYYDGKVMKL

SEQ ID NO: 148981 - protein, 10 aa, Homo Sapiens
GGIPALVRLL

SEQ ID NO: 148982 - protein, 10 aa, Homo Sapiens
HPGRVLLQNL

SEQ ID NO: 148983 - protein, 10 aa, Homo Sapiens
HRPEDVVQFL

SEQ ID NO: 148984 - protein, 10 aa, Homo Sapiens
HRYENVSILF

SEQ ID NO: 148985 - protein, 10 aa, Homo Sapiens
IQRTPKIQVY

SEQ ID NO: 148986 - protein, 10 aa, Homo Sapiens
IRNDEELNKL

SEQ ID NO: 148987 - protein, 10 aa, Homo Sapiens
IRSNNINTLF

SEQ ID NO: 148988 - protein, 10 aa, Homo Sapiens
IRSVVALHNL

SEQ ID NO: 148989 - protein, 10 aa, Homo Sapiens
ISNKTPLVLL

SEQ ID NO: 148990 - protein, 10 aa, Homo Sapiens
LRPEELTNQM

SEQ ID NO: 148991 - protein, 10 aa, Homo Sapiens
LRPLVKPKIV

SEQ ID NO: 148992 - protein, 10 aa, Homo Sapiens
MAGPLRAPLL

SEQ ID NO: 148993 - protein, 10 aa, Homo Sapiens
PYSPPTFRFL

SEQ ID NO: 148994 - protein, 10 aa, Homo Sapiens
QSTDIIRYLF

SEQ ID NO: 148995 - protein, 10 aa, Homo Sapiens
RLPQGIVREL

SEQ ID NO: 148996 - protein, 10 aa, Homo Sapiens
SAVDFIRTLL

SEQ ID NO: 148997 - protein, 10 aa, Homo Sapiens
SIPEFQRAYV

SEQ ID NO: 148998 - protein, 10 aa, Homo Sapiens
SKTGIPLNVL

SEQ ID NO: 148999 - protein, 10 aa, Homo Sapiens
SLMAKYIMDL

SEQ ID NO: 149000 - protein, 10 aa, Homo Sapiens
TTVPPNLRKL

SEQ ID NO: 149001 - protein, 10 aa, Homo Sapiens
VKPNFPFLLF

SEQ ID NO: 149002 - protein, 10 aa, Homo Sapiens
VLPTLPFHVL

SEQ ID NO: 149003 - protein, 10 aa, Homo Sapiens
VSAAGLVQGL

SEQ ID NO: 149004 - protein, 10 aa, Homo Sapiens
YAFNGTQRFL

SEQ ID NO: 149005 - protein, 10 aa, Homo Sapiens
YGYDNVKEYL

SEQ ID NO: 149006 - protein, 10 aa, Homo Sapiens
YLPDGFLRKM

SEQ ID NO: 149007 - protein, 10 aa, Homo Sapiens
YLPSQVSRVV

SEQ ID NO: 149008 - protein, 10 aa, Homo Sapiens
YQFTGIKKYF

SEQ ID NO: 149009 - protein, 10 aa, Homo Sapiens
YRMDGHIQLI

SEQ ID NO: 149010 - protein, 10 aa, Homo Sapiens
YRNPKGFSTL

SEQ ID NO: 149011 - protein, 10 aa, Homo Sapiens
YRPDMIILQI

SEQ ID NO: 149012 - protein, 10 aa, Homo Sapiens
YVGQLAGQVI

SEQ ID NO: 149013 - protein, 10 aa, Homo Sapiens
YYFEGGLRKV

SEQ ID NO: 149014 - protein, 10 aa, Homo Sapiens
YYVDTAVRHV

SEQ ID NO: 149015 - protein, 11 aa, Homo Sapiens
ADREDDPNFFK

SEQ ID NO: 149016 - protein, 11 aa, Homo Sapiens
FGSDQSENVDR

SEQ ID NO: 149017 - protein, 11 aa, Homo Sapiens
FIPGGKASRGL

SEQ ID NO: 149018 - protein, 11 aa, Homo Sapiens
LLWASPPGRWL

SEQ ID NO: 149019 - protein, 11 aa, Homo Sapiens
LTSQLPPLREI

SEQ ID NO: 149020 - protein, 11 aa, Homo Sapiens
LVAQIAAGMEY

SEQ ID NO: 149021 - protein, 11 aa, Homo Sapiens
MAPSETQFSHL

SEQ ID NO: 149022 - protein, 11 aa, Homo Sapiens
PMFIVNTNVPR

SEQ ID NO: 149023 - protein, 11 aa, Homo Sapiens
RLPAVASKRYL

SEQ ID NO: 149024 - protein, 11 aa, Homo Sapiens
RQFVKDSIRLV

SEQ ID NO: 149025 - protein, 11 aa, Homo Sapiens
SAYVIRLEPLL

SEQ ID NO: 149026 - protein, 11 aa, Homo Sapiens
SHKDDSPDLPK

SEQ ID NO: 149027 - protein, 11 aa, Homo Sapiens
VTVPSGELRHV

SEQ ID NO: 149028 - protein, 11 aa, Homo Sapiens
YYIDADLLREI

SEQ ID NO: 149029 - protein, 8 aa, Homo Sapiens
AAGRPLEL

SEQ ID NO: 149030 - protein, 8 aa, Homo Sapiens
AGGHPLEL

SEQ ID NO: 149031 - protein, 8 aa, Homo Sapiens
AGSIPLIL

SEQ ID NO: 149032 - protein, 8 aa, Homo Sapiens
ARGPIQIL

SEQ ID NO: 149033 - protein, 8 aa, Homo Sapiens
ASFVGYSY

SEQ ID NO: 149034 - protein, 8 aa, Homo Sapiens
ASGCPLFF

SEQ ID NO: 149035 - protein, 8 aa, Homo Sapiens
ASGMILVM

SEQ ID NO: 149036 - protein, 8 aa, Homo Sapiens
ASGPELIL

SEQ ID NO: 149037 - protein, 8 aa, Homo Sapiens
ATAPVVTF

SEQ ID NO: 149038 - protein, 8 aa, Homo Sapiens
ATGPDLEF

SEQ ID NO: 149039 - protein, 8 aa, Homo Sapiens
CGGVPIIF

SEQ ID NO: 149040 - protein, 8 aa, Homo Sapiens
CSGAIIVL

SEQ ID NO: 149041 - protein, 8 aa, Homo Sapiens
CVFVHQTL

SEQ ID NO: 149042 - protein, 8 aa, Homo Sapiens
CYIVHEIY

SEQ ID NO: 149043 - protein, 8 aa, Homo Sapiens
EEQLQQIR

SEQ ID NO: 149044 - protein, 8 aa, Homo Sapiens
ESLIACKA

SEQ ID NO: 149045 - protein, 8 aa, Homo Sapiens
FGGEPLSY

SEQ ID NO: 149046 - protein, 8 aa, Homo Sapiens
FRGVVIKY

SEQ ID NO: 149047 - protein, 8 aa, Homo Sapiens
GNYLHPSL

SEQ ID NO: 149048 - protein, 8 aa, Homo Sapiens
GSGLPLVL

SEQ ID NO: 149049 - protein, 8 aa, Homo Sapiens
HAGPPVYF

SEQ ID NO: 149050 - protein, 8 aa, Homo Sapiens
HNLTHPEL

SEQ ID NO: 149051 - protein, 8 aa, Homo Sapiens
HRGIELTL

SEQ ID NO: 149052 - protein, 8 aa, Homo Sapiens
HSFLHPSY

SEQ ID NO: 149053 - protein, 8 aa, Homo Sapiens
HSGPAVYF

SEQ ID NO: 149054 - protein, 8 aa, Homo Sapiens
HSGPFFTF

SEQ ID NO: 149055 - protein, 8 aa, Homo Sapiens
HSGPIHVL

SEQ ID NO: 149056 - protein, 8 aa, Homo Sapiens
HSGPPIVI

SEQ ID NO: 149057 - protein, 8 aa, Homo Sapiens
HSGPQKLL

SEQ ID NO: 149058 - protein, 8 aa, Homo Sapiens
HSHFHDTL

SEQ ID NO: 149059 - protein, 8 aa, Homo Sapiens
HSQFHAPL

SEQ ID NO: 149060 - protein, 8 aa, Homo Sapiens
HTFLHTVY

SEQ ID NO: 149061 - protein, 8 aa, Homo Sapiens
HTGYVIEL

SEQ ID NO: 149062 - protein, 8 aa, Homo Sapiens
HYFLHISL

SEQ ID NO: 149063 - protein, 8 aa, Homo Sapiens
IGGPAILL

SEQ ID NO: 149064 - protein, 8 aa, Homo Sapiens
IRAPIMRM

SEQ ID NO: 149065 - protein, 8 aa, Homo Sapiens
IRFVHKEM

SEQ ID NO: 149066 - protein, 8 aa, Homo Sapiens
IRGVVIVL

SEQ ID NO: 149067 - protein, 8 aa, Homo Sapiens
ITGVVITL

SEQ ID NO: 149068 - protein, 8 aa, Homo Sapiens
KAFIHHEL

SEQ ID NO: 149069 - protein, 8 aa, Homo Sapiens
KAGPILEL

SEQ ID NO: 149070 - protein, 8 aa, Homo Sapiens
KNFVSQEL

SEQ ID NO: 149071 - protein, 8 aa, Homo Sapiens
KSAVGFDY

SEQ ID NO: 149072 - protein, 8 aa, Homo Sapiens
KSFYHVSY

SEQ ID NO: 149073 - protein, 8 aa, Homo Sapiens
KSGVAITF

SEQ ID NO: 149074 - protein, 8 aa, Homo Sapiens
KSQVHPVL

SEQ ID NO: 149075 - protein, 8 aa, Homo Sapiens
KSYVHSAL

SEQ ID NO: 149076 - protein, 8 aa, Homo Sapiens
KYMPHAVL

SEQ ID NO: 149077 - protein, 8 aa, Homo Sapiens
LAGPALEL

SEQ ID NO: 149078 - protein, 8 aa, Homo Sapiens
LTGPVLEL

SEQ ID NO: 149079 - protein, 8 aa, Homo Sapiens
QRGPVRGI

SEQ ID NO: 149080 - protein, 8 aa, Homo Sapiens
RGGPILTF

SEQ ID NO: 149081 - protein, 8 aa, Homo Sapiens
RNGPYRQL

SEQ ID NO: 149082 - protein, 8 aa, Homo Sapiens
RNYLHYSL

SEQ ID NO: 149083 - protein, 8 aa, Homo Sapiens
RSFFHQHY

SEQ ID NO: 149084 - protein, 8 aa, Homo Sapiens
RTAIHEVM

SEQ ID NO: 149085 - protein, 8 aa, Homo Sapiens
RTGIPISM

SEQ ID NO: 149086 - protein, 8 aa, Homo Sapiens
RTGPALVL

SEQ ID NO: 149087 - protein, 8 aa, Homo Sapiens
RTGPPRLL

SEQ ID NO: 149088 - protein, 8 aa, Homo Sapiens
RVFPHAEF

SEQ ID NO: 149089 - protein, 8 aa, Homo Sapiens
SGGHPLEF

SEQ ID NO: 149090 - protein, 8 aa, Homo Sapiens
SGGPGFTF

SEQ ID NO: 149091 - protein, 8 aa, Homo Sapiens
SGGPVLQF

SEQ ID NO: 149092 - protein, 8 aa, Homo Sapiens
SIYIHCSF

SEQ ID NO: 149093 - protein, 8 aa, Homo Sapiens
SSGLPLIL

SEQ ID NO: 149094 - protein, 8 aa, Homo Sapiens
SSGPERIL

SEQ ID NO: 149095 - protein, 8 aa, Homo Sapiens
STGEPLEL

SEQ ID NO: 149096 - protein, 8 aa, Homo Sapiens
TEELAYLK

SEQ ID NO: 149097 - protein, 8 aa, Homo Sapiens
TRGPVVRL

SEQ ID NO: 149098 - protein, 8 aa, Homo Sapiens
TRGWVQTL

SEQ ID NO: 149099 - protein, 8 aa, Homo Sapiens
TSGPPLTM

SEQ ID NO: 149100 - protein, 8 aa, Homo Sapiens
VGGPEIEL

SEQ ID NO: 149101 - protein, 8 aa, Homo Sapiens
VGVVNPIL

SEQ ID NO: 149102 - protein, 8 aa, Homo Sapiens
VIGPPVVL

SEQ ID NO: 149103 - protein, 8 aa, Homo Sapiens
VRGVVHVY

SEQ ID NO: 149104 - protein, 8 aa, Homo Sapiens
VSGICIVF

SEQ ID NO: 149105 - protein, 8 aa, Homo Sapiens
VSGPAMTL

SEQ ID NO: 149106 - protein, 8 aa, Homo Sapiens
VSSIPLVL

SEQ ID NO: 149107 - protein, 8 aa, Homo Sapiens
VTDTNVIL

SEQ ID NO: 149108 - protein, 8 aa, Homo Sapiens
VTGPEIVY

SEQ ID NO: 149109 - protein, 8 aa, Homo Sapiens
VTGVPLSY

SEQ ID NO: 149110 - protein, 8 aa, Homo Sapiens
YEDIAQKS

SEQ ID NO: 149111 - protein, 8 aa, Homo Sapiens
YEEIAQRS

SEQ ID NO: 149112 - protein, 8 aa, Homo Sapiens
YNLIHPEY

SEQ ID NO: 149113 - protein, 8 aa, Homo Sapiens
YRGPANGF

SEQ ID NO: 149114 - protein, 8 aa, Homo Sapiens
YRGPCHTY

SEQ ID NO: 149115 - protein, 8 aa, Homo Sapiens
YSAPGRDL

SEQ ID NO: 149116 - protein, 8 aa, Homo Sapiens
YSGVLITL

SEQ ID NO: 149117 - protein, 9 aa, Homo Sapiens
AAAPAGTTF

SEQ ID NO: 149118 - protein, 9 aa, Homo Sapiens
AANKTIIYL

SEQ ID NO: 149119 - protein, 9 aa, Homo Sapiens
AANPHSFVF

SEQ ID NO: 149120 - protein, 9 aa, Homo Sapiens
AAPALASSL

SEQ ID NO: 149121 - protein, 9 aa, Homo Sapiens
AAPTSAAAL

SEQ ID NO: 149122 - protein, 9 aa, Homo Sapiens
AAPVPTTTL

SEQ ID NO: 149123 - protein, 9 aa, Homo Sapiens
AFNPEPLVL

SEQ ID NO: 149124 - protein, 9 aa, Homo Sapiens
AMYPHIFYF

SEQ ID NO: 149125 - protein, 9 aa, Homo Sapiens
AMYVHAYTL

SEQ ID NO: 149126 - protein, 9 aa, Homo Sapiens
ANKYQVFFF

SEQ ID NO: 149127 - protein, 9 aa, Homo Sapiens
ANSSIRPIF

SEQ ID NO: 149128 - protein, 9 aa, Homo Sapiens
AQNRFLLEL

SEQ ID NO: 149129 - protein, 9 aa, Homo Sapiens
ARADFQKVL

SEQ ID NO: 149130 - protein, 9 aa, Homo Sapiens
ARAHSIQIM

SEQ ID NO: 149131 - protein, 9 aa, Homo Sapiens
ARAPGTRTL

SEQ ID NO: 149132 - protein, 9 aa, Homo Sapiens
ARCDFALFL

SEQ ID NO: 149133 - protein, 9 aa, Homo Sapiens
ARCPSPKLL

SEQ ID NO: 149134 - protein, 9 aa, Homo Sapiens
ARDDTHYLL

SEQ ID NO: 149135 - protein, 9 aa, Homo Sapiens
ARDPGARVL

SEQ ID NO: 149136 - protein, 9 aa, Homo Sapiens
ARFGSVNEL

SEQ ID NO: 149137 - protein, 9 aa, Homo Sapiens
ARGPLRQTF

SEQ ID NO: 149138 - protein, 9 aa, Homo Sapiens
ARGQYVKFL

SEQ ID NO: 149139 - protein, 9 aa, Homo Sapiens
ARHSLLQTL

SEQ ID NO: 149140 - protein, 9 aa, Homo Sapiens
ARLAETREL

SEQ ID NO: 149141 - protein, 9 aa, Homo Sapiens
ARLDLPYEL

SEQ ID NO: 149142 - protein, 9 aa, Homo Sapiens
ARLKDIIVM

SEQ ID NO: 149143 - protein, 9 aa, Homo Sapiens
ARLKEVLEY

SEQ ID NO: 149144 - protein, 9 aa, Homo Sapiens
ARLNWILHF

SEQ ID NO: 149145 - protein, 9 aa, Homo Sapiens
ARLPLVNSY

SEQ ID NO: 149146 - protein, 9 aa, Homo Sapiens
ARMEFAWIY

SEQ ID NO: 149147 - protein, 9 aa, Homo Sapiens
ARMEFILRH

SEQ ID NO: 149148 - protein, 9 aa, Homo Sapiens
ARNDYLLTL

SEQ ID NO: 149149 - protein, 9 aa, Homo Sapiens
ARNEYLLNL

SEQ ID NO: 149150 - protein, 9 aa, Homo Sapiens
ARNEYLLSL

SEQ ID NO: 149151 - protein, 9 aa, Homo Sapiens
ARNLFCLQL

SEQ ID NO: 149152 - protein, 9 aa, Homo Sapiens
ARNPSTVCL

SEQ ID NO: 149153 - protein, 9 aa, Homo Sapiens
ARNTVTQVL

SEQ ID NO: 149154 - protein, 9 aa, Homo Sapiens
ARPQVSLTF

SEQ ID NO: 149155 - protein, 9 aa, Homo Sapiens
ARPRTEVSL

SEQ ID NO: 149156 - protein, 9 aa, Homo Sapiens
ARRENILVM

SEQ ID NO: 149157 - protein, 9 aa, Homo Sapiens
ARTVFCMQL

SEQ ID NO: 149158 - protein, 9 aa, Homo Sapiens
ARVIFITEY

SEQ ID NO: 149159 - protein, 9 aa, Homo Sapiens
ASADTAYVL

SEQ ID NO: 149160 - protein, 9 aa, Homo Sapiens
ASFHRVWSF

SEQ ID NO: 149161 - protein, 9 aa, Homo Sapiens
ASGGHYYSY

SEQ ID NO: 149162 - protein, 9 aa, Homo Sapiens
ASHLHIHVF

SEQ ID NO: 149163 - protein, 9 aa, Homo Sapiens
ASLLHPVVY

SEQ ID NO: 149164 - protein, 9 aa, Homo Sapiens
ASLMHSFIL

SEQ ID NO: 149165 - protein, 9 aa, Homo Sapiens
ASNKYLVEF

SEQ ID NO: 149166 - protein, 9 aa, Homo Sapiens
ASNPAMLLY

SEQ ID NO: 149167 - protein, 9 aa, Homo Sapiens
ASPSSIRSL

SEQ ID NO: 149168 - protein, 9 aa, Homo Sapiens
ASSGHYIAY

SEQ ID NO: 149169 - protein, 9 aa, Homo Sapiens
ASSPHGLVM

SEQ ID NO: 149170 - protein, 9 aa, Homo Sapiens
ASTPVAREL

SEQ ID NO: 149171 - protein, 9 aa, Homo Sapiens
ATFARIWYL

SEQ ID NO: 149172 - protein, 9 aa, Homo Sapiens
ATIAIAYIM

SEQ ID NO: 149173 - protein, 9 aa, Homo Sapiens
ATISYILTL

SEQ ID NO: 149174 - protein, 9 aa, Homo Sapiens
ATNAAVTVL

SEQ ID NO: 149175 - protein, 9 aa, Homo Sapiens
ATNKITIIF

SEQ ID NO: 149176 - protein, 9 aa, Homo Sapiens
ATNPESKVF

SEQ ID NO: 149177 - protein, 9 aa, Homo Sapiens
ATNPISRVL

SEQ ID NO: 149178 - protein, 9 aa, Homo Sapiens
ATNPKPVKL

SEQ ID NO: 149179 - protein, 9 aa, Homo Sapiens
ATSKVALVY

SEQ ID NO: 149180 - protein, 9 aa, Homo Sapiens
AVLDFCYHL

SEQ ID NO: 149181 - protein, 9 aa, Homo Sapiens
AVSEAAIIL

SEQ ID NO: 149182 - protein, 9 aa, Homo Sapiens
AVSPYSIVL

SEQ ID NO: 149183 - protein, 9 aa, Homo Sapiens
AYKDAIYVF

SEQ ID NO: 149184 - protein, 9 aa, Homo Sapiens
AYSSYVHQY

SEQ ID NO: 149185 - protein, 9 aa, Homo Sapiens
CRDDIFYIL

SEQ ID NO: 149186 - protein, 9 aa, Homo Sapiens
CRESGVRNL

SEQ ID NO: 149187 - protein, 9 aa, Homo Sapiens
CVYVHETVL

SEQ ID NO: 149188 - protein, 9 aa, Homo Sapiens
EMKPHPWFF

SEQ ID NO: 149189 - protein, 9 aa, Homo Sapiens
ERNPAVYNF

SEQ ID NO: 149190 - protein, 9 aa, Homo Sapiens
ERVSYALLF

SEQ ID NO: 149191 - protein, 9 aa, Homo Sapiens
FAPENTCHL

SEQ ID NO: 149192 - protein, 9 aa, Homo Sapiens
FGRPVIVAY

SEQ ID NO: 149193 - protein, 9 aa, Homo Sapiens
FRGPVVPAF

SEQ ID NO: 149194 - protein, 9 aa, Homo Sapiens
FRGVLHQVM

SEQ ID NO: 149195 - protein, 9 aa, Homo Sapiens
FRMPVLREY

SEQ ID NO: 149196 - protein, 9 aa, Homo Sapiens
FRPLYTHEY

SEQ ID NO: 149197 - protein, 9 aa, Homo Sapiens
FRVDYILSV

SEQ ID NO: 149198 - protein, 9 aa, Homo Sapiens
FRVPTANVS

SEQ ID NO: 149199 - protein, 9 aa, Homo Sapiens
FRYHGLSSL

SEQ ID NO: 149200 - protein, 9 aa, Homo Sapiens
FRYTAGTPY

SEQ ID NO: 149201 - protein, 9 aa, Homo Sapiens
FSNPYSIEY

SEQ ID NO: 149202 - protein, 9 aa, Homo Sapiens
FTNRTVLEL

SEQ ID NO: 149203 - protein, 9 aa, Homo Sapiens
GAPVAAAAL

SEQ ID NO: 149204 - protein, 9 aa, Homo Sapiens
GGPGGVGGL

SEQ ID NO: 149205 - protein, 9 aa, Homo Sapiens
GNLRFVYEL

SEQ ID NO: 149206 - protein, 9 aa, Homo Sapiens
GNYFHHVVL

SEQ ID NO: 149207 - protein, 9 aa, Homo Sapiens
GNYYKPWFF

SEQ ID NO: 149208 - protein, 9 aa, Homo Sapiens
GRAPQVLVL

SEQ ID NO: 149209 - protein, 9 aa, Homo Sapiens
GRFEDVYQL

SEQ ID NO: 149210 - protein, 9 aa, Homo Sapiens
GRHSLPKTL

SEQ ID NO: 149211 - protein, 9 aa, Homo Sapiens
GRMVQVHEL

SEQ ID NO: 149212 - protein, 9 aa, Homo Sapiens
GRNPFVHEL

SEQ ID NO: 149213 - protein, 9 aa, Homo Sapiens
GRNSTPLHL

SEQ ID NO: 149214 - protein, 9 aa, Homo Sapiens
GRSCIILEF

SEQ ID NO: 149215 - protein, 9 aa, Homo Sapiens
GRYHVIRKL

SEQ ID NO: 149216 - protein, 9 aa, Homo Sapiens
GSNPVRVSF

SEQ ID NO: 149217 - protein, 9 aa, Homo Sapiens
GTSPYVYQL

SEQ ID NO: 149218 - protein, 9 aa, Homo Sapiens
GYPGGIHEV

SEQ ID NO: 149219 - protein, 9 aa, Homo Sapiens
HLPSGVKSL

SEQ ID NO: 149220 - protein, 9 aa, Homo Sapiens
HNKEPVYSL

SEQ ID NO: 149221 - protein, 9 aa, Homo Sapiens
HNSGVPVYL

SEQ ID NO: 149222 - protein, 9 aa, Homo Sapiens
HNSNIIKKL

SEQ ID NO: 149223 - protein, 9 aa, Homo Sapiens
HNVGYHIVY

SEQ ID NO: 149224 - protein, 9 aa, Homo Sapiens
HNVSFAFEL

SEQ ID NO: 149225 - protein, 9 aa, Homo Sapiens
HRGLFIQQL

SEQ ID NO: 149226 - protein, 9 aa, Homo Sapiens
HRLPPVTSF

SEQ ID NO: 149227 - protein, 9 aa, Homo Sapiens
HRNEVTVEL

SEQ ID NO: 149228 - protein, 9 aa, Homo Sapiens
HRNGGLITL

SEQ ID NO: 149229 - protein, 9 aa, Homo Sapiens
HRPEFSSCL

SEQ ID NO: 149230 - protein, 9 aa, Homo Sapiens
HRWEVCLTM

SEQ ID NO: 149231 - protein, 9 aa, Homo Sapiens
HRYEVVTEL

SEQ ID NO: 149232 - protein, 9 aa, Homo Sapiens
HRYPAVHVY

SEQ ID NO: 149233 - protein, 9 aa, Homo Sapiens
HSGPIHVLL

SEQ ID NO: 149234 - protein, 9 aa, Homo Sapiens
HSNPYFFLL

SEQ ID NO: 149235 - protein, 9 aa, Homo Sapiens
HSPPFSKTL

SEQ ID NO: 149236 - protein, 9 aa, Homo Sapiens
HSTVHLIEF

SEQ ID NO: 149237 - protein, 9 aa, Homo Sapiens
HSYFHKWSA

SEQ ID NO: 149238 - protein, 9 aa, Homo Sapiens
HTHDYPYSL

SEQ ID NO: 149239 - protein, 9 aa, Homo Sapiens
IAPGVTHEL

SEQ ID NO: 149240 - protein, 9 aa, Homo Sapiens
IINSNPIEL

SEQ ID NO: 149241 - protein, 9 aa, Homo Sapiens
IQPNIQLIL

SEQ ID NO: 149242 - protein, 9 aa, Homo Sapiens
IRDDHIRFI

SEQ ID NO: 149243 - protein, 9 aa, Homo Sapiens
IRFQEERRL

SEQ ID NO: 149244 - protein, 9 aa, Homo Sapiens
IRGPTQHEL

SEQ ID NO: 149245 - protein, 9 aa, Homo Sapiens
IRHETIRVA

SEQ ID NO: 149246 - protein, 9 aa, Homo Sapiens
IRHPNIITL

SEQ ID NO: 149247 - protein, 9 aa, Homo Sapiens
IRKPYIWEY

SEQ ID NO: 149248 - protein, 9 aa, Homo Sapiens
IRMTYIKEL

SEQ ID NO: 149249 - protein, 9 aa, Homo Sapiens
IRNDYYLNL

SEQ ID NO: 149250 - protein, 9 aa, Homo Sapiens
IRNHHVASL

SEQ ID NO: 149251 - protein, 9 aa, Homo Sapiens
IRNQIIREL

SEQ ID NO: 149252 - protein, 9 aa, Homo Sapiens
IRPEHVLRL

SEQ ID NO: 149253 - protein, 9 aa, Homo Sapiens
IRPENVIIY

SEQ ID NO: 149254 - protein, 9 aa, Homo Sapiens
IRPGTAFEL

SEQ ID NO: 149255 - protein, 9 aa, Homo Sapiens
IRPQVVTTF

SEQ ID NO: 149256 - protein, 9 aa, Homo Sapiens
IRSSHIKYI

SEQ ID NO: 149257 - protein, 9 aa, Homo Sapiens
IRSSYIRVL

SEQ ID NO: 149258 - protein, 9 aa, Homo Sapiens
IRVDKITEY

SEQ ID NO: 149259 - protein, 9 aa, Homo Sapiens
IRYPDSHQL

SEQ ID NO: 149260 - protein, 9 aa, Homo Sapiens
ITNKYQLVF

SEQ ID NO: 149261 - protein, 9 aa, Homo Sapiens
ITQIEHEVS

SEQ ID NO: 149262 - protein, 9 aa, Homo Sapiens
IVPGNVKSL

SEQ ID NO: 149263 - protein, 9 aa, Homo Sapiens
KAAPCIYWL

SEQ ID NO: 149264 - protein, 9 aa, Homo Sapiens
KAFARPWSL

SEQ ID NO: 149265 - protein, 9 aa, Homo Sapiens
KAFPFHIIF

SEQ ID NO: 149266 - protein, 9 aa, Homo Sapiens
KALEVFPEF

SEQ ID NO: 149267 - protein, 9 aa, Homo Sapiens
KANHAELIL

SEQ ID NO: 149268 - protein, 9 aa, Homo Sapiens
KANPALYVL

SEQ ID NO: 149269 - protein, 9 aa, Homo Sapiens
KAPEMTNEL

SEQ ID NO: 149270 - protein, 9 aa, Homo Sapiens
KAPEPLSSL

SEQ ID NO: 149271 - protein, 9 aa, Homo Sapiens
KGFVHKVEL

SEQ ID NO: 149272 - protein, 9 aa, Homo Sapiens
KGSGVVIIM

SEQ ID NO: 149273 - protein, 9 aa, Homo Sapiens
KIKEYIQKY

SEQ ID NO: 149274 - protein, 9 aa, Homo Sapiens
KINEAFIEM

SEQ ID NO: 149275 - protein, 9 aa, Homo Sapiens
KIPDKQYVL

SEQ ID NO: 149276 - protein, 9 aa, Homo Sapiens
KKNPFHLEL

SEQ ID NO: 149277 - protein, 9 aa, Homo Sapiens
KKPELVISY

SEQ ID NO: 149278 - protein, 9 aa, Homo Sapiens
KKPNFILLL

SEQ ID NO: 149279 - protein, 9 aa, Homo Sapiens
KKPTVTLTY

SEQ ID NO: 149280 - protein, 9 aa, Homo Sapiens
KKTEVVITL

SEQ ID NO: 149281 - protein, 9 aa, Homo Sapiens
KLNESVMVF

SEQ ID NO: 149282 - protein, 9 aa, Homo Sapiens
KLNPYAKTM

SEQ ID NO: 149283 - protein, 9 aa, Homo Sapiens
KLPPLPLTL

SEQ ID NO: 149284 - protein, 9 aa, Homo Sapiens
KMHPHPVAL

SEQ ID NO: 149285 - protein, 9 aa, Homo Sapiens
KNAQYVLVF

SEQ ID NO: 149286 - protein, 9 aa, Homo Sapiens
KNFDMVIVY

SEQ ID NO: 149287 - protein, 9 aa, Homo Sapiens
KNFVHAQCL

SEQ ID NO: 149288 - protein, 9 aa, Homo Sapiens
KNSYHPVSL

SEQ ID NO: 149289 - protein, 9 aa, Homo Sapiens
KNTDIAKEL

SEQ ID NO: 149290 - protein, 9 aa, Homo Sapiens
KNYTLVTVF

SEQ ID NO: 149291 - protein, 9 aa, Homo Sapiens
KQLDFTYEM

SEQ ID NO: 149292 - protein, 9 aa, Homo Sapiens
KRADLQSTF

SEQ ID NO: 149293 - protein, 9 aa, Homo Sapiens
KRADWLARL

SEQ ID NO: 149294 - protein, 9 aa, Homo Sapiens
KRAEEILRL

SEQ ID NO: 149295 - protein, 9 aa, Homo Sapiens
KRAPGIRSW

SEQ ID NO: 149296 - protein, 9 aa, Homo Sapiens
KRASYILRL

SEQ ID NO: 149297 - protein, 9 aa, Homo Sapiens
KRAYIPRTL

SEQ ID NO: 149298 - protein, 9 aa, Homo Sapiens
KRCDNMRVF

SEQ ID NO: 149299 - protein, 9 aa, Homo Sapiens
KRDAYVSRL

SEQ ID NO: 149300 - protein, 9 aa, Homo Sapiens
KRFDDKYTL

SEQ ID NO: 149301 - protein, 9 aa, Homo Sapiens
KRFDMAVMF

SEQ ID NO: 149302 - protein, 9 aa, Homo Sapiens
KRFEKVYTH

SEQ ID NO: 149303 - protein, 9 aa, Homo Sapiens
KRFFEVRRV

SEQ ID NO: 149304 - protein, 9 aa, Homo Sapiens
KRFGKAYNL

SEQ ID NO: 149305 - protein, 9 aa, Homo Sapiens
KRFQPVHDL

SEQ ID NO: 149306 - protein, 9 aa, Homo Sapiens
KRFQVAVNL

SEQ ID NO: 149307 - protein, 9 aa, Homo Sapiens
KRFSGTVRL

SEQ ID NO: 149308 - protein, 9 aa, Homo Sapiens
KRGDFIPGL

SEQ ID NO: 149309 - protein, 9 aa, Homo Sapiens
KRGDILKVL

SEQ ID NO: 149310 - protein, 9 aa, Homo Sapiens
KRGDVIYIL

SEQ ID NO: 149311 - protein, 9 aa, Homo Sapiens
KRGEYIKTW

SEQ ID NO: 149312 - protein, 9 aa, Homo Sapiens
KRIDIIHNL

SEQ ID NO: 149313 - protein, 9 aa, Homo Sapiens
KRIDYILVY

SEQ ID NO: 149314 - protein, 9 aa, Homo Sapiens
KRINWRTVL

SEQ ID NO: 149315 - protein, 9 aa, Homo Sapiens
KRLDVEFVL

SEQ ID NO: 149316 - protein, 9 aa, Homo Sapiens
KRLGIARVV

SEQ ID NO: 149317 - protein, 9 aa, Homo Sapiens
KRLKTVLEL

SEQ ID NO: 149318 - protein, 9 aa, Homo Sapiens
KRLNELREL

SEQ ID NO: 149319 - protein, 9 aa, Homo Sapiens
KRLNFITEY

SEQ ID NO: 149320 - protein, 9 aa, Homo Sapiens
KRLQQFLEF

SEQ ID NO: 149321 - protein, 9 aa, Homo Sapiens
KRLSVERIY

SEQ ID NO: 149322 - protein, 9 aa, Homo Sapiens
KRMQHVICV

SEQ ID NO: 149323 - protein, 9 aa, Homo Sapiens
KRNDYVHAL

SEQ ID NO: 149324 - protein, 9 aa, Homo Sapiens
KRNEFLGEL

SEQ ID NO: 149325 - protein, 9 aa, Homo Sapiens
KRNKIFMEF

SEQ ID NO: 149326 - protein, 9 aa, Homo Sapiens
KRPEFVRGY

SEQ ID NO: 149327 - protein, 9 aa, Homo Sapiens
KRPFGVSLL

SEQ ID NO: 149328 - protein, 9 aa, Homo Sapiens
KRPNAILKL

SEQ ID NO: 149329 - protein, 9 aa, Homo Sapiens
KRPRLPRKL

SEQ ID NO: 149330 - protein, 9 aa, Homo Sapiens
KRPSSVKVF

SEQ ID NO: 149331 - protein, 9 aa, Homo Sapiens
KRPVAVYNL

SEQ ID NO: 149332 - protein, 9 aa, Homo Sapiens
KRPVFIFEW

SEQ ID NO: 149333 - protein, 9 aa, Homo Sapiens
KRPVIVKVL

SEQ ID NO: 149334 - protein, 9 aa, Homo Sapiens
KRQEAIFEL

SEQ ID NO: 149335 - protein, 9 aa, Homo Sapiens
KRQEVIYEL

SEQ ID NO: 149336 - protein, 9 aa, Homo Sapiens
KRREPIPSL

SEQ ID NO: 149337 - protein, 9 aa, Homo Sapiens
KRSELVNWY

SEQ ID NO: 149338 - protein, 9 aa, Homo Sapiens
KRSNYITRL

SEQ ID NO: 149339 - protein, 9 aa, Homo Sapiens
KRVEDAYIL

SEQ ID NO: 149340 - protein, 9 aa, Homo Sapiens
KRVFPKWTY

SEQ ID NO: 149341 - protein, 9 aa, Homo Sapiens
KRVTWIVEF

SEQ ID NO: 149342 - protein, 9 aa, Homo Sapiens
KRWESERIL

SEQ ID NO: 149343 - protein, 9 aa, Homo Sapiens
KRWESERVL

SEQ ID NO: 149344 - protein, 9 aa, Homo Sapiens
KRYHIAKVY

SEQ ID NO: 149345 - protein, 9 aa, Homo Sapiens
KRYPECRDL

SEQ ID NO: 149346 - protein, 9 aa, Homo Sapiens
KRYQEALHL

SEQ ID NO: 149347 - protein, 9 aa, Homo Sapiens
KSFEDIHHY

SEQ ID NO: 149348 - protein, 9 aa, Homo Sapiens
KSFEDIHQY

SEQ ID NO: 149349 - protein, 9 aa, Homo Sapiens
KSFEGLFYF

SEQ ID NO: 149350 - protein, 9 aa, Homo Sapiens
KSKDFVQVM

SEQ ID NO: 149351 - protein, 9 aa, Homo Sapiens
KSLGVHYVF

SEQ ID NO: 149352 - protein, 9 aa, Homo Sapiens
KSNPKPLVL

SEQ ID NO: 149353 - protein, 9 aa, Homo Sapiens
KSTDVAKTF

SEQ ID NO: 149354 - protein, 9 aa, Homo Sapiens
KSTPVTVVL

SEQ ID NO: 149355 - protein, 9 aa, Homo Sapiens
KSYSVGVAY

SEQ ID NO: 149356 - protein, 9 aa, Homo Sapiens
KTFPYQHRY

SEQ ID NO: 149357 - protein, 9 aa, Homo Sapiens
KTFVHTVHL

SEQ ID NO: 149358 - protein, 9 aa, Homo Sapiens
KTIDYIQFL

SEQ ID NO: 149359 - protein, 9 aa, Homo Sapiens
KTKEVYELL

SEQ ID NO: 149360 - protein, 9 aa, Homo Sapiens
KTKPFQLQL

SEQ ID NO: 149361 - protein, 9 aa, Homo Sapiens
KTNAIPLTL

SEQ ID NO: 149362 - protein, 9 aa, Homo Sapiens
KTNDYCKSL

SEQ ID NO: 149363 - protein, 9 aa, Homo Sapiens
KTNEMLLNF

SEQ ID NO: 149364 - protein, 9 aa, Homo Sapiens
KTNHVFFLL

SEQ ID NO: 149365 - protein, 9 aa, Homo Sapiens
KTPEEVIEY

SEQ ID NO: 149366 - protein, 9 aa, Homo Sapiens
KTPNFSTLL

SEQ ID NO: 149367 - protein, 9 aa, Homo Sapiens
KTSDFLKVL

SEQ ID NO: 149368 - protein, 9 aa, Homo Sapiens
KTSDVYWVL

SEQ ID NO: 149369 - protein, 9 aa, Homo Sapiens
KTSPYPIIL

SEQ ID NO: 149370 - protein, 9 aa, Homo Sapiens
KTYDYLFKL

SEQ ID NO: 149371 - protein, 9 aa, Homo Sapiens
KVAGIAKVL

SEQ ID NO: 149372 - protein, 9 aa, Homo Sapiens
KVFEYHNVL

SEQ ID NO: 149373 - protein, 9 aa, Homo Sapiens
KVKEFFEKL

SEQ ID NO: 149374 - protein, 9 aa, Homo Sapiens
KVNGRPLEM

SEQ ID NO: 149375 - protein, 9 aa, Homo Sapiens
KVPPFVFFF

SEQ ID NO: 149376 - protein, 9 aa, Homo Sapiens
KVPTFVRML

SEQ ID NO: 149377 - protein, 9 aa, Homo Sapiens
KVSDYEMKL

SEQ ID NO: 149378 - protein, 9 aa, Homo Sapiens
KYADKIYSI

SEQ ID NO: 149379 - protein, 9 aa, Homo Sapiens
KYFDEHYEY

SEQ ID NO: 149380 - protein, 9 aa, Homo Sapiens
KYFEKQFEL

SEQ ID NO: 149381 - protein, 9 aa, Homo Sapiens
KYFLQQWEL

SEQ ID NO: 149382 - protein, 9 aa, Homo Sapiens
KYIGYARQY

SEQ ID NO: 149383 - protein, 9 aa, Homo Sapiens
KYMDVQFDF

SEQ ID NO: 149384 - protein, 9 aa, Homo Sapiens
KYNACILEY

SEQ ID NO: 149385 - protein, 9 aa, Homo Sapiens
LLNSNIPLE

SEQ ID NO: 149386 - protein, 9 aa, Homo Sapiens
LQIDNARLA

SEQ ID NO: 149387 - protein, 9 aa, Homo Sapiens
LRDHSVRVL

SEQ ID NO: 149388 - protein, 9 aa, Homo Sapiens
LRGDFVRRL

SEQ ID NO: 149389 - protein, 9 aa, Homo Sapiens
LRHPAIRVL

SEQ ID NO: 149390 - protein, 9 aa, Homo Sapiens
LRLSYPLEL

SEQ ID NO: 149391 - protein, 9 aa, Homo Sapiens
LRNKVIIEY

SEQ ID NO: 149392 - protein, 9 aa, Homo Sapiens
LRNPDIRVL

SEQ ID NO: 149393 - protein, 9 aa, Homo Sapiens
LRNQSVFNF

SEQ ID NO: 149394 - protein, 9 aa, Homo Sapiens
LRPGVRHPL

SEQ ID NO: 149395 - protein, 9 aa, Homo Sapiens
LRPSTSRSL

SEQ ID NO: 149396 - protein, 9 aa, Homo Sapiens
LRSGVIVRL

SEQ ID NO: 149397 - protein, 9 aa, Homo Sapiens
MAPLKMLAL

SEQ ID NO: 149398 - protein, 9 aa, Homo Sapiens
MQNPNAIIL

SEQ ID NO: 149399 - protein, 9 aa, Homo Sapiens
MRNAVCIFY

SEQ ID NO: 149400 - protein, 9 aa, Homo Sapiens
NRFNYPFEL

SEQ ID NO: 149401 - protein, 9 aa, Homo Sapiens
NRGDFFMTL

SEQ ID NO: 149402 - protein, 9 aa, Homo Sapiens
NRGEVVTSF

SEQ ID NO: 149403 - protein, 9 aa, Homo Sapiens
NRHGLIRKY

SEQ ID NO: 149404 - protein, 9 aa, Homo Sapiens
NSPLPGSEL

SEQ ID NO: 149405 - protein, 9 aa, Homo Sapiens
PIRPDIVNF

SEQ ID NO: 149406 - protein, 9 aa, Homo Sapiens
QIPEIKQTL

SEQ ID NO: 149407 - protein, 9 aa, Homo Sapiens
QQNPQPLIF

SEQ ID NO: 149408 - protein, 9 aa, Homo Sapiens
QRAEIIHHL

SEQ ID NO: 149409 - protein, 9 aa, Homo Sapiens
QRAHQILVL

SEQ ID NO: 149410 - protein, 9 aa, Homo Sapiens
QRGDLIRIL

SEQ ID NO: 149411 - protein, 9 aa, Homo Sapiens
QRMNFLVTL

SEQ ID NO: 149412 - protein, 9 aa, Homo Sapiens
QRNLFILAY

SEQ ID NO: 149413 - protein, 9 aa, Homo Sapiens
QRNPEISHL

SEQ ID NO: 149414 - protein, 9 aa, Homo Sapiens
QRNPEISHM

SEQ ID NO: 149415 - protein, 9 aa, Homo Sapiens
QRNVNIFKF

SEQ ID NO: 149416 - protein, 9 aa, Homo Sapiens
QRPRESYQM

SEQ ID NO: 149417 - protein, 9 aa, Homo Sapiens
QRPTIYYVM

SEQ ID NO: 149418 - protein, 9 aa, Homo Sapiens
QRQDIAFAY

SEQ ID NO: 149419 - protein, 9 aa, Homo Sapiens
QRSRFIVVV

SEQ ID NO: 149420 - protein, 9 aa, Homo Sapiens
QRVDYIMQL

SEQ ID NO: 149421 - protein, 9 aa, Homo Sapiens
QRVSCAHIY

SEQ ID NO: 149422 - protein, 9 aa, Homo Sapiens
QRYHQPHTL

SEQ ID NO: 149423 - protein, 9 aa, Homo Sapiens
QTNDVLLTF

SEQ ID NO: 149424 - protein, 9 aa, Homo Sapiens
RAADVLVYL

SEQ ID NO: 149425 - protein, 9 aa, Homo Sapiens
RAAPFSLEY

SEQ ID NO: 149426 - protein, 9 aa, Homo Sapiens
RAAPHRISL

SEQ ID NO: 149427 - protein, 9 aa, Homo Sapiens
RAQTVVVEY

SEQ ID NO: 149428 - protein, 9 aa, Homo Sapiens
RASQFTIVL

SEQ ID NO: 149429 - protein, 9 aa, Homo Sapiens
RGCDILIVY

SEQ ID NO: 149430 - protein, 9 aa, Homo Sapiens
RGSDVIIML

SEQ ID NO: 149431 - protein, 9 aa, Homo Sapiens
RGVEFVHVY

SEQ ID NO: 149432 - protein, 9 aa, Homo Sapiens
RIAEFAFEY

SEQ ID NO: 149433 - protein, 9 aa, Homo Sapiens
RILDQPYSL

SEQ ID NO: 149434 - protein, 9 aa, Homo Sapiens
RILFHGVFY

SEQ ID NO: 149435 - protein, 9 aa, Homo Sapiens
RILVHEWPM

SEQ ID NO: 149436 - protein, 9 aa, Homo Sapiens
RIPSFVTEL

SEQ ID NO: 149437 - protein, 9 aa, Homo Sapiens
RISDVHFSV

SEQ ID NO: 149438 - protein, 9 aa, Homo Sapiens
RIYPHGLVL

SEQ ID NO: 149439 - protein, 9 aa, Homo Sapiens
RKNPFVYKV

SEQ ID NO: 149440 - protein, 9 aa, Homo Sapiens
RKPKYIHNL

SEQ ID NO: 149441 - protein, 9 aa, Homo Sapiens
RLNDYIFSF

SEQ ID NO: 149442 - protein, 9 aa, Homo Sapiens
RLPAWQPIL

SEQ ID NO: 149443 - protein, 9 aa, Homo Sapiens
RLPDVQLWL

SEQ ID NO: 149444 - protein, 9 aa, Homo Sapiens
RLPEHCIEY

SEQ ID NO: 149445 - protein, 9 aa, Homo Sapiens
RLPEIYIQL

SEQ ID NO: 149446 - protein, 9 aa, Homo Sapiens
RNFHVFLEY

SEQ ID NO: 149447 - protein, 9 aa, Homo Sapiens
RNFVEETVY

SEQ ID NO: 149448 - protein, 9 aa, Homo Sapiens
RNHPYPYLM

SEQ ID NO: 149449 - protein, 9 aa, Homo Sapiens
RNKEIVHTF

SEQ ID NO: 149450 - protein, 9 aa, Homo Sapiens
RNKNIVHML

SEQ ID NO: 149451 - protein, 9 aa, Homo Sapiens
RNLDAQYEM

SEQ ID NO: 149452 - protein, 9 aa, Homo Sapiens
RNLDKAFSY

SEQ ID NO: 149453 - protein, 9 aa, Homo Sapiens
RNLFHRQGF

SEQ ID NO: 149454 - protein, 9 aa, Homo Sapiens
RNLHVVFTM

SEQ ID NO: 149455 - protein, 9 aa, Homo Sapiens
RNLLHDNEL

SEQ ID NO: 149456 - protein, 9 aa, Homo Sapiens
RNLPTIFVY

SEQ ID NO: 149457 - protein, 9 aa, Homo Sapiens
RNLYLIMEF

SEQ ID NO: 149458 - protein, 9 aa, Homo Sapiens
RNNSVVQVL

SEQ ID NO: 149459 - protein, 9 aa, Homo Sapiens
RNRILEIVY

SEQ ID NO: 149460 - protein, 9 aa, Homo Sapiens
RNTFHVISF

SEQ ID NO: 149461 - protein, 9 aa, Homo Sapiens
RNVARCWTY

SEQ ID NO: 149462 - protein, 9 aa, Homo Sapiens
RNYFKKEEL

SEQ ID NO: 149463 - protein, 9 aa, Homo Sapiens
RNYLHYSLY

SEQ ID NO: 149464 - protein, 9 aa, Homo Sapiens
RNYYHESAF

SEQ ID NO: 149465 - protein, 9 aa, Homo Sapiens
RQADFVQVL

SEQ ID NO: 149466 - protein, 9 aa, Homo Sapiens
RQFPTAFEF

SEQ ID NO: 149467 - protein, 9 aa, Homo Sapiens
RQRSLFVVV

SEQ ID NO: 149468 - protein, 9 aa, Homo Sapiens
RRAAEPVTF

SEQ ID NO: 149469 - protein, 9 aa, Homo Sapiens
RRAEVELEY

SEQ ID NO: 149470 - protein, 9 aa, Homo Sapiens
RRAPAHPCL

SEQ ID NO: 149471 - protein, 9 aa, Homo Sapiens
RRAPEPRVI

SEQ ID NO: 149472 - protein, 9 aa, Homo Sapiens
RRAPHLHTL

SEQ ID NO: 149473 - protein, 9 aa, Homo Sapiens
RRAPVVVRL

SEQ ID NO: 149474 - protein, 9 aa, Homo Sapiens
RRAQPLVTL

SEQ ID NO: 149475 - protein, 9 aa, Homo Sapiens
RRATWLHQA

SEQ ID NO: 149476 - protein, 9 aa, Homo Sapiens
RRDGQILVY

SEQ ID NO: 149477 - protein, 9 aa, Homo Sapiens
RRDTNVLVY

SEQ ID NO: 149478 - protein, 9 aa, Homo Sapiens
RRDYVFIEF

SEQ ID NO: 149479 - protein, 9 aa, Homo Sapiens
RRFDCNFDL

SEQ ID NO: 149480 - protein, 9 aa, Homo Sapiens
RRFDTAFFL

SEQ ID NO: 149481 - protein, 9 aa, Homo Sapiens
RRFFPYYVY

SEQ ID NO: 149482 - protein, 9 aa, Homo Sapiens
RRFKEPWFL

SEQ ID NO: 149483 - protein, 9 aa, Homo Sapiens
RRFKWAIEL

SEQ ID NO: 149484 - protein, 9 aa, Homo Sapiens
RRFLAARTL

SEQ ID NO: 149485 - protein, 9 aa, Homo Sapiens
RRFMQTFVL

SEQ ID NO: 149486 - protein, 9 aa, Homo Sapiens
RRFPLEQRL

SEQ ID NO: 149487 - protein, 9 aa, Homo Sapiens
RRFPSPHYL

SEQ ID NO: 149488 - protein, 9 aa, Homo Sapiens
RRFTEIYEF

SEQ ID NO: 149489 - protein, 9 aa, Homo Sapiens
RRFWNSIVM

SEQ ID NO: 149490 - protein, 9 aa, Homo Sapiens
RRGDALIEM

SEQ ID NO: 149491 - protein, 9 aa, Homo Sapiens
RRGDFIHVM

SEQ ID NO: 149492 - protein, 9 aa, Homo Sapiens
RRGDIIEVL

SEQ ID NO: 149493 - protein, 9 aa, Homo Sapiens
RRGDLPFVV

SEQ ID NO: 149494 - protein, 9 aa, Homo Sapiens
RRGDTFYVV

SEQ ID NO: 149495 - protein, 9 aa, Homo Sapiens
RRGEFIQEI

SEQ ID NO: 149496 - protein, 9 aa, Homo Sapiens
RRGEYVLTF

SEQ ID NO: 149497 - protein, 9 aa, Homo Sapiens
RRGIFHIIL

SEQ ID NO: 149498 - protein, 9 aa, Homo Sapiens
RRGILIRQL

SEQ ID NO: 149499 - protein, 9 aa, Homo Sapiens
RRGPGPLTL

SEQ ID NO: 149500 - protein, 9 aa, Homo Sapiens
RRGPGWRPL

SEQ ID NO: 149501 - protein, 9 aa, Homo Sapiens
RRHMEFRKL

SEQ ID NO: 149502 - protein, 9 aa, Homo Sapiens
RRHPACRVL

SEQ ID NO: 149503 - protein, 9 aa, Homo Sapiens
RRHTDPVQL

SEQ ID NO: 149504 - protein, 9 aa, Homo Sapiens
RRHWGGNVL

SEQ ID NO: 149505 - protein, 9 aa, Homo Sapiens
RRIDFVLVY

SEQ ID NO: 149506 - protein, 9 aa, Homo Sapiens
RRIEIAHSL

SEQ ID NO: 149507 - protein, 9 aa, Homo Sapiens
RRIQFPIEM

SEQ ID NO: 149508 - protein, 9 aa, Homo Sapiens
RRKDGVFLY

SEQ ID NO: 149509 - protein, 9 aa, Homo Sapiens
RRKDLVLKY

SEQ ID NO: 149510 - protein, 9 aa, Homo Sapiens
RRKEVVVYL

SEQ ID NO: 149511 - protein, 9 aa, Homo Sapiens
RRLDIVRSL

SEQ ID NO: 149512 - protein, 9 aa, Homo Sapiens
RRLDLVHTA

SEQ ID NO: 149513 - protein, 9 aa, Homo Sapiens
RRLNFVRLL

SEQ ID NO: 149514 - protein, 9 aa, Homo Sapiens
RRMDVFTEA

SEQ ID NO: 149515 - protein, 9 aa, Homo Sapiens
RRMEVYNEF

SEQ ID NO: 149516 - protein, 9 aa, Homo Sapiens
RRNDDIINF

SEQ ID NO: 149517 - protein, 9 aa, Homo Sapiens
RRNDKIIVF

SEQ ID NO: 149518 - protein, 9 aa, Homo Sapiens
RRNPEPLRF

SEQ ID NO: 149519 - protein, 9 aa, Homo Sapiens
RRNPGVVIY

SEQ ID NO: 149520 - protein, 9 aa, Homo Sapiens
RRNPYCRTL

SEQ ID NO: 149521 - protein, 9 aa, Homo Sapiens
RRPEFQTLL

SEQ ID NO: 149522 - protein, 9 aa, Homo Sapiens
RRPEPVQTL

SEQ ID NO: 149523 - protein, 9 aa, Homo Sapiens
RRPIVACEL

SEQ ID NO: 149524 - protein, 9 aa, Homo Sapiens
RRPLFALLL

SEQ ID NO: 149525 - protein, 9 aa, Homo Sapiens
RRPRIPREL

SEQ ID NO: 149526 - protein, 9 aa, Homo Sapiens
RRPSFTRTW

SEQ ID NO: 149527 - protein, 9 aa, Homo Sapiens
RRPYVRVEL

SEQ ID NO: 149528 - protein, 9 aa, Homo Sapiens
RRQEAIYEM

SEQ ID NO: 149529 - protein, 9 aa, Homo Sapiens
RRQELEQVL

SEQ ID NO: 149530 - protein, 9 aa, Homo Sapiens
RRQNVAYEY

SEQ ID NO: 149531 - protein, 9 aa, Homo Sapiens
RRQPQPWCL

SEQ ID NO: 149532 - protein, 9 aa, Homo Sapiens
RRSDDMFTF

SEQ ID NO: 149533 - protein, 9 aa, Homo Sapiens
RRSPFLQVF

SEQ ID NO: 149534 - protein, 9 aa, Homo Sapiens
RRSSIPITV

SEQ ID NO: 149535 - protein, 9 aa, Homo Sapiens
RRSSSWRIL

SEQ ID NO: 149536 - protein, 9 aa, Homo Sapiens
RRTDCAYVV

SEQ ID NO: 149537 - protein, 9 aa, Homo Sapiens
RRVEKHWRL

SEQ ID NO: 149538 - protein, 9 aa, Homo Sapiens
RRVEVTRQL

SEQ ID NO: 149539 - protein, 9 aa, Homo Sapiens
RRWEEVQSY

SEQ ID NO: 149540 - protein, 9 aa, Homo Sapiens
RRWEQALTF

SEQ ID NO: 149541 - protein, 9 aa, Homo Sapiens
RRWHLQHTL

SEQ ID NO: 149542 - protein, 9 aa, Homo Sapiens
RRYCDPVVL

SEQ ID NO: 149543 - protein, 9 aa, Homo Sapiens
RRYEIAVNL

SEQ ID NO: 149544 - protein, 9 aa, Homo Sapiens
RRYNDFVVF

SEQ ID NO: 149545 - protein, 9 aa, Homo Sapiens
RRYPIARVF

SEQ ID NO: 149546 - protein, 9 aa, Homo Sapiens
RRYSTLREL

SEQ ID NO: 149547 - protein, 9 aa, Homo Sapiens
RSFFHQHYL

SEQ ID NO: 149548 - protein, 9 aa, Homo Sapiens
RSFPSVREL

SEQ ID NO: 149549 - protein, 9 aa, Homo Sapiens
RSGPEFTLL

SEQ ID NO: 149550 - protein, 9 aa, Homo Sapiens
RSGPWNRGF

SEQ ID NO: 149551 - protein, 9 aa, Homo Sapiens
RSINQPVAF

SEQ ID NO: 149552 - protein, 9 aa, Homo Sapiens
RSLAYIHSF

SEQ ID NO: 149553 - protein, 9 aa, Homo Sapiens
RSLGVHLSF

SEQ ID NO: 149554 - protein, 9 aa, Homo Sapiens
RSLPFPTVL

SEQ ID NO: 149555 - protein, 9 aa, Homo Sapiens
RSLSTTNVF

SEQ ID NO: 149556 - protein, 9 aa, Homo Sapiens
RSMEAHNIL

SEQ ID NO: 149557 - protein, 9 aa, Homo Sapiens
RSMGLPLQF

SEQ ID NO: 149558 - protein, 9 aa, Homo Sapiens
RSNFLVLCY

SEQ ID NO: 149559 - protein, 9 aa, Homo Sapiens
RSPDFASSF

SEQ ID NO: 149560 - protein, 9 aa, Homo Sapiens
RSQEYKIVL

SEQ ID NO: 149561 - protein, 9 aa, Homo Sapiens
RSRPYPVCF

SEQ ID NO: 149562 - protein, 9 aa, Homo Sapiens
RSSTYVQVL

SEQ ID NO: 149563 - protein, 9 aa, Homo Sapiens
RSVLHHFHF

SEQ ID NO: 149564 - protein, 9 aa, Homo Sapiens
RTADFVFMF

SEQ ID NO: 149565 - protein, 9 aa, Homo Sapiens
RTADVIIMM

SEQ ID NO: 149566 - protein, 9 aa, Homo Sapiens
RTAHVILRY

SEQ ID NO: 149567 - protein, 9 aa, Homo Sapiens
RTATYITEL

SEQ ID NO: 149568 - protein, 9 aa, Homo Sapiens
RTFLHTVCF

SEQ ID NO: 149569 - protein, 9 aa, Homo Sapiens
RTFWHKISY

SEQ ID NO: 149570 - protein, 9 aa, Homo Sapiens
RTHPVATSF

SEQ ID NO: 149571 - protein, 9 aa, Homo Sapiens
RTIATALEY

SEQ ID NO: 149572 - protein, 9 aa, Homo Sapiens
RTIGFFYTL

SEQ ID NO: 149573 - protein, 9 aa, Homo Sapiens
RTKASVHTL

SEQ ID NO: 149574 - protein, 9 aa, Homo Sapiens
RTKDTPLSL

SEQ ID NO: 149575 - protein, 9 aa, Homo Sapiens
RTLDCIHVL

SEQ ID NO: 149576 - protein, 9 aa, Homo Sapiens
RTNEGVIEF

SEQ ID NO: 149577 - protein, 9 aa, Homo Sapiens
RTNNIELHY

SEQ ID NO: 149578 - protein, 9 aa, Homo Sapiens
RTPAAVREL

SEQ ID NO: 149579 - protein, 9 aa, Homo Sapiens
RTPDGQYIY

SEQ ID NO: 149580 - protein, 9 aa, Homo Sapiens
RTPDTPFSL

SEQ ID NO: 149581 - protein, 9 aa, Homo Sapiens
RTPGNRIVY

SEQ ID NO: 149582 - protein, 9 aa, Homo Sapiens
RTSNYIYNF

SEQ ID NO: 149583 - protein, 9 aa, Homo Sapiens
RTSPYRTVL

SEQ ID NO: 149584 - protein, 9 aa, Homo Sapiens
RTYDLYITY

SEQ ID NO: 149585 - protein, 9 aa, Homo Sapiens
RVAIHGWSY

SEQ ID NO: 149586 - protein, 9 aa, Homo Sapiens
RVAMYVHAY

SEQ ID NO: 149587 - protein, 9 aa, Homo Sapiens
RVIDYILDL

SEQ ID NO: 149588 - protein, 9 aa, Homo Sapiens
RVKPAVFDL

SEQ ID NO: 149589 - protein, 9 aa, Homo Sapiens
RVKPNIFSY

SEQ ID NO: 149590 - protein, 9 aa, Homo Sapiens
RVKTVTFEY

SEQ ID NO: 149591 - protein, 9 aa, Homo Sapiens
RVQEAIIHF

SEQ ID NO: 149592 - protein, 9 aa, Homo Sapiens
RVQGFQVEY

SEQ ID NO: 149593 - protein, 9 aa, Homo Sapiens
RVVSYQIRY

SEQ ID NO: 149594 - protein, 9 aa, Homo Sapiens
RVYVHPFHL

SEQ ID NO: 149595 - protein, 9 aa, Homo Sapiens
RYSEAVFYY

SEQ ID NO: 149596 - protein, 9 aa, Homo Sapiens
RYVEFNLLY

SEQ ID NO: 149597 - protein, 9 aa, Homo Sapiens
RYYHCAVTL

SEQ ID NO: 149598 - protein, 9 aa, Homo Sapiens
SAPDKSLEL

SEQ ID NO: 149599 - protein, 9 aa, Homo Sapiens
SAPVPASPL

SEQ ID NO: 149600 - protein, 9 aa, Homo Sapiens
SGPGPAAAL

SEQ ID NO: 149601 - protein, 9 aa, Homo Sapiens
SGPVPGTAI

SEQ ID NO: 149602 - protein, 9 aa, Homo Sapiens
SIIAEVKAQ

SEQ ID NO: 149603 - protein, 9 aa, Homo Sapiens
SINQFALEL

SEQ ID NO: 149604 - protein, 9 aa, Homo Sapiens
SIPLALALS

SEQ ID NO: 149605 - protein, 9 aa, Homo Sapiens
SNFLHPVIY

SEQ ID NO: 149606 - protein, 9 aa, Homo Sapiens
SPREAARVL

SEQ ID NO: 149607 - protein, 9 aa, Homo Sapiens
SRADTILCL

SEQ ID NO: 149608 - protein, 9 aa, Homo Sapiens
SRAKAVRAL

SEQ ID NO: 149609 - protein, 9 aa, Homo Sapiens
SRAPVFLQF

SEQ ID NO: 149610 - protein, 9 aa, Homo Sapiens
SRDKFIREL

SEQ ID NO: 149611 - protein, 9 aa, Homo Sapiens
SRFAKVHIL

SEQ ID NO: 149612 - protein, 9 aa, Homo Sapiens
SRFDMIFIV

SEQ ID NO: 149613 - protein, 9 aa, Homo Sapiens
SRFEKEFSF

SEQ ID NO: 149614 - protein, 9 aa, Homo Sapiens
SRFGNAFHL

SEQ ID NO: 149615 - protein, 9 aa, Homo Sapiens
SRFIFNYVY

SEQ ID NO: 149616 - protein, 9 aa, Homo Sapiens
SRFSNVYHL

SEQ ID NO: 149617 - protein, 9 aa, Homo Sapiens
SRFTYPYLL

SEQ ID NO: 149618 - protein, 9 aa, Homo Sapiens
SRGDFLRHL

SEQ ID NO: 149619 - protein, 9 aa, Homo Sapiens
SRGDFVVEY

SEQ ID NO: 149620 - protein, 9 aa, Homo Sapiens
SRGDVKVIM

SEQ ID NO: 149621 - protein, 9 aa, Homo Sapiens
SRGEGIRTL

SEQ ID NO: 149622 - protein, 9 aa, Homo Sapiens
SRIAGIRVL

SEQ ID NO: 149623 - protein, 9 aa, Homo Sapiens
SRIGHIAHL

SEQ ID NO: 149624 - protein, 9 aa, Homo Sapiens
SRIHPVSTM

SEQ ID NO: 149625 - protein, 9 aa, Homo Sapiens
SRITTHFEL

SEQ ID NO: 149626 - protein, 9 aa, Homo Sapiens
SRKSFVFEL

SEQ ID NO: 149627 - protein, 9 aa, Homo Sapiens
SRLFFVIEY

SEQ ID NO: 149628 - protein, 9 aa, Homo Sapiens
SRLGSSRVL

SEQ ID NO: 149629 - protein, 9 aa, Homo Sapiens
SRLSFCQEL

SEQ ID NO: 149630 - protein, 9 aa, Homo Sapiens
SRMPGELVL

SEQ ID NO: 149631 - protein, 9 aa, Homo Sapiens
SRMYFTQTL

SEQ ID NO: 149632 - protein, 9 aa, Homo Sapiens
SRNAYMLVY

SEQ ID NO: 149633 - protein, 9 aa, Homo Sapiens
SRNDFTLQL

SEQ ID NO: 149634 - protein, 9 aa, Homo Sapiens
SRNEGVATY

SEQ ID NO: 149635 - protein, 9 aa, Homo Sapiens
SRNEIIQSY

SEQ ID NO: 149636 - protein, 9 aa, Homo Sapiens
SRNNFIRNY

SEQ ID NO: 149637 - protein, 9 aa, Homo Sapiens
SRNPQSYHL

SEQ ID NO: 149638 - protein, 9 aa, Homo Sapiens
SRNPTFMCL

SEQ ID NO: 149639 - protein, 9 aa, Homo Sapiens
SRPENAIIY

SEQ ID NO: 149640 - protein, 9 aa, Homo Sapiens
SRPNIILVM

SEQ ID NO: 149641 - protein, 9 aa, Homo Sapiens
SRPRVVIQL

SEQ ID NO: 149642 - protein, 9 aa, Homo Sapiens
SRPSTYYEL

SEQ ID NO: 149643 - protein, 9 aa, Homo Sapiens
SRQGCTITM

SEQ ID NO: 149644 - protein, 9 aa, Homo Sapiens
SRSEYLNRL

SEQ ID NO: 149645 - protein, 9 aa, Homo Sapiens
SRSHSVFQL

SEQ ID NO: 149646 - protein, 9 aa, Homo Sapiens
SRSVIIREL

SEQ ID NO: 149647 - protein, 9 aa, Homo Sapiens
SRTGYVHIY

SEQ ID NO: 149648 - protein, 9 aa, Homo Sapiens
SRVEAVYVL

SEQ ID NO: 149649 - protein, 9 aa, Homo Sapiens
SRVIHIRKL

SEQ ID NO: 149650 - protein, 9 aa, Homo Sapiens
SRVKLILEY

SEQ ID NO: 149651 - protein, 9 aa, Homo Sapiens
SRVQYFWEA

SEQ ID NO: 149652 - protein, 9 aa, Homo Sapiens
SRYGDIRRL

SEQ ID NO: 149653 - protein, 9 aa, Homo Sapiens
SRYQDILVF

SEQ ID NO: 149654 - protein, 9 aa, Homo Sapiens
SSLLEKGLD

SEQ ID NO: 149655 - protein, 9 aa, Homo Sapiens
SSNPVYMEM

SEQ ID NO: 149656 - protein, 9 aa, Homo Sapiens
SSPEFSKTL

SEQ ID NO: 149657 - protein, 9 aa, Homo Sapiens
STNAYMLIY

SEQ ID NO: 149658 - protein, 9 aa, Homo Sapiens
STPDHSFSL

SEQ ID NO: 149659 - protein, 9 aa, Homo Sapiens
SVKHFHVEY

SEQ ID NO: 149660 - protein, 9 aa, Homo Sapiens
SVLPFQIYY

SEQ ID NO: 149661 - protein, 9 aa, Homo Sapiens
SVNRYILQL

SEQ ID NO: 149662 - protein, 9 aa, Homo Sapiens
SVVFHSTVI

SEQ ID NO: 149663 - protein, 9 aa, Homo Sapiens
SYIGFPVEL

SEQ ID NO: 149664 - protein, 9 aa, Homo Sapiens
TAPQGNVDL

SEQ ID NO: 149665 - protein, 9 aa, Homo Sapiens
TNHLHQTPL

SEQ ID NO: 149666 - protein, 9 aa, Homo Sapiens
TRAQWFYEY

SEQ ID NO: 149667 - protein, 9 aa, Homo Sapiens
TRDPLVIEL

SEQ ID NO: 149668 - protein, 9 aa, Homo Sapiens
TRGDYAPIL

SEQ ID NO: 149669 - protein, 9 aa, Homo Sapiens
TRIPRVRVL

SEQ ID NO: 149670 - protein, 9 aa, Homo Sapiens
TRMRHVISY

SEQ ID NO: 149671 - protein, 9 aa, Homo Sapiens
TRMSTVSEL

SEQ ID NO: 149672 - protein, 9 aa, Homo Sapiens
TRNDYVMMY

SEQ ID NO: 149673 - protein, 9 aa, Homo Sapiens
TRNPLVAVY

SEQ ID NO: 149674 - protein, 9 aa, Homo Sapiens
TRSAIILHL

SEQ ID NO: 149675 - protein, 9 aa, Homo Sapiens
TRSFYKHIL

SEQ ID NO: 149676 - protein, 9 aa, Homo Sapiens
TRSKSLKIL

SEQ ID NO: 149677 - protein, 9 aa, Homo Sapiens
TRVDTILEF

SEQ ID NO: 149678 - protein, 9 aa, Homo Sapiens
TRVKAVRIL

SEQ ID NO: 149679 - protein, 9 aa, Homo Sapiens
TRVYLILEY

SEQ ID NO: 149680 - protein, 9 aa, Homo Sapiens
TRWPGFYIL

SEQ ID NO: 149681 - protein, 9 aa, Homo Sapiens
TSPEAFLAL

SEQ ID NO: 149682 - protein, 9 aa, Homo Sapiens
TYVSFPLEL

SEQ ID NO: 149683 - protein, 9 aa, Homo Sapiens
VAPLPRSAL

SEQ ID NO: 149684 - protein, 9 aa, Homo Sapiens
VAPPGCSHL

SEQ ID NO: 149685 - protein, 9 aa, Homo Sapiens
VAPPVSGDL

SEQ ID NO: 149686 - protein, 9 aa, Homo Sapiens
VINPEPITL

SEQ ID NO: 149687 - protein, 9 aa, Homo Sapiens
VRAWVVFKL

SEQ ID NO: 149688 - protein, 9 aa, Homo Sapiens
VRFDQVTVY

SEQ ID NO: 149689 - protein, 9 aa, Homo Sapiens
VRFHRPYRL

SEQ ID NO: 149690 - protein, 9 aa, Homo Sapiens
VRKSIARVL

SEQ ID NO: 149691 - protein, 9 aa, Homo Sapiens
VRLPYPLQM

SEQ ID NO: 149692 - protein, 9 aa, Homo Sapiens
VRMGYQCTF

SEQ ID NO: 149693 - protein, 9 aa, Homo Sapiens
VRNDIYITL

SEQ ID NO: 149694 - protein, 9 aa, Homo Sapiens
VRNNVIIVM

SEQ ID NO: 149695 - protein, 9 aa, Homo Sapiens
VRNPFTVTV

SEQ ID NO: 149696 - protein, 9 aa, Homo Sapiens
VRNPRITSL

SEQ ID NO: 149697 - protein, 9 aa, Homo Sapiens
VRPPTPREL

SEQ ID NO: 149698 - protein, 9 aa, Homo Sapiens
VRPSYWLVL

SEQ ID NO: 149699 - protein, 9 aa, Homo Sapiens
VRSGYYKVL

SEQ ID NO: 149700 - protein, 9 aa, Homo Sapiens
VRSPVVHSV

SEQ ID NO: 149701 - protein, 9 aa, Homo Sapiens
VRTPYTMSY

SEQ ID NO: 149702 - protein, 9 aa, Homo Sapiens
VRVPYFIDL

SEQ ID NO: 149703 - protein, 9 aa, Homo Sapiens
VSNKYGLVF

SEQ ID NO: 149704 - protein, 9 aa, Homo Sapiens
VTKKYHEVL

SEQ ID NO: 149705 - protein, 9 aa, Homo Sapiens
VYKAFVDNY

SEQ ID NO: 149706 - protein, 9 aa, Homo Sapiens
YAAPHFFHL

SEQ ID NO: 149707 - protein, 9 aa, Homo Sapiens
YGSPGILEF

SEQ ID NO: 149708 - protein, 9 aa, Homo Sapiens
YQVGVHYEL

SEQ ID NO: 149709 - protein, 9 aa, Homo Sapiens
YRAPGTPTY

SEQ ID NO: 149710 - protein, 9 aa, Homo Sapiens
YRAQPSVSL

SEQ ID NO: 149711 - protein, 9 aa, Homo Sapiens
YRHDAVKIL

SEQ ID NO: 149712 - protein, 9 aa, Homo Sapiens
YRHPDPREL

SEQ ID NO: 149713 - protein, 9 aa, Homo Sapiens
YRNAYTMVL

SEQ ID NO: 149714 - protein, 9 aa, Homo Sapiens
YRNEFTAWY

SEQ ID NO: 149715 - protein, 9 aa, Homo Sapiens
YRNKFTQKY

SEQ ID NO: 149716 - protein, 9 aa, Homo Sapiens
YRNPCYVSY

SEQ ID NO: 149717 - protein, 9 aa, Homo Sapiens
YRPAYLVTL

SEQ ID NO: 149718 - protein, 9 aa, Homo Sapiens
YRTDMIQAL

SEQ ID NO: 149719 - protein, 9 aa, Homo Sapiens
YSFGGCHRY

SEQ ID NO: 149720 - protein, 9 aa, Homo Sapiens
YSTPHAFTF

SEQ ID NO: 149721 - protein, 9 aa, Homo Sapiens
YTSDYFISY

SEQ ID NO: 149722 - protein, 9 aa, Homo Sapiens
YTTDFIYQL

SEQ ID NO: 149723 - protein, 10 aa, Homo Sapiens
AQFNRMTVEY

SEQ ID NO: 149724 - protein, 10 aa, Homo Sapiens
AQQGHRPYFL

SEQ ID NO: 149725 - protein, 10 aa, Homo Sapiens
ARPRFEPVHF

SEQ ID NO: 149726 - protein, 10 aa, Homo Sapiens
ARSDKPIFTL

SEQ ID NO: 149727 - protein, 10 aa, Homo Sapiens
ARSENLIYTY

SEQ ID NO: 149728 - protein, 10 aa, Homo Sapiens
ARYGKSPYLY

SEQ ID NO: 149729 - protein, 10 aa, Homo Sapiens
ARYSGSYNDY

SEQ ID NO: 149730 - protein, 10 aa, Homo Sapiens
ASFDGRISVY

SEQ ID NO: 149731 - protein, 10 aa, Homo Sapiens
ATYNGPKHSL

SEQ ID NO: 149732 - protein, 10 aa, Homo Sapiens
EEQLQQIRAE

SEQ ID NO: 149733 - protein, 10 aa, Homo Sapiens
FHPEAHAITL

SEQ ID NO: 149734 - protein, 10 aa, Homo Sapiens
GPPPPPGKPQ

SEQ ID NO: 149735 - protein, 10 aa, Homo Sapiens
HRFEQAFYTY

SEQ ID NO: 149736 - protein, 10 aa, Homo Sapiens
IRAPQIGGSF

SEQ ID NO: 149737 - protein, 10 aa, Homo Sapiens
IRLENEIQTY

SEQ ID NO: 149738 - protein, 10 aa, Homo Sapiens
KAEAESLYQS

SEQ ID NO: 149739 - protein, 10 aa, Homo Sapiens
KDIENQYETQ

SEQ ID NO: 149740 - protein, 10 aa, Homo Sapiens
KRHEMPPHIY

SEQ ID NO: 149741 - protein, 10 aa, Homo Sapiens
KRIAEFAFEY

SEQ ID NO: 149742 - protein, 10 aa, Homo Sapiens
KRLDVTVQSF

SEQ ID NO: 149743 - protein, 10 aa, Homo Sapiens
KRMDEQRVLL

SEQ ID NO: 149744 - protein, 10 aa, Homo Sapiens
KRNDYVHALV

SEQ ID NO: 149745 - protein, 10 aa, Homo Sapiens
KRNGVIIAGY

SEQ ID NO: 149746 - protein, 10 aa, Homo Sapiens
KRPTDYFAEM

SEQ ID NO: 149747 - protein, 10 aa, Homo Sapiens
KRYDGDITDL

SEQ ID NO: 149748 - protein, 10 aa, Homo Sapiens
KRYDLEYWAF

SEQ ID NO: 149749 - protein, 10 aa, Homo Sapiens
KSNNEIVLVL

SEQ ID NO: 149750 - protein, 10 aa, Homo Sapiens
KTKDGVREVF

SEQ ID NO: 149751 - protein, 10 aa, Homo Sapiens
KTNDQMVVVY

SEQ ID NO: 149752 - protein, 10 aa, Homo Sapiens
LRAPCLPVTY

SEQ ID NO: 149753 - protein, 10 aa, Homo Sapiens
NRGDKYIAKF

SEQ ID NO: 149754 - protein, 10 aa, Homo Sapiens
RNLDIERPTY

SEQ ID NO: 149755 - protein, 10 aa, Homo Sapiens
RRAEGPPRLA

SEQ ID NO: 149756 - protein, 10 aa, Homo Sapiens
RRFDAMPFTL

SEQ ID NO: 149757 - protein, 10 aa, Homo Sapiens
RRGDFIHVMD

SEQ ID NO: 149758 - protein, 10 aa, Homo Sapiens
RRHTVYLDSY

SEQ ID NO: 149759 - protein, 10 aa, Homo Sapiens
RRIQDPLIEF

SEQ ID NO: 149760 - protein, 10 aa, Homo Sapiens
RRISGVDRYY

SEQ ID NO: 149761 - protein, 10 aa, Homo Sapiens
RRKDFVSEAY

SEQ ID NO: 149762 - protein, 10 aa, Homo Sapiens
RRNEALPVTL

SEQ ID NO: 149763 - protein, 10 aa, Homo Sapiens
RRNNKLIFKV

SEQ ID NO: 149764 - protein, 10 aa, Homo Sapiens
RRPEYTPIHL

SEQ ID NO: 149765 - protein, 10 aa, Homo Sapiens
RRSDPGHYSF

SEQ ID NO: 149766 - protein, 10 aa, Homo Sapiens
RRSINQPVAF

SEQ ID NO: 149767 - protein, 10 aa, Homo Sapiens
RTNHQGTYVL

SEQ ID NO: 149768 - protein, 10 aa, Homo Sapiens
RYIDRIHIFF

SEQ ID NO: 149769 - protein, 10 aa, Homo Sapiens
RYMDDYIFTY

SEQ ID NO: 149770 - protein, 10 aa, Homo Sapiens
RYMELYTHVY

SEQ ID NO: 149771 - protein, 10 aa, Homo Sapiens
SAIPANIHIY

SEQ ID NO: 149772 - protein, 10 aa, Homo Sapiens
SGPQAPVFEF

SEQ ID NO: 149773 - protein, 10 aa, Homo Sapiens
SIEGRVAVEY

SEQ ID NO: 149774 - protein, 10 aa, Homo Sapiens
SREGHCVIFY

SEQ ID NO: 149775 - protein, 10 aa, Homo Sapiens
SREGRPIWQL

SEQ ID NO: 149776 - protein, 10 aa, Homo Sapiens
SRGPGTSFEF

SEQ ID NO: 149777 - protein, 10 aa, Homo Sapiens
SRGQQVIVSY

SEQ ID NO: 149778 - protein, 10 aa, Homo Sapiens
SRHSGPFFTF

SEQ ID NO: 149779 - protein, 10 aa, Homo Sapiens
SRRFFPYYVY

SEQ ID NO: 149780 - protein, 10 aa, Homo Sapiens
SRTNRPPLSL

SEQ ID NO: 149781 - protein, 10 aa, Homo Sapiens
SRVGYPAQVY

SEQ ID NO: 149782 - protein, 10 aa, Homo Sapiens
SRYDGQIAVF

SEQ ID NO: 149783 - protein, 10 aa, Homo Sapiens
STPSEPHPVL

SEQ ID NO: 149784 - protein, 10 aa, Homo Sapiens
SVHGKPSVVY

SEQ ID NO: 149785 - protein, 10 aa, Homo Sapiens
TISSNVASKA

SEQ ID NO: 149786 - protein, 10 aa, Homo Sapiens
TRAQLPVVVF

SEQ ID NO: 149787 - protein, 10 aa, Homo Sapiens
VAPGKDLTKT

SEQ ID NO: 149788 - protein, 10 aa, Homo Sapiens
VRPEQPFIVL

SEQ ID NO: 149789 - protein, 10 aa, Homo Sapiens
YRPETGSWVF

SEQ ID NO: 149790 - protein, 11 aa, Homo Sapiens
ADINGLRQVLD

SEQ ID NO: 149791 - protein, 11 aa, Homo Sapiens
AEQRGELAIKD

SEQ ID NO: 149792 - protein, 11 aa, Homo Sapiens
ARPDEKAIMTY

SEQ ID NO: 149793 - protein, 11 aa, Homo Sapiens
ARYSGSYNDYL

SEQ ID NO: 149794 - protein, 11 aa, Homo Sapiens
EGNCPERIITL

SEQ ID NO: 149795 - protein, 11 aa, Homo Sapiens
IDNNIEQISSY

SEQ ID NO: 149796 - protein, 11 aa, Homo Sapiens
IGTAGASDVHV

SEQ ID NO: 149797 - protein, 11 aa, Homo Sapiens
ISERYGPVFTI

SEQ ID NO: 149798 - protein, 11 aa, Homo Sapiens
KKDVDNAYMIK

SEQ ID NO: 149799 - protein, 11 aa, Homo Sapiens
KRFVPSQHYVY

SEQ ID NO: 149800 - protein, 11 aa, Homo Sapiens
KRIEPADAHVL

SEQ ID NO: 149801 - protein, 11 aa, Homo Sapiens
KRKDEIEREVL

SEQ ID NO: 149802 - protein, 11 aa, Homo Sapiens
KRNDYVHALVA

SEQ ID NO: 149803 - protein, 11 aa, Homo Sapiens
KRYDREFLLGF

SEQ ID NO: 149804 - protein, 11 aa, Homo Sapiens
KYFDKASYRVY

SEQ ID NO: 149805 - protein, 11 aa, Homo Sapiens
KYLDEDTIYHL

SEQ ID NO: 149806 - protein, 11 aa, Homo Sapiens
LRGDPGLRGSL

SEQ ID NO: 149807 - protein, 11 aa, Homo Sapiens
QIKDFLNGPAD

SEQ ID NO: 149808 - protein, 11 aa, Homo Sapiens
RAFPNKQGYVL

SEQ ID NO: 149809 - protein, 11 aa, Homo Sapiens
RRFDPKLFLVF

SEQ ID NO: 149810 - protein, 11 aa, Homo Sapiens
RRFEEALQTIF

SEQ ID NO: 149811 - protein, 11 aa, Homo Sapiens
RRHPEYAVSVL

SEQ ID NO: 149812 - protein, 11 aa, Homo Sapiens
RRSETVVERML

SEQ ID NO: 149813 - protein, 11 aa, Homo Sapiens
RTSAEIAAIVF

SEQ ID NO: 149814 - protein, 11 aa, Homo Sapiens
SKAEAESLYQS

SEQ ID NO: 149815 - protein, 11 aa, Homo Sapiens
SRKESYSIYVY

SEQ ID NO: 149816 - protein, 11 aa, Homo Sapiens
SSRSSSVDYIL

SEQ ID NO: 149817 - protein, 11 aa, Homo Sapiens
SSTISSNVASK

SEQ ID NO: 149818 - protein, 11 aa, Homo Sapiens
SVPGKDAIYSL

SEQ ID NO: 149819 - protein, 11 aa, Homo Sapiens
TEELNREVATN

SEQ ID NO: 149820 - protein, 11 aa, Homo Sapiens
VAPGKDLTKTL

SEQ ID NO: 149821 - protein, 11 aa, Homo Sapiens
VIFHPTQPWVF

SEQ ID NO: 149822 - protein, 11 aa, Homo Sapiens
YGFRPDEPYYY

SEQ ID NO: 149823 - protein, 8 aa, Homo Sapiens
AAPTSSAL

SEQ ID NO: 149824 - protein, 8 aa, Homo Sapiens
AHPPLLVL

SEQ ID NO: 149825 - protein, 8 aa, Homo Sapiens
AKAPHYVL

SEQ ID NO: 149826 - protein, 8 aa, Homo Sapiens
AKGPNIVL

SEQ ID NO: 149827 - protein, 8 aa, Homo Sapiens
APSTAVSV

SEQ ID NO: 149828 - protein, 8 aa, Homo Sapiens
ARAPIIRV

SEQ ID NO: 149829 - protein, 8 aa, Homo Sapiens
ARAPRKVL

SEQ ID NO: 149830 - protein, 8 aa, Homo Sapiens
ARFTFDVY

SEQ ID NO: 149831 - protein, 8 aa, Homo Sapiens
ARPDVVEM

SEQ ID NO: 149832 - protein, 8 aa, Homo Sapiens
ARPEALYY

SEQ ID NO: 149833 - protein, 8 aa, Homo Sapiens
ARYVFSNF

SEQ ID NO: 149834 - protein, 8 aa, Homo Sapiens
CRPLPVTF

SEQ ID NO: 149835 - protein, 8 aa, Homo Sapiens
CYGIRPEL

SEQ ID NO: 149836 - protein, 8 aa, Homo Sapiens
CYHNLDAF

SEQ ID NO: 149837 - protein, 8 aa, Homo Sapiens
CYIVHEIY

SEQ ID NO: 149838 - protein, 8 aa, Homo Sapiens
CYNNQQVF

SEQ ID NO: 149839 - protein, 8 aa, Homo Sapiens
ERPPAYNL

SEQ ID NO: 149840 - protein, 8 aa, Homo Sapiens
ESLITCKA

SEQ ID NO: 149841 - protein, 8 aa, Homo Sapiens
FKLLSHSL

SEQ ID NO: 149842 - protein, 8 aa, Homo Sapiens
FKPPVLVF

SEQ ID NO: 149843 - protein, 8 aa, Homo Sapiens
FKQPFLEL

SEQ ID NO: 149844 - protein, 8 aa, Homo Sapiens
FRVNLRTL

SEQ ID NO: 149845 - protein, 8 aa, Homo Sapiens
FSPTGEIL

SEQ ID NO: 149846 - protein, 8 aa, Homo Sapiens
FSPVGSVL

SEQ ID NO: 149847 - protein, 8 aa, Homo Sapiens
FYAYHYRF

SEQ ID NO: 149848 - protein, 8 aa, Homo Sapiens
FYGRHAEL

SEQ ID NO: 149849 - protein, 8 aa, Homo Sapiens
FYHPAQEY

SEQ ID NO: 149850 - protein, 8 aa, Homo Sapiens
FYPPKVEL

SEQ ID NO: 149851 - protein, 8 aa, Homo Sapiens
FYQEHPDL

SEQ ID NO: 149852 - protein, 8 aa, Homo Sapiens
FYVEHPEV

SEQ ID NO: 149853 - protein, 8 aa, Homo Sapiens
FYVHHDIL

SEQ ID NO: 149854 - protein, 8 aa, Homo Sapiens
FYVVNSEL

SEQ ID NO: 149855 - protein, 8 aa, Homo Sapiens
GAEAKPAE

SEQ ID NO: 149856 - protein, 8 aa, Homo Sapiens
HRPPPIKL

SEQ ID NO: 149857 - protein, 8 aa, Homo Sapiens
HRRPPIGY

SEQ ID NO: 149858 - protein, 8 aa, Homo Sapiens
HRRPPLGL

SEQ ID NO: 149859 - protein, 8 aa, Homo Sapiens
HYFLHISL

SEQ ID NO: 149860 - protein, 8 aa, Homo Sapiens
IAPPERKY

SEQ ID NO: 149861 - protein, 8 aa, Homo Sapiens
IKPPIIHY

SEQ ID NO: 149862 - protein, 8 aa, Homo Sapiens
IRAPIMRM

SEQ ID NO: 149863 - protein, 8 aa, Homo Sapiens
IRFVHKEM

SEQ ID NO: 149864 - protein, 8 aa, Homo Sapiens
IRPPTRTA

SEQ ID NO: 149865 - protein, 8 aa, Homo Sapiens
IYATIPVY

SEQ ID NO: 149866 - protein, 8 aa, Homo Sapiens
KKATAYIL

SEQ ID NO: 149867 - protein, 8 aa, Homo Sapiens
KNGSPYGL

SEQ ID NO: 149868 - protein, 8 aa, Homo Sapiens
KRFSFRSF

SEQ ID NO: 149869 - protein, 8 aa, Homo Sapiens
KRPPLRGV

SEQ ID NO: 149870 - protein, 8 aa, Homo Sapiens
KRPPLRKW

SEQ ID NO: 149871 - protein, 8 aa, Homo Sapiens
KRPPVLRA

SEQ ID NO: 149872 - protein, 8 aa, Homo Sapiens
KRYLFRSF

SEQ ID NO: 149873 - protein, 8 aa, Homo Sapiens
KRYVFDTH

SEQ ID NO: 149874 - protein, 8 aa, Homo Sapiens
LKGPILCF

SEQ ID NO: 149875 - protein, 8 aa, Homo Sapiens
LYAFIGVK

SEQ ID NO: 149876 - protein, 8 aa, Homo Sapiens
LYGTITEF

SEQ ID NO: 149877 - protein, 8 aa, Homo Sapiens
MRPPIIIH

SEQ ID NO: 149878 - protein, 8 aa, Homo Sapiens
MRPVSRVL

SEQ ID NO: 149879 - protein, 8 aa, Homo Sapiens
NHPPGHVL

SEQ ID NO: 149880 - protein, 8 aa, Homo Sapiens
NKGPSYGL

SEQ ID NO: 149881 - protein, 8 aa, Homo Sapiens
NRFYHEEL

SEQ ID NO: 149882 - protein, 8 aa, Homo Sapiens
NRGVIITM

SEQ ID NO: 149883 - protein, 8 aa, Homo Sapiens
NRIPVISL

SEQ ID NO: 149884 - protein, 8 aa, Homo Sapiens
NRPGAYEL

SEQ ID NO: 149885 - protein, 8 aa, Homo Sapiens
NRPITVSY

SEQ ID NO: 149886 - protein, 8 aa, Homo Sapiens
NRVVFQEF

SEQ ID NO: 149887 - protein, 8 aa, Homo Sapiens
NRVVSNLL

SEQ ID NO: 149888 - protein, 8 aa, Homo Sapiens
NRVVTHEL

SEQ ID NO: 149889 - protein, 8 aa, Homo Sapiens
NYGPGPSL

SEQ ID NO: 149890 - protein, 8 aa, Homo Sapiens
NYGQYFTL

SEQ ID NO: 149891 - protein, 8 aa, Homo Sapiens
NYYVRAVL

SEQ ID NO: 149892 - protein, 8 aa, Homo Sapiens
QRWVFVCL

SEQ ID NO: 149893 - protein, 8 aa, Homo Sapiens
RRPKTLRL

SEQ ID NO: 149894 - protein, 8 aa, Homo Sapiens
RYHGLSSL

SEQ ID NO: 149895 - protein, 8 aa, Homo Sapiens
RYWFHYTL

SEQ ID NO: 149896 - protein, 8 aa, Homo Sapiens
SHAPSFNF

SEQ ID NO: 149897 - protein, 8 aa, Homo Sapiens
SKAPVLTY

SEQ ID NO: 149898 - protein, 8 aa, Homo Sapiens
SKGPVVQY

SEQ ID NO: 149899 - protein, 8 aa, Homo Sapiens
SKPPVISL

SEQ ID NO: 149900 - protein, 8 aa, Homo Sapiens
SRPELLEY

SEQ ID NO: 149901 - protein, 8 aa, Homo Sapiens
SRPISPLL

SEQ ID NO: 149902 - protein, 8 aa, Homo Sapiens
SRPNIFIL

SEQ ID NO: 149903 - protein, 8 aa, Homo Sapiens
SRPNSPQL

SEQ ID NO: 149904 - protein, 8 aa, Homo Sapiens
SRPPIQNA

SEQ ID NO: 149905 - protein, 8 aa, Homo Sapiens
SRPPLLGF

SEQ ID NO: 149906 - protein, 8 aa, Homo Sapiens
SRPPVTLR

SEQ ID NO: 149907 - protein, 8 aa, Homo Sapiens
SRPVIINM

SEQ ID NO: 149908 - protein, 8 aa, Homo Sapiens
SRTIVHTL

SEQ ID NO: 149909 - protein, 8 aa, Homo Sapiens
SYPPTKQL

SEQ ID NO: 149910 - protein, 8 aa, Homo Sapiens
SYWNHREL

SEQ ID NO: 149911 - protein, 8 aa, Homo Sapiens
TRGPVVRL

SEQ ID NO: 149912 - protein, 8 aa, Homo Sapiens
TRPPIRVT

SEQ ID NO: 149913 - protein, 8 aa, Homo Sapiens
TRPPKLVL

SEQ ID NO: 149914 - protein, 8 aa, Homo Sapiens
TRPPVRLV

SEQ ID NO: 149915 - protein, 8 aa, Homo Sapiens
TRTEIIIL

SEQ ID NO: 149916 - protein, 8 aa, Homo Sapiens
VHAPPMQL

SEQ ID NO: 149917 - protein, 8 aa, Homo Sapiens
VHAPYYKL

SEQ ID NO: 149918 - protein, 8 aa, Homo Sapiens
VHGPPVQL

SEQ ID NO: 149919 - protein, 8 aa, Homo Sapiens
VHPPHYFF

SEQ ID NO: 149920 - protein, 8 aa, Homo Sapiens
VKPPVRKL

SEQ ID NO: 149921 - protein, 8 aa, Homo Sapiens
VRGCILTL

SEQ ID NO: 149922 - protein, 8 aa, Homo Sapiens
VRHIFTAF

SEQ ID NO: 149923 - protein, 8 aa, Homo Sapiens
VRPGILVL

SEQ ID NO: 149924 - protein, 8 aa, Homo Sapiens
VRPKLPLL

SEQ ID NO: 149925 - protein, 8 aa, Homo Sapiens
VRPLVTEL

SEQ ID NO: 149926 - protein, 8 aa, Homo Sapiens
VRPPIRSH

SEQ ID NO: 149927 - protein, 8 aa, Homo Sapiens
VRPPKKVL

SEQ ID NO: 149928 - protein, 8 aa, Homo Sapiens
VRPPKQLL

SEQ ID NO: 149929 - protein, 8 aa, Homo Sapiens
VRPPKRDL

SEQ ID NO: 149930 - protein, 8 aa, Homo Sapiens
VRPPPYHP

SEQ ID NO: 149931 - protein, 8 aa, Homo Sapiens
VRPPVQVY

SEQ ID NO: 149932 - protein, 8 aa, Homo Sapiens
VRPVPLEL

SEQ ID NO: 149933 - protein, 8 aa, Homo Sapiens
VRPVTLNM

SEQ ID NO: 149934 - protein, 8 aa, Homo Sapiens
VYFVHPTF

SEQ ID NO: 149935 - protein, 8 aa, Homo Sapiens
VYPPIRHH

SEQ ID NO: 149936 - protein, 8 aa, Homo Sapiens
VYVLHPQY

SEQ ID NO: 149937 - protein, 8 aa, Homo Sapiens
YKGPGFEY

SEQ ID NO: 149938 - protein, 8 aa, Homo Sapiens
YKGPRIVL

SEQ ID NO: 149939 - protein, 8 aa, Homo Sapiens
YKPPGFSL

SEQ ID NO: 149940 - protein, 8 aa, Homo Sapiens
YKSPVILL

SEQ ID NO: 149941 - protein, 8 aa, Homo Sapiens
YKYVGMIL

SEQ ID NO: 149942 - protein, 8 aa, Homo Sapiens
YRAPEIML

SEQ ID NO: 149943 - protein, 8 aa, Homo Sapiens
YRGPANGF

SEQ ID NO: 149944 - protein, 8 aa, Homo Sapiens
YRGPCHTY

SEQ ID NO: 149945 - protein, 8 aa, Homo Sapiens
YRGPSHTY

SEQ ID NO: 149946 - protein, 8 aa, Homo Sapiens
YRPPELLL

SEQ ID NO: 149947 - protein, 8 aa, Homo Sapiens
YRRVFEEY

SEQ ID NO: 149948 - protein, 8 aa, Homo Sapiens
YYGNISHF

SEQ ID NO: 149949 - protein, 8 aa, Homo Sapiens
YYINHPLY

SEQ ID NO: 149950 - protein, 8 aa, Homo Sapiens
YYINSPEL

SEQ ID NO: 149951 - protein, 8 aa, Homo Sapiens
YYNSHDSL

SEQ ID NO: 149952 - protein, 8 aa, Homo Sapiens
YYNTITNF

SEQ ID NO: 149953 - protein, 8 aa, Homo Sapiens
YYTEFPTV

SEQ ID NO: 149954 - protein, 9 aa, Homo Sapiens
AANPHSFVF

SEQ ID NO: 149955 - protein, 9 aa, Homo Sapiens
AAPAYSRAL

SEQ ID NO: 149956 - protein, 9 aa, Homo Sapiens
AAPEGAGAL

SEQ ID NO: 149957 - protein, 9 aa, Homo Sapiens
AAPTAQKSL

SEQ ID NO: 149958 - protein, 9 aa, Homo Sapiens
AAPTSAAAL

SEQ ID NO: 149959 - protein, 9 aa, Homo Sapiens
AAPVPTTTL

SEQ ID NO: 149960 - protein, 9 aa, Homo Sapiens
AAQDRDQIY

SEQ ID NO: 149961 - protein, 9 aa, Homo Sapiens
AFKDVSFSL

SEQ ID NO: 149962 - protein, 9 aa, Homo Sapiens
AKADVPYIL

SEQ ID NO: 149963 - protein, 9 aa, Homo Sapiens
AKAGVYYVF

SEQ ID NO: 149964 - protein, 9 aa, Homo Sapiens
AKAPPTACY

SEQ ID NO: 149965 - protein, 9 aa, Homo Sapiens
AKFSLPVSL

SEQ ID NO: 149966 - protein, 9 aa, Homo Sapiens
AKNNVVINY

SEQ ID NO: 149967 - protein, 9 aa, Homo Sapiens
AKQDVVLNY

SEQ ID NO: 149968 - protein, 9 aa, Homo Sapiens
AKSDVTNQL

SEQ ID NO: 149969 - protein, 9 aa, Homo Sapiens
AQVTVVVAQ

SEQ ID NO: 149970 - protein, 9 aa, Homo Sapiens
ARADFQKVL

SEQ ID NO: 149971 - protein, 9 aa, Homo Sapiens
ARADSYYEY

SEQ ID NO: 149972 - protein, 9 aa, Homo Sapiens
ARAGVSQVL

SEQ ID NO: 149973 - protein, 9 aa, Homo Sapiens
ARAHSIQIM

SEQ ID NO: 149974 - protein, 9 aa, Homo Sapiens
ARAPGTRTL

SEQ ID NO: 149975 - protein, 9 aa, Homo Sapiens
ARAYEPQEL

SEQ ID NO: 149976 - protein, 9 aa, Homo Sapiens
ARCDFALFL

SEQ ID NO: 149977 - protein, 9 aa, Homo Sapiens
ARDDTHYLL

SEQ ID NO: 149978 - protein, 9 aa, Homo Sapiens
ARDPGARVL

SEQ ID NO: 149979 - protein, 9 aa, Homo Sapiens
ARFGSVNEL

SEQ ID NO: 149980 - protein, 9 aa, Homo Sapiens
ARFLFTTGF

SEQ ID NO: 149981 - protein, 9 aa, Homo Sapiens
ARGAFSEEY

SEQ ID NO: 149982 - protein, 9 aa, Homo Sapiens
ARGLLEEQY

SEQ ID NO: 149983 - protein, 9 aa, Homo Sapiens
ARHEHQVML

SEQ ID NO: 149984 - protein, 9 aa, Homo Sapiens
ARHFLHHYY

SEQ ID NO: 149985 - protein, 9 aa, Homo Sapiens
ARHVVAVVL

SEQ ID NO: 149986 - protein, 9 aa, Homo Sapiens
ARHVVKVEY

SEQ ID NO: 149987 - protein, 9 aa, Homo Sapiens
ARIPFYGSY

SEQ ID NO: 149988 - protein, 9 aa, Homo Sapiens
ARIPLNPVL

SEQ ID NO: 149989 - protein, 9 aa, Homo Sapiens
ARLDLPYEL

SEQ ID NO: 149990 - protein, 9 aa, Homo Sapiens
ARLTEGCSF

SEQ ID NO: 149991 - protein, 9 aa, Homo Sapiens
ARNDYLLTL

SEQ ID NO: 149992 - protein, 9 aa, Homo Sapiens
ARNERIYVY

SEQ ID NO: 149993 - protein, 9 aa, Homo Sapiens
ARNPSTVCL

SEQ ID NO: 149994 - protein, 9 aa, Homo Sapiens
ARNTVTQVL

SEQ ID NO: 149995 - protein, 9 aa, Homo Sapiens
ARPDATKVL

SEQ ID NO: 149996 - protein, 9 aa, Homo Sapiens
ARPDINLIL

SEQ ID NO: 149997 - protein, 9 aa, Homo Sapiens
ARPDNWFCY

SEQ ID NO: 149998 - protein, 9 aa, Homo Sapiens
ARPEEPIAF

SEQ ID NO: 149999 - protein, 9 aa, Homo Sapiens
ARPELLEVF

SEQ ID NO: 150000 - protein, 9 aa, Homo Sapiens
ARPEPATGY

SEQ ID NO: 150001 - protein, 9 aa, Homo Sapiens
ARPERPMAF

SEQ ID NO: 150002 - protein, 9 aa, Homo Sapiens
ARPGCIIAL

SEQ ID NO: 150003 - protein, 9 aa, Homo Sapiens
ARPGCIIEL

SEQ ID NO: 150004 - protein, 9 aa, Homo Sapiens
ARPLEGTSF

SEQ ID NO: 150005 - protein, 9 aa, Homo Sapiens
ARPLVQTIF

SEQ ID NO: 150006 - protein, 9 aa, Homo Sapiens
ARPPAAPEL

SEQ ID NO: 150007 - protein, 9 aa, Homo Sapiens
ARPPDPLCL

SEQ ID NO: 150008 - protein, 9 aa, Homo Sapiens
ARPPFVICV

SEQ ID NO: 150009 - protein, 9 aa, Homo Sapiens
ARPPPLPGL

SEQ ID NO: 150010 - protein, 9 aa, Homo Sapiens
ARPPSVDSL

SEQ ID NO: 150011 - protein, 9 aa, Homo Sapiens
ARPPVLAKL

SEQ ID NO: 150012 - protein, 9 aa, Homo Sapiens
ARPSPCYQL

SEQ ID NO: 150013 - protein, 9 aa, Homo Sapiens
ARPSVLWCY

SEQ ID NO: 150014 - protein, 9 aa, Homo Sapiens
ARPTAPFTL

SEQ ID NO: 150015 - protein, 9 aa, Homo Sapiens
ARPVLLQVY

SEQ ID NO: 150016 - protein, 9 aa, Homo Sapiens
ARRENILVM

SEQ ID NO: 150017 - protein, 9 aa, Homo Sapiens
ARSLKVFEL

SEQ ID NO: 150018 - protein, 9 aa, Homo Sapiens
ARSRFPQTF

SEQ ID NO: 150019 - protein, 9 aa, Homo Sapiens
ARTVFCMQL

SEQ ID NO: 150020 - protein, 9 aa, Homo Sapiens
ARVIFITEY

SEQ ID NO: 150021 - protein, 9 aa, Homo Sapiens
ARVPHSLDL

SEQ ID NO: 150022 - protein, 9 aa, Homo Sapiens
ARVPSSLAY

SEQ ID NO: 150023 - protein, 9 aa, Homo Sapiens
ARYPKKIHY

SEQ ID NO: 150024 - protein, 9 aa, Homo Sapiens
AYAGTGIQY

SEQ ID NO: 150025 - protein, 9 aa, Homo Sapiens
AYFPYFITY

SEQ ID NO: 150026 - protein, 9 aa, Homo Sapiens
AYHELAQVY

SEQ ID NO: 150027 - protein, 9 aa, Homo Sapiens
AYHGLTVPL

SEQ ID NO: 150028 - protein, 9 aa, Homo Sapiens
AYHTQTTPL

SEQ ID NO: 150029 - protein, 9 aa, Homo Sapiens
AYIPTPIYF

SEQ ID NO: 150030 - protein, 9 aa, Homo Sapiens
AYKDAIYVF

SEQ ID NO: 150031 - protein, 9 aa, Homo Sapiens
AYKDFLWFF

SEQ ID NO: 150032 - protein, 9 aa, Homo Sapiens
AYKEPCFVY

SEQ ID NO: 150033 - protein, 9 aa, Homo Sapiens
AYKEPPLAL

SEQ ID NO: 150034 - protein, 9 aa, Homo Sapiens
AYKNVKFVL

SEQ ID NO: 150035 - protein, 9 aa, Homo Sapiens
AYKPPGFSL

SEQ ID NO: 150036 - protein, 9 aa, Homo Sapiens
AYLEAHETF

SEQ ID NO: 150037 - protein, 9 aa, Homo Sapiens
AYLESFYKF

SEQ ID NO: 150038 - protein, 9 aa, Homo Sapiens
AYLPVNESF

SEQ ID NO: 150039 - protein, 9 aa, Homo Sapiens
AYPDKNFTL

SEQ ID NO: 150040 - protein, 9 aa, Homo Sapiens
AYPEIVAVY

SEQ ID NO: 150041 - protein, 9 aa, Homo Sapiens
AYPEVRIVL

SEQ ID NO: 150042 - protein, 9 aa, Homo Sapiens
AYPEYLITF

SEQ ID NO: 150043 - protein, 9 aa, Homo Sapiens
AYPEYLITY

SEQ ID NO: 150044 - protein, 9 aa, Homo Sapiens
AYPPPAPAY

SEQ ID NO: 150045 - protein, 9 aa, Homo Sapiens
AYPTYPVGF

SEQ ID NO: 150046 - protein, 9 aa, Homo Sapiens
AYQEAVRTL

SEQ ID NO: 150047 - protein, 9 aa, Homo Sapiens
AYQELLQHY

SEQ ID NO: 150048 - protein, 9 aa, Homo Sapiens
AYRDARVEL

SEQ ID NO: 150049 - protein, 9 aa, Homo Sapiens
AYRKLALKY

SEQ ID NO: 150050 - protein, 9 aa, Homo Sapiens
AYRLSVEIY

SEQ ID NO: 150051 - protein, 9 aa, Homo Sapiens
AYRQGHFTY

SEQ ID NO: 150052 - protein, 9 aa, Homo Sapiens
AYSDVAKRL

SEQ ID NO: 150053 - protein, 9 aa, Homo Sapiens
AYSEAIFEL

SEQ ID NO: 150054 - protein, 9 aa, Homo Sapiens
AYSSYVHQY

SEQ ID NO: 150055 - protein, 9 aa, Homo Sapiens
AYTPFHAVL

SEQ ID NO: 150056 - protein, 9 aa, Homo Sapiens
CRFQIVQVL

SEQ ID NO: 150057 - protein, 9 aa, Homo Sapiens
CRHANIVAY

SEQ ID NO: 150058 - protein, 9 aa, Homo Sapiens
CRQPQPFLL

SEQ ID NO: 150059 - protein, 9 aa, Homo Sapiens
CYGGTAAVF

SEQ ID NO: 150060 - protein, 9 aa, Homo Sapiens
CYILRPWAY

SEQ ID NO: 150061 - protein, 9 aa, Homo Sapiens
CYNPLLDSF

SEQ ID NO: 150062 - protein, 9 aa, Homo Sapiens
CYSPKPSVY

SEQ ID NO: 150063 - protein, 9 aa, Homo Sapiens
ERNPAVYNF

SEQ ID NO: 150064 - protein, 9 aa, Homo Sapiens
ERPPNPIEF

SEQ ID NO: 150065 - protein, 9 aa, Homo Sapiens
ERVPFILTY

SEQ ID NO: 150066 - protein, 9 aa, Homo Sapiens
EYPDLIHIY

SEQ ID NO: 150067 - protein, 9 aa, Homo Sapiens
FAPYERRAM

SEQ ID NO: 150068 - protein, 9 aa, Homo Sapiens
FFKELIQEF

SEQ ID NO: 150069 - protein, 9 aa, Homo Sapiens
FFMPGFAPL

SEQ ID NO: 150070 - protein, 9 aa, Homo Sapiens
FKAPITSEF

SEQ ID NO: 150071 - protein, 9 aa, Homo Sapiens
FKGQNPFEL

SEQ ID NO: 150072 - protein, 9 aa, Homo Sapiens
FKIHQPYTL

SEQ ID NO: 150073 - protein, 9 aa, Homo Sapiens
FKNPEPELL

SEQ ID NO: 150074 - protein, 9 aa, Homo Sapiens
FKNPIIEKY

SEQ ID NO: 150075 - protein, 9 aa, Homo Sapiens
FKPETYWVL

SEQ ID NO: 150076 - protein, 9 aa, Homo Sapiens
FKSNVTKTM

SEQ ID NO: 150077 - protein, 9 aa, Homo Sapiens
FKSPVKTIR

SEQ ID NO: 150078 - protein, 9 aa, Homo Sapiens
FRDAFTQEL

SEQ ID NO: 150079 - protein, 9 aa, Homo Sapiens
FRFENVNGY

SEQ ID NO: 150080 - protein, 9 aa, Homo Sapiens
FRFQPFESY

SEQ ID NO: 150081 - protein, 9 aa, Homo Sapiens
FRGDLCYLL

SEQ ID NO: 150082 - protein, 9 aa, Homo Sapiens
FRGNTPLHL

SEQ ID NO: 150083 - protein, 9 aa, Homo Sapiens
FRGPTVSNI

SEQ ID NO: 150084 - protein, 9 aa, Homo Sapiens
FRGPVVPAF

SEQ ID NO: 150085 - protein, 9 aa, Homo Sapiens
FRHEVGYVL

SEQ ID NO: 150086 - protein, 9 aa, Homo Sapiens
FRHEVMYSF

SEQ ID NO: 150087 - protein, 9 aa, Homo Sapiens
FRHLIEFTY

SEQ ID NO: 150088 - protein, 9 aa, Homo Sapiens
FRHNPYTAF

SEQ ID NO: 150089 - protein, 9 aa, Homo Sapiens
FRHPHIIKL

SEQ ID NO: 150090 - protein, 9 aa, Homo Sapiens
FRKSMVEHY

SEQ ID NO: 150091 - protein, 9 aa, Homo Sapiens
FRKSTVEHF

SEQ ID NO: 150092 - protein, 9 aa, Homo Sapiens
FRKVDVDEY

SEQ ID NO: 150093 - protein, 9 aa, Homo Sapiens
FRLDTPLYF

SEQ ID NO: 150094 - protein, 9 aa, Homo Sapiens
FRLEQGYEL

SEQ ID NO: 150095 - protein, 9 aa, Homo Sapiens
FRLLQETLY

SEQ ID NO: 150096 - protein, 9 aa, Homo Sapiens
FRLLQETMY

SEQ ID NO: 150097 - protein, 9 aa, Homo Sapiens
FRLPTAEVM

SEQ ID NO: 150098 - protein, 9 aa, Homo Sapiens
FRMPVLREY

SEQ ID NO: 150099 - protein, 9 aa, Homo Sapiens
FRNERAIRF

SEQ ID NO: 150100 - protein, 9 aa, Homo Sapiens
FRNFFSNMF

SEQ ID NO: 150101 - protein, 9 aa, Homo Sapiens
FRNIPGITL

SEQ ID NO: 150102 - protein, 9 aa, Homo Sapiens
FRNLHTIVL

SEQ ID NO: 150103 - protein, 9 aa, Homo Sapiens
FRNPKTSFY

SEQ ID NO: 150104 - protein, 9 aa, Homo Sapiens
FRPALPVSY

SEQ ID NO: 150105 - protein, 9 aa, Homo Sapiens
FRPDEPYYY

SEQ ID NO: 150106 - protein, 9 aa, Homo Sapiens
FRPECFSAF

SEQ ID NO: 150107 - protein, 9 aa, Homo Sapiens
FRPEHVSRL

SEQ ID NO: 150108 - protein, 9 aa, Homo Sapiens
FRPEWQSVY

SEQ ID NO: 150109 - protein, 9 aa, Homo Sapiens
FRPEWTQRY

SEQ ID NO: 150110 - protein, 9 aa, Homo Sapiens
FRPLDVSLY

SEQ ID NO: 150111 - protein, 9 aa, Homo Sapiens
FRPLYTHEY

SEQ ID NO: 150112 - protein, 9 aa, Homo Sapiens
FRPPGTSDL

SEQ ID NO: 150113 - protein, 9 aa, Homo Sapiens
FRPPITQEI

SEQ ID NO: 150114 - protein, 9 aa, Homo Sapiens
FRPPNPWTM

SEQ ID NO: 150115 - protein, 9 aa, Homo Sapiens
FRPPTRAEL

SEQ ID NO: 150116 - protein, 9 aa, Homo Sapiens
FRPQQTEIY

SEQ ID NO: 150117 - protein, 9 aa, Homo Sapiens
FRPQSGRVL

SEQ ID NO: 150118 - protein, 9 aa, Homo Sapiens
FRQDFHSEM

SEQ ID NO: 150119 - protein, 9 aa, Homo Sapiens
FRQEYLDTL

SEQ ID NO: 150120 - protein, 9 aa, Homo Sapiens
FRQIIAVVL

SEQ ID NO: 150121 - protein, 9 aa, Homo Sapiens
FRQLPARTL

SEQ ID NO: 150122 - protein, 9 aa, Homo Sapiens
FRQPVVDTF

SEQ ID NO: 150123 - protein, 9 aa, Homo Sapiens
FRQQRPLEF

SEQ ID NO: 150124 - protein, 9 aa, Homo Sapiens
FRRPVLQVL

SEQ ID NO: 150125 - protein, 9 aa, Homo Sapiens
FRSDISEEL

SEQ ID NO: 150126 - protein, 9 aa, Homo Sapiens
FRSDNSFSF

SEQ ID NO: 150127 - protein, 9 aa, Homo Sapiens
FRSDSSFNF

SEQ ID NO: 150128 - protein, 9 aa, Homo Sapiens
FRSEPALYF

SEQ ID NO: 150129 - protein, 9 aa, Homo Sapiens
FRSFVVSKF

SEQ ID NO: 150130 - protein, 9 aa, Homo Sapiens
FRSIRPLSY

SEQ ID NO: 150131 - protein, 9 aa, Homo Sapiens
FRSPLARQL

SEQ ID NO: 150132 - protein, 9 aa, Homo Sapiens
FRTDGHPVM

SEQ ID NO: 150133 - protein, 9 aa, Homo Sapiens
FRTEFNLMY

SEQ ID NO: 150134 - protein, 9 aa, Homo Sapiens
FRTPFPLAF

SEQ ID NO: 150135 - protein, 9 aa, Homo Sapiens
FRVDYILSV

SEQ ID NO: 150136 - protein, 9 aa, Homo Sapiens
FRVHLQYEF

SEQ ID NO: 150137 - protein, 9 aa, Homo Sapiens
FRVHTVMTL

SEQ ID NO: 150138 - protein, 9 aa, Homo Sapiens
FRVPFIYGH

SEQ ID NO: 150139 - protein, 9 aa, Homo Sapiens
FRVPTANVS

SEQ ID NO: 150140 - protein, 9 aa, Homo Sapiens
FRYTAGTPY

SEQ ID NO: 150141 - protein, 9 aa, Homo Sapiens
FSNPYSIEY

SEQ ID NO: 150142 - protein, 9 aa, Homo Sapiens
FYDDKKYTY

SEQ ID NO: 150143 - protein, 9 aa, Homo Sapiens
FYFALRDTL

SEQ ID NO: 150144 - protein, 9 aa, Homo Sapiens
FYGSHPWHW

SEQ ID NO: 150145 - protein, 9 aa, Homo Sapiens
FYHEAVVLF

SEQ ID NO: 150146 - protein, 9 aa, Homo Sapiens
FYHPETTQL

SEQ ID NO: 150147 - protein, 9 aa, Homo Sapiens
FYMDTSHLF

SEQ ID NO: 150148 - protein, 9 aa, Homo Sapiens
FYNERVVIM

SEQ ID NO: 150149 - protein, 9 aa, Homo Sapiens
FYNEYVREL

SEQ ID NO: 150150 - protein, 9 aa, Homo Sapiens
FYNLIHPEY

SEQ ID NO: 150151 - protein, 9 aa, Homo Sapiens
FYPLFVHMY

SEQ ID NO: 150152 - protein, 9 aa, Homo Sapiens
FYPPPRITL

SEQ ID NO: 150153 - protein, 9 aa, Homo Sapiens
FYQPKIQQF

SEQ ID NO: 150154 - protein, 9 aa, Homo Sapiens
FYQPTCIVL

SEQ ID NO: 150155 - protein, 9 aa, Homo Sapiens
FYQRFPLSF

SEQ ID NO: 150156 - protein, 9 aa, Homo Sapiens
FYRPHTITL

SEQ ID NO: 150157 - protein, 9 aa, Homo Sapiens
FYRPLAPEL

SEQ ID NO: 150158 - protein, 9 aa, Homo Sapiens
FYRVTTEQY

SEQ ID NO: 150159 - protein, 9 aa, Homo Sapiens
FYSEVHPHY

SEQ ID NO: 150160 - protein, 9 aa, Homo Sapiens
FYSGSPTSY

SEQ ID NO: 150161 - protein, 9 aa, Homo Sapiens
FYVDTVRAF

SEQ ID NO: 150162 - protein, 9 aa, Homo Sapiens
FYVPFAKAL

SEQ ID NO: 150163 - protein, 9 aa, Homo Sapiens
GAPVAAAAL

SEQ ID NO: 150164 - protein, 9 aa, Homo Sapiens
GRAKTPVTL

SEQ ID NO: 150165 - protein, 9 aa, Homo Sapiens
GRAPGGLSL

SEQ ID NO: 150166 - protein, 9 aa, Homo Sapiens
GRFEDVYQL

SEQ ID NO: 150167 - protein, 9 aa, Homo Sapiens
GRGPVLGPM

SEQ ID NO: 150168 - protein, 9 aa, Homo Sapiens
GRHGVFLEL

SEQ ID NO: 150169 - protein, 9 aa, Homo Sapiens
GRNPFVHEL

SEQ ID NO: 150170 - protein, 9 aa, Homo Sapiens
GRPCKIVEM

SEQ ID NO: 150171 - protein, 9 aa, Homo Sapiens
GRPETIFQL

SEQ ID NO: 150172 - protein, 9 aa, Homo Sapiens
GRPGPIGPA

SEQ ID NO: 150173 - protein, 9 aa, Homo Sapiens
GRPLFPHVL

SEQ ID NO: 150174 - protein, 9 aa, Homo Sapiens
GRQIKPYTL

SEQ ID NO: 150175 - protein, 9 aa, Homo Sapiens
GRSCIILEF

SEQ ID NO: 150176 - protein, 9 aa, Homo Sapiens
GRSEYVEKF

SEQ ID NO: 150177 - protein, 9 aa, Homo Sapiens
GRYQVSWSL

SEQ ID NO: 150178 - protein, 9 aa, Homo Sapiens
GSLRVLVLR

SEQ ID NO: 150179 - protein, 9 aa, Homo Sapiens
GYFLRAWNY

SEQ ID NO: 150180 - protein, 9 aa, Homo Sapiens
HAPFTATSL

SEQ ID NO: 150181 - protein, 9 aa, Homo Sapiens
HGPGPVGAL

SEQ ID NO: 150182 - protein, 9 aa, Homo Sapiens
HLPSGVKSL

SEQ ID NO: 150183 - protein, 9 aa, Homo Sapiens
HRAEVTEEF

SEQ ID NO: 150184 - protein, 9 aa, Homo Sapiens
HRAVFPIYL

SEQ ID NO: 150185 - protein, 9 aa, Homo Sapiens
HRFYMFHSF

SEQ ID NO: 150186 - protein, 9 aa, Homo Sapiens
HRFYMHHSF

SEQ ID NO: 150187 - protein, 9 aa, Homo Sapiens
HRGEVPCTV

SEQ ID NO: 150188 - protein, 9 aa, Homo Sapiens
HRGPDAFRF

SEQ ID NO: 150189 - protein, 9 aa, Homo Sapiens
HRHPDAFYL

SEQ ID NO: 150190 - protein, 9 aa, Homo Sapiens
HRKDYINAY

SEQ ID NO: 150191 - protein, 9 aa, Homo Sapiens
HRKPMFNIH

SEQ ID NO: 150192 - protein, 9 aa, Homo Sapiens
HRLPPVTSF

SEQ ID NO: 150193 - protein, 9 aa, Homo Sapiens
HRNEVTVEL

SEQ ID NO: 150194 - protein, 9 aa, Homo Sapiens
HRNFKPVVY

SEQ ID NO: 150195 - protein, 9 aa, Homo Sapiens
HRNGGLITL

SEQ ID NO: 150196 - protein, 9 aa, Homo Sapiens
HRNLIEIGY

SEQ ID NO: 150197 - protein, 9 aa, Homo Sapiens
HRNPLPEYL

SEQ ID NO: 150198 - protein, 9 aa, Homo Sapiens
HRPEATPSM

SEQ ID NO: 150199 - protein, 9 aa, Homo Sapiens
HRPEFSSCL

SEQ ID NO: 150200 - protein, 9 aa, Homo Sapiens
HRPGIVVDY

SEQ ID NO: 150201 - protein, 9 aa, Homo Sapiens
HRPSHFLNF

SEQ ID NO: 150202 - protein, 9 aa, Homo Sapiens
HRQGFSYDY

SEQ ID NO: 150203 - protein, 9 aa, Homo Sapiens
HRSWWVYTL

SEQ ID NO: 150204 - protein, 9 aa, Homo Sapiens
HRTDLNPIL

SEQ ID NO: 150205 - protein, 9 aa, Homo Sapiens
HRVAQAWEL

SEQ ID NO: 150206 - protein, 9 aa, Homo Sapiens
HRWEVCLTM

SEQ ID NO: 150207 - protein, 9 aa, Homo Sapiens
HRYENVSIL

SEQ ID NO: 150208 - protein, 9 aa, Homo Sapiens
HRYEVVTEL

SEQ ID NO: 150209 - protein, 9 aa, Homo Sapiens
HRYPAVHVY

SEQ ID NO: 150210 - protein, 9 aa, Homo Sapiens
HYGQSGISM

SEQ ID NO: 150211 - protein, 9 aa, Homo Sapiens
HYKPTPLYF

SEQ ID NO: 150212 - protein, 9 aa, Homo Sapiens
HYLPVKIIL

SEQ ID NO: 150213 - protein, 9 aa, Homo Sapiens
HYPDFHQEL

SEQ ID NO: 150214 - protein, 9 aa, Homo Sapiens
HYPDYSWSA

SEQ ID NO: 150215 - protein, 9 aa, Homo Sapiens
HYPPVQVLF

SEQ ID NO: 150216 - protein, 9 aa, Homo Sapiens
HYRPPEVIL

SEQ ID NO: 150217 - protein, 9 aa, Homo Sapiens
HYSPIYLSF

SEQ ID NO: 150218 - protein, 9 aa, Homo Sapiens
HYVEKPSTF

SEQ ID NO: 150219 - protein, 9 aa, Homo Sapiens
HYYSITINY

SEQ ID NO: 150220 - protein, 9 aa, Homo Sapiens
IAPETRRSI

SEQ ID NO: 150221 - protein, 9 aa, Homo Sapiens
IAPGVTHEL

SEQ ID NO: 150222 - protein, 9 aa, Homo Sapiens
IHPVVITSF

SEQ ID NO: 150223 - protein, 9 aa, Homo Sapiens
IHSPVVNEL

SEQ ID NO: 150224 - protein, 9 aa, Homo Sapiens
IKADHVSTY

SEQ ID NO: 150225 - protein, 9 aa, Homo Sapiens
IKPETILYY

SEQ ID NO: 150226 - protein, 9 aa, Homo Sapiens
IKSDVHLNF

SEQ ID NO: 150227 - protein, 9 aa, Homo Sapiens
ILTERGYSF

SEQ ID NO: 150228 - protein, 9 aa, Homo Sapiens
IPPLVCNPE

SEQ ID NO: 150229 - protein, 9 aa, Homo Sapiens
IRGPTQHEL

SEQ ID NO: 150230 - protein, 9 aa, Homo Sapiens
IRKPYIWEY

SEQ ID NO: 150231 - protein, 9 aa, Homo Sapiens
IRMTYIKEL

SEQ ID NO: 150232 - protein, 9 aa, Homo Sapiens
IRNDYYLNL

SEQ ID NO: 150233 - protein, 9 aa, Homo Sapiens
IRPDNMSEY

SEQ ID NO: 150234 - protein, 9 aa, Homo Sapiens
IRPEHVLRL

SEQ ID NO: 150235 - protein, 9 aa, Homo Sapiens
IRPEIHENY

SEQ ID NO: 150236 - protein, 9 aa, Homo Sapiens
IRPENVIIY

SEQ ID NO: 150237 - protein, 9 aa, Homo Sapiens
IRPEYAWIV

SEQ ID NO: 150238 - protein, 9 aa, Homo Sapiens
IRPGTAFEL

SEQ ID NO: 150239 - protein, 9 aa, Homo Sapiens
IRPQVVTTF

SEQ ID NO: 150240 - protein, 9 aa, Homo Sapiens
IRQDNERVL

SEQ ID NO: 150241 - protein, 9 aa, Homo Sapiens
IRSSYIRVL

SEQ ID NO: 150242 - protein, 9 aa, Homo Sapiens
IRTDFNILY

SEQ ID NO: 150243 - protein, 9 aa, Homo Sapiens
IRVDKITEY

SEQ ID NO: 150244 - protein, 9 aa, Homo Sapiens
IVPGNVKSL

SEQ ID NO: 150245 - protein, 9 aa, Homo Sapiens
IYAPKLQEF

SEQ ID NO: 150246 - protein, 9 aa, Homo Sapiens
IYATRLIQM

SEQ ID NO: 150247 - protein, 9 aa, Homo Sapiens
IYAVNGIAF

SEQ ID NO: 150248 - protein, 9 aa, Homo Sapiens
IYGEKTYAF

SEQ ID NO: 150249 - protein, 9 aa, Homo Sapiens
IYKDLPFET

SEQ ID NO: 150250 - protein, 9 aa, Homo Sapiens
IYKELLISL

SEQ ID NO: 150251 - protein, 9 aa, Homo Sapiens
IYPDSFTVL

SEQ ID NO: 150252 - protein, 9 aa, Homo Sapiens
IYPEVVHMF

SEQ ID NO: 150253 - protein, 9 aa, Homo Sapiens
IYPGHGMMF

SEQ ID NO: 150254 - protein, 9 aa, Homo Sapiens
IYPVNAISF

SEQ ID NO: 150255 - protein, 9 aa, Homo Sapiens
IYPYVIQEL

SEQ ID NO: 150256 - protein, 9 aa, Homo Sapiens
IYQELVTKY

SEQ ID NO: 150257 - protein, 9 aa, Homo Sapiens
IYYFKANVF

SEQ ID NO: 150258 - protein, 9 aa, Homo Sapiens
KAFARPWSL

SEQ ID NO: 150259 - protein, 9 aa, Homo Sapiens
KAPGSTSNL

SEQ ID NO: 150260 - protein, 9 aa, Homo Sapiens
KAPVTKVAA

SEQ ID NO: 150261 - protein, 9 aa, Homo Sapiens
KKADCTITM

SEQ ID NO: 150262 - protein, 9 aa, Homo Sapiens
KKIPGIYVL

SEQ ID NO: 150263 - protein, 9 aa, Homo Sapiens
KKNPFHLEL

SEQ ID NO: 150264 - protein, 9 aa, Homo Sapiens
KKSDPVVSY

SEQ ID NO: 150265 - protein, 9 aa, Homo Sapiens
KKTEVVITL

SEQ ID NO: 150266 - protein, 9 aa, Homo Sapiens
KRADLQSTF

SEQ ID NO: 150267 - protein, 9 aa, Homo Sapiens
KRCDIILVM

SEQ ID NO: 150268 - protein, 9 aa, Homo Sapiens
KRFGKAYNL

SEQ ID NO: 150269 - protein, 9 aa, Homo Sapiens
KRFSGTVRL

SEQ ID NO: 150270 - protein, 9 aa, Homo Sapiens
KRGDVIYIL

SEQ ID NO: 150271 - protein, 9 aa, Homo Sapiens
KRHCFDVNY

SEQ ID NO: 150272 - protein, 9 aa, Homo Sapiens
KRIDIIHNL

SEQ ID NO: 150273 - protein, 9 aa, Homo Sapiens
KRINWRTVL

SEQ ID NO: 150274 - protein, 9 aa, Homo Sapiens
KRLDVEFVL

SEQ ID NO: 150275 - protein, 9 aa, Homo Sapiens
KRNDYVHAL

SEQ ID NO: 150276 - protein, 9 aa, Homo Sapiens
KRPAGPLVL

SEQ ID NO: 150277 - protein, 9 aa, Homo Sapiens
KRPDTTESL

SEQ ID NO: 150278 - protein, 9 aa, Homo Sapiens
KRPVFIFEW

SEQ ID NO: 150279 - protein, 9 aa, Homo Sapiens
KRPVGGFLL

SEQ ID NO: 150280 - protein, 9 aa, Homo Sapiens
KRQEAIFEL

SEQ ID NO: 150281 - protein, 9 aa, Homo Sapiens
KRQEVIYEL

SEQ ID NO: 150282 - protein, 9 aa, Homo Sapiens
KRVEDAYIL

SEQ ID NO: 150283 - protein, 9 aa, Homo Sapiens
KRVFPKWTY

SEQ ID NO: 150284 - protein, 9 aa, Homo Sapiens
KRVTWIVEF

SEQ ID NO: 150285 - protein, 9 aa, Homo Sapiens
KRYIFADAY

SEQ ID NO: 150286 - protein, 9 aa, Homo Sapiens
KRYKSIVKY

SEQ ID NO: 150287 - protein, 9 aa, Homo Sapiens
KYAGSALQY

SEQ ID NO: 150288 - protein, 9 aa, Homo Sapiens
KYFAKHPRL

SEQ ID NO: 150289 - protein, 9 aa, Homo Sapiens
KYFDEHYEY

SEQ ID NO: 150290 - protein, 9 aa, Homo Sapiens
KYFEKQFEL

SEQ ID NO: 150291 - protein, 9 aa, Homo Sapiens
KYFGGVLEY

SEQ ID NO: 150292 - protein, 9 aa, Homo Sapiens
KYFLQQWEL

SEQ ID NO: 150293 - protein, 9 aa, Homo Sapiens
KYFLRGYRY

SEQ ID NO: 150294 - protein, 9 aa, Homo Sapiens
KYGNQLVRL

SEQ ID NO: 150295 - protein, 9 aa, Homo Sapiens
KYHGFGNVH

SEQ ID NO: 150296 - protein, 9 aa, Homo Sapiens
KYIGYARQY

SEQ ID NO: 150297 - protein, 9 aa, Homo Sapiens
KYKDAIHFY

SEQ ID NO: 150298 - protein, 9 aa, Homo Sapiens
KYKDIYTEL

SEQ ID NO: 150299 - protein, 9 aa, Homo Sapiens
KYKDNPFSL

SEQ ID NO: 150300 - protein, 9 aa, Homo Sapiens
KYKERGTVL

SEQ ID NO: 150301 - protein, 9 aa, Homo Sapiens
KYMDVQFDF

SEQ ID NO: 150302 - protein, 9 aa, Homo Sapiens
KYNACILEY

SEQ ID NO: 150303 - protein, 9 aa, Homo Sapiens
KYPDVIQEL

SEQ ID NO: 150304 - protein, 9 aa, Homo Sapiens
KYPEGIRKY

SEQ ID NO: 150305 - protein, 9 aa, Homo Sapiens
KYPENFFLL

SEQ ID NO: 150306 - protein, 9 aa, Homo Sapiens
KYPHYFPVM

SEQ ID NO: 150307 - protein, 9 aa, Homo Sapiens
KYPPVNRKY

SEQ ID NO: 150308 - protein, 9 aa, Homo Sapiens
KYPSPFFVF

SEQ ID NO: 150309 - protein, 9 aa, Homo Sapiens
KYPSYIHKM

SEQ ID NO: 150310 - protein, 9 aa, Homo Sapiens
KYQDVYVEL

SEQ ID NO: 150311 - protein, 9 aa, Homo Sapiens
KYREMYEEF

SEQ ID NO: 150312 - protein, 9 aa, Homo Sapiens
KYRPVCIHL

SEQ ID NO: 150313 - protein, 9 aa, Homo Sapiens
LKSDIYLEY

SEQ ID NO: 150314 - protein, 9 aa, Homo Sapiens
LKSPFAYCM

SEQ ID NO: 150315 - protein, 9 aa, Homo Sapiens
LRADLAEEY

SEQ ID NO: 150316 - protein, 9 aa, Homo Sapiens
LRDHSVRVL

SEQ ID NO: 150317 - protein, 9 aa, Homo Sapiens
LRHDRPYTL

SEQ ID NO: 150318 - protein, 9 aa, Homo Sapiens
LRHPVCVEL

SEQ ID NO: 150319 - protein, 9 aa, Homo Sapiens
LRNHMAVAF

SEQ ID NO: 150320 - protein, 9 aa, Homo Sapiens
LRNKVIIEY

SEQ ID NO: 150321 - protein, 9 aa, Homo Sapiens
LRNQSVFNF

SEQ ID NO: 150322 - protein, 9 aa, Homo Sapiens
LRPAVGYEL

SEQ ID NO: 150323 - protein, 9 aa, Homo Sapiens
LRPGIHHSL

SEQ ID NO: 150324 - protein, 9 aa, Homo Sapiens
LRPPERQAL

SEQ ID NO: 150325 - protein, 9 aa, Homo Sapiens
LRPPIMIMM

SEQ ID NO: 150326 - protein, 9 aa, Homo Sapiens
LRPPYQISM

SEQ ID NO: 150327 - protein, 9 aa, Homo Sapiens
LRPSTSRSL

SEQ ID NO: 150328 - protein, 9 aa, Homo Sapiens
LRSDSYVEL

SEQ ID NO: 150329 - protein, 9 aa, Homo Sapiens
LRSGVIVRL

SEQ ID NO: 150330 - protein, 9 aa, Homo Sapiens
LSPTPATAL

SEQ ID NO: 150331 - protein, 9 aa, Homo Sapiens
LYHEHIIKY

SEQ ID NO: 150332 - protein, 9 aa, Homo Sapiens
LYHYYIMEL

SEQ ID NO: 150333 - protein, 9 aa, Homo Sapiens
LYPGIPVIF

SEQ ID NO: 150334 - protein, 9 aa, Homo Sapiens
LYPSIIQEF

SEQ ID NO: 150335 - protein, 9 aa, Homo Sapiens
LYQDTHQEY

SEQ ID NO: 150336 - protein, 9 aa, Homo Sapiens
LYRNCVYTY

SEQ ID NO: 150337 - protein, 9 aa, Homo Sapiens
LYRPGSVAY

SEQ ID NO: 150338 - protein, 9 aa, Homo Sapiens
LYSPQYISY

SEQ ID NO: 150339 - protein, 9 aa, Homo Sapiens
LYWSHPRKF

SEQ ID NO: 150340 - protein, 9 aa, Homo Sapiens
MAPLKMLAL

SEQ ID NO: 150341 - protein, 9 aa, Homo Sapiens
MKPLVVFVL

SEQ ID NO: 150342 - protein, 9 aa, Homo Sapiens
MRKEFTLEF

SEQ ID NO: 150343 - protein, 9 aa, Homo Sapiens
MRMATPLLM

SEQ ID NO: 150344 - protein, 9 aa, Homo Sapiens
MRNAVCIFY

SEQ ID NO: 150345 - protein, 9 aa, Homo Sapiens
MRPDLELQF

SEQ ID NO: 150346 - protein, 9 aa, Homo Sapiens
MRPLDIVEL

SEQ ID NO: 150347 - protein, 9 aa, Homo Sapiens
MRPNNLVHF

SEQ ID NO: 150348 - protein, 9 aa, Homo Sapiens
MRSLLRTPF

SEQ ID NO: 150349 - protein, 9 aa, Homo Sapiens
MYHGAAFQL

SEQ ID NO: 150350 - protein, 9 aa, Homo Sapiens
MYPAFAEEY

SEQ ID NO: 150351 - protein, 9 aa, Homo Sapiens
MYRDYPLEL

SEQ ID NO: 150352 - protein, 9 aa, Homo Sapiens
MYRSYVEML

SEQ ID NO: 150353 - protein, 9 aa, Homo Sapiens
NKAAVVLCM

SEQ ID NO: 150354 - protein, 9 aa, Homo Sapiens
NKADVILKY

SEQ ID NO: 150355 - protein, 9 aa, Homo Sapiens
NKKGEIFEL

SEQ ID NO: 150356 - protein, 9 aa, Homo Sapiens
NKNPNIVNY

SEQ ID NO: 150357 - protein, 9 aa, Homo Sapiens
NKTDVVLIL

SEQ ID NO: 150358 - protein, 9 aa, Homo Sapiens
NRAFVSMVY

SEQ ID NO: 150359 - protein, 9 aa, Homo Sapiens
NRFNYPFEL

SEQ ID NO: 150360 - protein, 9 aa, Homo Sapiens
NRFPWPKVL

SEQ ID NO: 150361 - protein, 9 aa, Homo Sapiens
NRGDFFMTL

SEQ ID NO: 150362 - protein, 9 aa, Homo Sapiens
NRGEVVTSF

SEQ ID NO: 150363 - protein, 9 aa, Homo Sapiens
NRGQFFTVY

SEQ ID NO: 150364 - protein, 9 aa, Homo Sapiens
NRHAVVMEL

SEQ ID NO: 150365 - protein, 9 aa, Homo Sapiens
NRHGLIRKY

SEQ ID NO: 150366 - protein, 9 aa, Homo Sapiens
NRIHYNIFY

SEQ ID NO: 150367 - protein, 9 aa, Homo Sapiens
NRKEFVNLY

SEQ ID NO: 150368 - protein, 9 aa, Homo Sapiens
NRLFHKTVY

SEQ ID NO: 150369 - protein, 9 aa, Homo Sapiens
NRLGYTHLY

SEQ ID NO: 150370 - protein, 9 aa, Homo Sapiens
NRLLEATSY

SEQ ID NO: 150371 - protein, 9 aa, Homo Sapiens
NRLLLPHAF

SEQ ID NO: 150372 - protein, 9 aa, Homo Sapiens
NRLPLVVSF

SEQ ID NO: 150373 - protein, 9 aa, Homo Sapiens
NRLSFFFDF

SEQ ID NO: 150374 - protein, 9 aa, Homo Sapiens
NRMTVEYVY

SEQ ID NO: 150375 - protein, 9 aa, Homo Sapiens
NRNLVSPAY

SEQ ID NO: 150376 - protein, 9 aa, Homo Sapiens
NRNSIPLQL

SEQ ID NO: 150377 - protein, 9 aa, Homo Sapiens
NRPADVYSY

SEQ ID NO: 150378 - protein, 9 aa, Homo Sapiens
NRPEFITEF

SEQ ID NO: 150379 - protein, 9 aa, Homo Sapiens
NRPGLSYHY

SEQ ID NO: 150380 - protein, 9 aa, Homo Sapiens
NRPGTVSSL

SEQ ID NO: 150381 - protein, 9 aa, Homo Sapiens
NRPKALNAL

SEQ ID NO: 150382 - protein, 9 aa, Homo Sapiens
NRPNDVYAY

SEQ ID NO: 150383 - protein, 9 aa, Homo Sapiens
NRPNLYYEV

SEQ ID NO: 150384 - protein, 9 aa, Homo Sapiens
NRPPFGQGY

SEQ ID NO: 150385 - protein, 9 aa, Homo Sapiens
NRPPSSTEL

SEQ ID NO: 150386 - protein, 9 aa, Homo Sapiens
NRPRNIMVY

SEQ ID NO: 150387 - protein, 9 aa, Homo Sapiens
NRPTNSIVF

SEQ ID NO: 150388 - protein, 9 aa, Homo Sapiens
NRPVEVYQY

SEQ ID NO: 150389 - protein, 9 aa, Homo Sapiens
NRPVHAYKF

SEQ ID NO: 150390 - protein, 9 aa, Homo Sapiens
NRRPSVYLP

SEQ ID NO: 150391 - protein, 9 aa, Homo Sapiens
NRSNFPVVL

SEQ ID NO: 150392 - protein, 9 aa, Homo Sapiens
NRTDTEYVL

SEQ ID NO: 150393 - protein, 9 aa, Homo Sapiens
NRTETVTSF

SEQ ID NO: 150394 - protein, 9 aa, Homo Sapiens
NRTIVITSH

SEQ ID NO: 150395 - protein, 9 aa, Homo Sapiens
NRVLHYWTM

SEQ ID NO: 150396 - protein, 9 aa, Homo Sapiens
NRYSHDFNF

SEQ ID NO: 150397 - protein, 9 aa, Homo Sapiens
NRYYSHVDY

SEQ ID NO: 150398 - protein, 9 aa, Homo Sapiens
NSPLPGSEL

SEQ ID NO: 150399 - protein, 9 aa, Homo Sapiens
NTPSGTNAL

SEQ ID NO: 150400 - protein, 9 aa, Homo Sapiens
NVPVRDIPA

SEQ ID NO: 150401 - protein, 9 aa, Homo Sapiens
NYFGAQPHY

SEQ ID NO: 150402 - protein, 9 aa, Homo Sapiens
NYFHLAVAF

SEQ ID NO: 150403 - protein, 9 aa, Homo Sapiens
NYFLRLCSF

SEQ ID NO: 150404 - protein, 9 aa, Homo Sapiens
NYGVLLHEL

SEQ ID NO: 150405 - protein, 9 aa, Homo Sapiens
NYHAQHYHL

SEQ ID NO: 150406 - protein, 9 aa, Homo Sapiens
NYIEFTRIL

SEQ ID NO: 150407 - protein, 9 aa, Homo Sapiens
NYLPFIMEL

SEQ ID NO: 150408 - protein, 9 aa, Homo Sapiens
NYNEKIYEL

SEQ ID NO: 150409 - protein, 9 aa, Homo Sapiens
NYPAFMMEM

SEQ ID NO: 150410 - protein, 9 aa, Homo Sapiens
NYPGFLTIL

SEQ ID NO: 150411 - protein, 9 aa, Homo Sapiens
NYPGLSISL

SEQ ID NO: 150412 - protein, 9 aa, Homo Sapiens
NYRHVANTL

SEQ ID NO: 150413 - protein, 9 aa, Homo Sapiens
NYRPDHCIY

SEQ ID NO: 150414 - protein, 9 aa, Homo Sapiens
NYSQQLQVY

SEQ ID NO: 150415 - protein, 9 aa, Homo Sapiens
NYYGKYIAL

SEQ ID NO: 150416 - protein, 9 aa, Homo Sapiens
PIRLLAAAA

SEQ ID NO: 150417 - protein, 9 aa, Homo Sapiens
PSIVHRKCF

SEQ ID NO: 150418 - protein, 9 aa, Homo Sapiens
QIPEIKQTL

SEQ ID NO: 150419 - protein, 9 aa, Homo Sapiens
QRAPGGLSY

SEQ ID NO: 150420 - protein, 9 aa, Homo Sapiens
QRNEVVVEL

SEQ ID NO: 150421 - protein, 9 aa, Homo Sapiens
QRPETAATL

SEQ ID NO: 150422 - protein, 9 aa, Homo Sapiens
QRPFFPILY

SEQ ID NO: 150423 - protein, 9 aa, Homo Sapiens
QRPPTRETF

SEQ ID NO: 150424 - protein, 9 aa, Homo Sapiens
QRPRESYQM

SEQ ID NO: 150425 - protein, 9 aa, Homo Sapiens
QRPTIYYVM

SEQ ID NO: 150426 - protein, 9 aa, Homo Sapiens
QRQDIAFAY

SEQ ID NO: 150427 - protein, 9 aa, Homo Sapiens
QRQEVCQSY

SEQ ID NO: 150428 - protein, 9 aa, Homo Sapiens
QRRPAGISY

SEQ ID NO: 150429 - protein, 9 aa, Homo Sapiens
QRVDYIMQL

SEQ ID NO: 150430 - protein, 9 aa, Homo Sapiens
QRVSCAHIY

SEQ ID NO: 150431 - protein, 9 aa, Homo Sapiens
QYFARMCSL

SEQ ID NO: 150432 - protein, 9 aa, Homo Sapiens
QYNPLPIEY

SEQ ID NO: 150433 - protein, 9 aa, Homo Sapiens
QYNTYPIKL

SEQ ID NO: 150434 - protein, 9 aa, Homo Sapiens
QYPGRSLVF

SEQ ID NO: 150435 - protein, 9 aa, Homo Sapiens
RAGLPAPTI

SEQ ID NO: 150436 - protein, 9 aa, Homo Sapiens
RKNPFVYKV

SEQ ID NO: 150437 - protein, 9 aa, Homo Sapiens
RRAEVELEY

SEQ ID NO: 150438 - protein, 9 aa, Homo Sapiens
RRDYVFIEF

SEQ ID NO: 150439 - protein, 9 aa, Homo Sapiens
RRFDTAFFL

SEQ ID NO: 150440 - protein, 9 aa, Homo Sapiens
RRFFPYYVY

SEQ ID NO: 150441 - protein, 9 aa, Homo Sapiens
RRFMQTFVL

SEQ ID NO: 150442 - protein, 9 aa, Homo Sapiens
RRFTEIYEF

SEQ ID NO: 150443 - protein, 9 aa, Homo Sapiens
RRGDFIHVM

SEQ ID NO: 150444 - protein, 9 aa, Homo Sapiens
RRGEYVLTF

SEQ ID NO: 150445 - protein, 9 aa, Homo Sapiens
RRIDFVLVY

SEQ ID NO: 150446 - protein, 9 aa, Homo Sapiens
RRIEIAHSL

SEQ ID NO: 150447 - protein, 9 aa, Homo Sapiens
RRKDGVFLY

SEQ ID NO: 150448 - protein, 9 aa, Homo Sapiens
RRMENLVAY

SEQ ID NO: 150449 - protein, 9 aa, Homo Sapiens
RRMEVYNEF

SEQ ID NO: 150450 - protein, 9 aa, Homo Sapiens
RRNDKIIVF

SEQ ID NO: 150451 - protein, 9 aa, Homo Sapiens
RRNPEPLRF

SEQ ID NO: 150452 - protein, 9 aa, Homo Sapiens
RRNPGVVIY

SEQ ID NO: 150453 - protein, 9 aa, Homo Sapiens
RRNPYCRTL

SEQ ID NO: 150454 - protein, 9 aa, Homo Sapiens
RRPPILEDY

SEQ ID NO: 150455 - protein, 9 aa, Homo Sapiens
RRQEAIYEM

SEQ ID NO: 150456 - protein, 9 aa, Homo Sapiens
RRQNVAYEY

SEQ ID NO: 150457 - protein, 9 aa, Homo Sapiens
RRTDCAYVV

SEQ ID NO: 150458 - protein, 9 aa, Homo Sapiens
RRWEQALTF

SEQ ID NO: 150459 - protein, 9 aa, Homo Sapiens
RYHPQALIY

SEQ ID NO: 150460 - protein, 9 aa, Homo Sapiens
RYKDLRTAY

SEQ ID NO: 150461 - protein, 9 aa, Homo Sapiens
RYLTVAAVF

SEQ ID NO: 150462 - protein, 9 aa, Homo Sapiens
RYNDITKVY

SEQ ID NO: 150463 - protein, 9 aa, Homo Sapiens
RYNGLSFVY

SEQ ID NO: 150464 - protein, 9 aa, Homo Sapiens
RYPAEIRKY

SEQ ID NO: 150465 - protein, 9 aa, Homo Sapiens
RYPDLELKY

SEQ ID NO: 150466 - protein, 9 aa, Homo Sapiens
RYPNIELSY

SEQ ID NO: 150467 - protein, 9 aa, Homo Sapiens
RYREAIIKY

SEQ ID NO: 150468 - protein, 9 aa, Homo Sapiens
RYRPGTVAL

SEQ ID NO: 150469 - protein, 9 aa, Homo Sapiens
RYSEAVFYY

SEQ ID NO: 150470 - protein, 9 aa, Homo Sapiens
SAPDKSLEL

SEQ ID NO: 150471 - protein, 9 aa, Homo Sapiens
SAPGIISAL

SEQ ID NO: 150472 - protein, 9 aa, Homo Sapiens
SAPSSSTPF

SEQ ID NO: 150473 - protein, 9 aa, Homo Sapiens
SAPVPASPL

SEQ ID NO: 150474 - protein, 9 aa, Homo Sapiens
SFYFFFSSF

SEQ ID NO: 150475 - protein, 9 aa, Homo Sapiens
SGPGPAAAL

SEQ ID NO: 150476 - protein, 9 aa, Homo Sapiens
SGPVPGTAI

SEQ ID NO: 150477 - protein, 9 aa, Homo Sapiens
SIPTKALEL

SEQ ID NO: 150478 - protein, 9 aa, Homo Sapiens
SKADALFEL

SEQ ID NO: 150479 - protein, 9 aa, Homo Sapiens
SKIDYFLEY

SEQ ID NO: 150480 - protein, 9 aa, Homo Sapiens
SKNPHIVSF

SEQ ID NO: 150481 - protein, 9 aa, Homo Sapiens
SKSPFIVHL

SEQ ID NO: 150482 - protein, 9 aa, Homo Sapiens
SNPGGRPAL

SEQ ID NO: 150483 - protein, 9 aa, Homo Sapiens
SRADTILCL

SEQ ID NO: 150484 - protein, 9 aa, Homo Sapiens
SRAIFEEVY

SEQ ID NO: 150485 - protein, 9 aa, Homo Sapiens
SRAMLLTSY

SEQ ID NO: 150486 - protein, 9 aa, Homo Sapiens
SRAPSTYTY

SEQ ID NO: 150487 - protein, 9 aa, Homo Sapiens
SRFAKVHIL

SEQ ID NO: 150488 - protein, 9 aa, Homo Sapiens
SRFEKEFSF

SEQ ID NO: 150489 - protein, 9 aa, Homo Sapiens
SRFGNAFHL

SEQ ID NO: 150490 - protein, 9 aa, Homo Sapiens
SRFIFNYVY

SEQ ID NO: 150491 - protein, 9 aa, Homo Sapiens
SRFIKFQEM

SEQ ID NO: 150492 - protein, 9 aa, Homo Sapiens
SRFLNKQPY

SEQ ID NO: 150493 - protein, 9 aa, Homo Sapiens
SRFNRYYSL

SEQ ID NO: 150494 - protein, 9 aa, Homo Sapiens
SRFPEALRL

SEQ ID NO: 150495 - protein, 9 aa, Homo Sapiens
SRFSNVYHL

SEQ ID NO: 150496 - protein, 9 aa, Homo Sapiens
SRFTYPYLL

SEQ ID NO: 150497 - protein, 9 aa, Homo Sapiens
SRGDFVVEY

SEQ ID NO: 150498 - protein, 9 aa, Homo Sapiens
SRGDVKVIM

SEQ ID NO: 150499 - protein, 9 aa, Homo Sapiens
SRGEQAWTL

SEQ ID NO: 150500 - protein, 9 aa, Homo Sapiens
SRHLDSYEF

SEQ ID NO: 150501 - protein, 9 aa, Homo Sapiens
SRHSIPSEM

SEQ ID NO: 150502 - protein, 9 aa, Homo Sapiens
SRIHPVSTM

SEQ ID NO: 150503 - protein, 9 aa, Homo Sapiens
SRIQYEMEY

SEQ ID NO: 150504 - protein, 9 aa, Homo Sapiens
SRKELPEYY

SEQ ID NO: 150505 - protein, 9 aa, Homo Sapiens
SRKGPAPEL

SEQ ID NO: 150506 - protein, 9 aa, Homo Sapiens
SRKSFVFEL

SEQ ID NO: 150507 - protein, 9 aa, Homo Sapiens
SRLFQPVQY

SEQ ID NO: 150508 - protein, 9 aa, Homo Sapiens
SRNAITSSY

SEQ ID NO: 150509 - protein, 9 aa, Homo Sapiens
SRNAYMLVY

SEQ ID NO: 150510 - protein, 9 aa, Homo Sapiens
SRNEGVATY

SEQ ID NO: 150511 - protein, 9 aa, Homo Sapiens
SRNEIIQSY

SEQ ID NO: 150512 - protein, 9 aa, Homo Sapiens
SRNKDTYFL

SEQ ID NO: 150513 - protein, 9 aa, Homo Sapiens
SRPALPFIL

SEQ ID NO: 150514 - protein, 9 aa, Homo Sapiens
SRPDGSASF

SEQ ID NO: 150515 - protein, 9 aa, Homo Sapiens
SRPDTECKF

SEQ ID NO: 150516 - protein, 9 aa, Homo Sapiens
SRPEANEAL

SEQ ID NO: 150517 - protein, 9 aa, Homo Sapiens
SRPEAPNEF

SEQ ID NO: 150518 - protein, 9 aa, Homo Sapiens
SRPENAIIY

SEQ ID NO: 150519 - protein, 9 aa, Homo Sapiens
SRPESFAIY

SEQ ID NO: 150520 - protein, 9 aa, Homo Sapiens
SRPGVCLVV

SEQ ID NO: 150521 - protein, 9 aa, Homo Sapiens
SRPHFLIEL

SEQ ID NO: 150522 - protein, 9 aa, Homo Sapiens
SRPKLSFSL

SEQ ID NO: 150523 - protein, 9 aa, Homo Sapiens
SRPLHISTF

SEQ ID NO: 150524 - protein, 9 aa, Homo Sapiens
SRPLSAVVL

SEQ ID NO: 150525 - protein, 9 aa, Homo Sapiens
SRPNIILVM

SEQ ID NO: 150526 - protein, 9 aa, Homo Sapiens
SRPPAQTSL

SEQ ID NO: 150527 - protein, 9 aa, Homo Sapiens
SRPPCQPQF

SEQ ID NO: 150528 - protein, 9 aa, Homo Sapiens
SRPPGQGEF

SEQ ID NO: 150529 - protein, 9 aa, Homo Sapiens
SRPPVTLRL

SEQ ID NO: 150530 - protein, 9 aa, Homo Sapiens
SRPSTYYEL

SEQ ID NO: 150531 - protein, 9 aa, Homo Sapiens
SRPYAFLEF

SEQ ID NO: 150532 - protein, 9 aa, Homo Sapiens
SRQVGERTL

SEQ ID NO: 150533 - protein, 9 aa, Homo Sapiens
SRSHSVFQL

SEQ ID NO: 150534 - protein, 9 aa, Homo Sapiens
SRSHYSPIY

SEQ ID NO: 150535 - protein, 9 aa, Homo Sapiens
SRSLLESTY

SEQ ID NO: 150536 - protein, 9 aa, Homo Sapiens
SRSLLQTTF

SEQ ID NO: 150537 - protein, 9 aa, Homo Sapiens
SRSPVYSHF

SEQ ID NO: 150538 - protein, 9 aa, Homo Sapiens
SRSVMTEEY

SEQ ID NO: 150539 - protein, 9 aa, Homo Sapiens
SRSWLSYSY

SEQ ID NO: 150540 - protein, 9 aa, Homo Sapiens
SRTPYHVNL

SEQ ID NO: 150541 - protein, 9 aa, Homo Sapiens
SRVEAVYVL

SEQ ID NO: 150542 - protein, 9 aa, Homo Sapiens
SRVETPVSY

SEQ ID NO: 150543 - protein, 9 aa, Homo Sapiens
SRVHAALVY

SEQ ID NO: 150544 - protein, 9 aa, Homo Sapiens
SRVLQNVAF

SEQ ID NO: 150545 - protein, 9 aa, Homo Sapiens
SRVNVAICL

SEQ ID NO: 150546 - protein, 9 aa, Homo Sapiens
SRVVTVSEY

SEQ ID NO: 150547 - protein, 9 aa, Homo Sapiens
SRYDPSISF

SEQ ID NO: 150548 - protein, 9 aa, Homo Sapiens
SRYEVPCVL

SEQ ID NO: 150549 - protein, 9 aa, Homo Sapiens
SRYVLDDEY

SEQ ID NO: 150550 - protein, 9 aa, Homo Sapiens
SSPAPRTAL

SEQ ID NO: 150551 - protein, 9 aa, Homo Sapiens
SSPQAGSSL

SEQ ID NO: 150552 - protein, 9 aa, Homo Sapiens
SVPAFASSL

SEQ ID NO: 150553 - protein, 9 aa, Homo Sapiens
SYFGSFSSL

SEQ ID NO: 150554 - protein, 9 aa, Homo Sapiens
SYHSYVIGF

SEQ ID NO: 150555 - protein, 9 aa, Homo Sapiens
SYIGLGHIY

SEQ ID NO: 150556 - protein, 9 aa, Homo Sapiens
SYKDSTLIM

SEQ ID NO: 150557 - protein, 9 aa, Homo Sapiens
SYKGHVDIL

SEQ ID NO: 150558 - protein, 9 aa, Homo Sapiens
SYLENPTSY

SEQ ID NO: 150559 - protein, 9 aa, Homo Sapiens
SYLEYQKVM

SEQ ID NO: 150560 - protein, 9 aa, Homo Sapiens
SYNDYVREF

SEQ ID NO: 150561 - protein, 9 aa, Homo Sapiens
SYNPVTHIY

SEQ ID NO: 150562 - protein, 9 aa, Homo Sapiens
SYPDFLHKM

SEQ ID NO: 150563 - protein, 9 aa, Homo Sapiens
SYPDFLRMM

SEQ ID NO: 150564 - protein, 9 aa, Homo Sapiens
SYPDIHFDM

SEQ ID NO: 150565 - protein, 9 aa, Homo Sapiens
SYPGGQLVF

SEQ ID NO: 150566 - protein, 9 aa, Homo Sapiens
SYPGSSYIF

SEQ ID NO: 150567 - protein, 9 aa, Homo Sapiens
SYPNVFLVF

SEQ ID NO: 150568 - protein, 9 aa, Homo Sapiens
SYPTTTISY

SEQ ID NO: 150569 - protein, 9 aa, Homo Sapiens
SYPYFVIQY

SEQ ID NO: 150570 - protein, 9 aa, Homo Sapiens
SYQDAAFTY

SEQ ID NO: 150571 - protein, 9 aa, Homo Sapiens
SYRDAISMY

SEQ ID NO: 150572 - protein, 9 aa, Homo Sapiens
SYRDSYDSY

SEQ ID NO: 150573 - protein, 9 aa, Homo Sapiens
SYRDSYESY

SEQ ID NO: 150574 - protein, 9 aa, Homo Sapiens
SYREAVFKM

SEQ ID NO: 150575 - protein, 9 aa, Homo Sapiens
TAPQGNVDL

SEQ ID NO: 150576 - protein, 9 aa, Homo Sapiens
TFRDVAIEF

SEQ ID NO: 150577 - protein, 9 aa, Homo Sapiens
TFRDVVIEF

SEQ ID NO: 150578 - protein, 9 aa, Homo Sapiens
TKIDVSYEY

SEQ ID NO: 150579 - protein, 9 aa, Homo Sapiens
TKQNSVLLL

SEQ ID NO: 150580 - protein, 9 aa, Homo Sapiens
TRAQWFYEY

SEQ ID NO: 150581 - protein, 9 aa, Homo Sapiens
TRIGYHISL

SEQ ID NO: 150582 - protein, 9 aa, Homo Sapiens
TRLYPVFFL

SEQ ID NO: 150583 - protein, 9 aa, Homo Sapiens
TRMRHVISY

SEQ ID NO: 150584 - protein, 9 aa, Homo Sapiens
TRNDYVMMY

SEQ ID NO: 150585 - protein, 9 aa, Homo Sapiens
TRNNFAVGY

SEQ ID NO: 150586 - protein, 9 aa, Homo Sapiens
TRNPLVAVY

SEQ ID NO: 150587 - protein, 9 aa, Homo Sapiens
TRNPVSEEL

SEQ ID NO: 150588 - protein, 9 aa, Homo Sapiens
TRPAAQPSF

SEQ ID NO: 150589 - protein, 9 aa, Homo Sapiens
TRPDMIRIL

SEQ ID NO: 150590 - protein, 9 aa, Homo Sapiens
TRPEKALIL

SEQ ID NO: 150591 - protein, 9 aa, Homo Sapiens
TRPPALLLL

SEQ ID NO: 150592 - protein, 9 aa, Homo Sapiens
TRPPEPRHI

SEQ ID NO: 150593 - protein, 9 aa, Homo Sapiens
TRPQQLVCF

SEQ ID NO: 150594 - protein, 9 aa, Homo Sapiens
TRSAIILHL

SEQ ID NO: 150595 - protein, 9 aa, Homo Sapiens
TRSFYKHIL

SEQ ID NO: 150596 - protein, 9 aa, Homo Sapiens
TRSPHIETY

SEQ ID NO: 150597 - protein, 9 aa, Homo Sapiens
TRTIYQFHY

SEQ ID NO: 150598 - protein, 9 aa, Homo Sapiens
TRTPVAKEL

SEQ ID NO: 150599 - protein, 9 aa, Homo Sapiens
TRVDTILEF

SEQ ID NO: 150600 - protein, 9 aa, Homo Sapiens
TRVKAVRIL

SEQ ID NO: 150601 - protein, 9 aa, Homo Sapiens
TRYDLYHTF

SEQ ID NO: 150602 - protein, 9 aa, Homo Sapiens
TRYQGVNLY

SEQ ID NO: 150603 - protein, 9 aa, Homo Sapiens
TSPEAFLAL

SEQ ID NO: 150604 - protein, 9 aa, Homo Sapiens
TVMDKTRAL

SEQ ID NO: 150605 - protein, 9 aa, Homo Sapiens
TYGDAGLTY

SEQ ID NO: 150606 - protein, 9 aa, Homo Sapiens
TYGERVVAF

SEQ ID NO: 150607 - protein, 9 aa, Homo Sapiens
TYKDPITEF

SEQ ID NO: 150608 - protein, 9 aa, Homo Sapiens
TYKDYVDLF

SEQ ID NO: 150609 - protein, 9 aa, Homo Sapiens
TYPEVVRMV

SEQ ID NO: 150610 - protein, 9 aa, Homo Sapiens
TYQVLAVTF

SEQ ID NO: 150611 - protein, 9 aa, Homo Sapiens
TYRAIAETY

SEQ ID NO: 150612 - protein, 9 aa, Homo Sapiens
TYRLFAVVY

SEQ ID NO: 150613 - protein, 9 aa, Homo Sapiens
TYSEFAREL

SEQ ID NO: 150614 - protein, 9 aa, Homo Sapiens
TYYGSFVTR

SEQ ID NO: 150615 - protein, 9 aa, Homo Sapiens
VAPGKRPAL

SEQ ID NO: 150616 - protein, 9 aa, Homo Sapiens
VAPPGCSHL

SEQ ID NO: 150617 - protein, 9 aa, Homo Sapiens
VAPPVSGDL

SEQ ID NO: 150618 - protein, 9 aa, Homo Sapiens
VAPTSGPAL

SEQ ID NO: 150619 - protein, 9 aa, Homo Sapiens
VAPVAQVAL

SEQ ID NO: 150620 - protein, 9 aa, Homo Sapiens
VFRDLVIKY

SEQ ID NO: 150621 - protein, 9 aa, Homo Sapiens
VHADVYRVL

SEQ ID NO: 150622 - protein, 9 aa, Homo Sapiens
VHAFPELFL

SEQ ID NO: 150623 - protein, 9 aa, Homo Sapiens
VHPPPTTTY

SEQ ID NO: 150624 - protein, 9 aa, Homo Sapiens
VHVDVHSHY

SEQ ID NO: 150625 - protein, 9 aa, Homo Sapiens
VKSDVEINY

SEQ ID NO: 150626 - protein, 9 aa, Homo Sapiens
VKSDYVVKY

SEQ ID NO: 150627 - protein, 9 aa, Homo Sapiens
VKTDTVLIL

SEQ ID NO: 150628 - protein, 9 aa, Homo Sapiens
VRADCHYRY

SEQ ID NO: 150629 - protein, 9 aa, Homo Sapiens
VRAEVQHQL

SEQ ID NO: 150630 - protein, 9 aa, Homo Sapiens
VRANLPQSF

SEQ ID NO: 150631 - protein, 9 aa, Homo Sapiens
VRANVPEEL

SEQ ID NO: 150632 - protein, 9 aa, Homo Sapiens
VRAWVVFKL

SEQ ID NO: 150633 - protein, 9 aa, Homo Sapiens
VRDHWVHVL

SEQ ID NO: 150634 - protein, 9 aa, Homo Sapiens
VRENVPRVL

SEQ ID NO: 150635 - protein, 9 aa, Homo Sapiens
VRFDQVTVY

SEQ ID NO: 150636 - protein, 9 aa, Homo Sapiens
VRKKFVTEL

SEQ ID NO: 150637 - protein, 9 aa, Homo Sapiens
VRKSIARVL

SEQ ID NO: 150638 - protein, 9 aa, Homo Sapiens
VRNAVTQEF

SEQ ID NO: 150639 - protein, 9 aa, Homo Sapiens
VRNDIYITL

SEQ ID NO: 150640 - protein, 9 aa, Homo Sapiens
VRNEHFWTL

SEQ ID NO: 150641 - protein, 9 aa, Homo Sapiens
VRNNVIIVM

SEQ ID NO: 150642 - protein, 9 aa, Homo Sapiens
VRNPEAEEM

SEQ ID NO: 150643 - protein, 9 aa, Homo Sapiens
VRNYEQWQL

SEQ ID NO: 150644 - protein, 9 aa, Homo Sapiens
VRPAEPAFL

SEQ ID NO: 150645 - protein, 9 aa, Homo Sapiens
VRPDDAIEL

SEQ ID NO: 150646 - protein, 9 aa, Homo Sapiens
VRPDNTYEV

SEQ ID NO: 150647 - protein, 9 aa, Homo Sapiens
VRPDTVRNL

SEQ ID NO: 150648 - protein, 9 aa, Homo Sapiens
VRPHIDISF

SEQ ID NO: 150649 - protein, 9 aa, Homo Sapiens
VRPLATLSY

SEQ ID NO: 150650 - protein, 9 aa, Homo Sapiens
VRPLLSASY

SEQ ID NO: 150651 - protein, 9 aa, Homo Sapiens
VRPLRLFVY

SEQ ID NO: 150652 - protein, 9 aa, Homo Sapiens
VRPPPGPEL

SEQ ID NO: 150653 - protein, 9 aa, Homo Sapiens
VRPPQIKSL

SEQ ID NO: 150654 - protein, 9 aa, Homo Sapiens
VRPPQQVVY

SEQ ID NO: 150655 - protein, 9 aa, Homo Sapiens
VRPPTPREL

SEQ ID NO: 150656 - protein, 9 aa, Homo Sapiens
VRPSYWLVL

SEQ ID NO: 150657 - protein, 9 aa, Homo Sapiens
VRPTYCLEY

SEQ ID NO: 150658 - protein, 9 aa, Homo Sapiens
VRPYCFIEF

SEQ ID NO: 150659 - protein, 9 aa, Homo Sapiens
VRQDVINTL

SEQ ID NO: 150660 - protein, 9 aa, Homo Sapiens
VRSGYYKVL

SEQ ID NO: 150661 - protein, 9 aa, Homo Sapiens
VRSPHPYQL

SEQ ID NO: 150662 - protein, 9 aa, Homo Sapiens
VRSPVVHSV

SEQ ID NO: 150663 - protein, 9 aa, Homo Sapiens
VRTPYTMSY

SEQ ID NO: 150664 - protein, 9 aa, Homo Sapiens
VRVDRDYVL

SEQ ID NO: 150665 - protein, 9 aa, Homo Sapiens
VRVEPLVTM

SEQ ID NO: 150666 - protein, 9 aa, Homo Sapiens
VRVPVTSNL

SEQ ID NO: 150667 - protein, 9 aa, Homo Sapiens
VRVPYFIDL

SEQ ID NO: 150668 - protein, 9 aa, Homo Sapiens
VSPDAKTSL

SEQ ID NO: 150669 - protein, 9 aa, Homo Sapiens
VSPLATSAL

SEQ ID NO: 150670 - protein, 9 aa, Homo Sapiens
VYCPVQWEY

SEQ ID NO: 150671 - protein, 9 aa, Homo Sapiens
VYFGHWVVM

SEQ ID NO: 150672 - protein, 9 aa, Homo Sapiens
VYGPLPQSF

SEQ ID NO: 150673 - protein, 9 aa, Homo Sapiens
VYGTRLVVL

SEQ ID NO: 150674 - protein, 9 aa, Homo Sapiens
VYGVVPISL

SEQ ID NO: 150675 - protein, 9 aa, Homo Sapiens
VYHEILIGY

SEQ ID NO: 150676 - protein, 9 aa, Homo Sapiens
VYKAFVDNY

SEQ ID NO: 150677 - protein, 9 aa, Homo Sapiens
VYKDLVLLL

SEQ ID NO: 150678 - protein, 9 aa, Homo Sapiens
VYKKSIFVF

SEQ ID NO: 150679 - protein, 9 aa, Homo Sapiens
VYNENLVHM

SEQ ID NO: 150680 - protein, 9 aa, Homo Sapiens
VYNIYIRRY

SEQ ID NO: 150681 - protein, 9 aa, Homo Sapiens
VYPERSTSY

SEQ ID NO: 150682 - protein, 9 aa, Homo Sapiens
VYPEYVIQY

SEQ ID NO: 150683 - protein, 9 aa, Homo Sapiens
VYPGIAVFF

SEQ ID NO: 150684 - protein, 9 aa, Homo Sapiens
VYPGYYLTF

SEQ ID NO: 150685 - protein, 9 aa, Homo Sapiens
VYPLYTIVF

SEQ ID NO: 150686 - protein, 9 aa, Homo Sapiens
VYPPIRHHL

SEQ ID NO: 150687 - protein, 9 aa, Homo Sapiens
VYPPLKGSF

SEQ ID NO: 150688 - protein, 9 aa, Homo Sapiens
VYPPPHQVF

SEQ ID NO: 150689 - protein, 9 aa, Homo Sapiens
VYPQPPFSY

SEQ ID NO: 150690 - protein, 9 aa, Homo Sapiens
VYPQYVIEY

SEQ ID NO: 150691 - protein, 9 aa, Homo Sapiens
VYPTAVHVL

SEQ ID NO: 150692 - protein, 9 aa, Homo Sapiens
VYPWTQRFF

SEQ ID NO: 150693 - protein, 9 aa, Homo Sapiens
VYQEMPAQL

SEQ ID NO: 150694 - protein, 9 aa, Homo Sapiens
VYRTPTEAL

SEQ ID NO: 150695 - protein, 9 aa, Homo Sapiens
VYRTVIEYY

SEQ ID NO: 150696 - protein, 9 aa, Homo Sapiens
VYVQHPITF

SEQ ID NO: 150697 - protein, 9 aa, Homo Sapiens
WRPPPLNPY

SEQ ID NO: 150698 - protein, 9 aa, Homo Sapiens
YAGLSMEGG

SEQ ID NO: 150699 - protein, 9 aa, Homo Sapiens
YHIGIPLTY

SEQ ID NO: 150700 - protein, 9 aa, Homo Sapiens
YHSPYPEEY

SEQ ID NO: 150701 - protein, 9 aa, Homo Sapiens
YKAPTDYCF

SEQ ID NO: 150702 - protein, 9 aa, Homo Sapiens
YKFDFPVSY

SEQ ID NO: 150703 - protein, 9 aa, Homo Sapiens
YKGQYILTL

SEQ ID NO: 150704 - protein, 9 aa, Homo Sapiens
YKIAFPYLY

SEQ ID NO: 150705 - protein, 9 aa, Homo Sapiens
YKIPYTTVL

SEQ ID NO: 150706 - protein, 9 aa, Homo Sapiens
YKLDNQFEL

SEQ ID NO: 150707 - protein, 9 aa, Homo Sapiens
YKNPDQVYL

SEQ ID NO: 150708 - protein, 9 aa, Homo Sapiens
YKNPSEYHY

SEQ ID NO: 150709 - protein, 9 aa, Homo Sapiens
YKPDVKIEY

SEQ ID NO: 150710 - protein, 9 aa, Homo Sapiens
YKQPMFYHL

SEQ ID NO: 150711 - protein, 9 aa, Homo Sapiens
YKQVLEPSF

SEQ ID NO: 150712 - protein, 9 aa, Homo Sapiens
YKVEYPIMY

SEQ ID NO: 150713 - protein, 9 aa, Homo Sapiens
YKVPHPLEH

SEQ ID NO: 150714 - protein, 9 aa, Homo Sapiens
YKVPQVRVL

SEQ ID NO: 150715 - protein, 9 aa, Homo Sapiens
YLPYRDYNY

SEQ ID NO: 150716 - protein, 9 aa, Homo Sapiens
YRAQPSASL

SEQ ID NO: 150717 - protein, 9 aa, Homo Sapiens
YRDPHVDQY

SEQ ID NO: 150718 - protein, 9 aa, Homo Sapiens
YREILVKEL

SEQ ID NO: 150719 - protein, 9 aa, Homo Sapiens
YRFDPRSGP

SEQ ID NO: 150720 - protein, 9 aa, Homo Sapiens
YRFETVQKL

SEQ ID NO: 150721 - protein, 9 aa, Homo Sapiens
YRGQPGNAY

SEQ ID NO: 150722 - protein, 9 aa, Homo Sapiens
YRHDAVKIL

SEQ ID NO: 150723 - protein, 9 aa, Homo Sapiens
YRHGKAYRF

SEQ ID NO: 150724 - protein, 9 aa, Homo Sapiens
YRHLCAVYY

SEQ ID NO: 150725 - protein, 9 aa, Homo Sapiens
YRHLVGVCY

SEQ ID NO: 150726 - protein, 9 aa, Homo Sapiens
YRHPDPREL

SEQ ID NO: 150727 - protein, 9 aa, Homo Sapiens
YRIESYWTY

SEQ ID NO: 150728 - protein, 9 aa, Homo Sapiens
YRKPKWNHL

SEQ ID NO: 150729 - protein, 9 aa, Homo Sapiens
YRKPTYESY

SEQ ID NO: 150730 - protein, 9 aa, Homo Sapiens
YRKTLIHCY

SEQ ID NO: 150731 - protein, 9 aa, Homo Sapiens
YRLEYMRVL

SEQ ID NO: 150732 - protein, 9 aa, Homo Sapiens
YRLHHVVVY

SEQ ID NO: 150733 - protein, 9 aa, Homo Sapiens
YRNAYTMVL

SEQ ID NO: 150734 - protein, 9 aa, Homo Sapiens
YRNEFTAWY

SEQ ID NO: 150735 - protein, 9 aa, Homo Sapiens
YRNKFTQKY

SEQ ID NO: 150736 - protein, 9 aa, Homo Sapiens
YRNPCYVSY

SEQ ID NO: 150737 - protein, 9 aa, Homo Sapiens
YRNPKEWTK

SEQ ID NO: 150738 - protein, 9 aa, Homo Sapiens
YRNPVSQCM

SEQ ID NO: 150739 - protein, 9 aa, Homo Sapiens
YRNVHAVVF

SEQ ID NO: 150740 - protein, 9 aa, Homo Sapiens
YRPAYLVTL

SEQ ID NO: 150741 - protein, 9 aa, Homo Sapiens
YRPDMPCFL

SEQ ID NO: 150742 - protein, 9 aa, Homo Sapiens
YRPGHYDIL

SEQ ID NO: 150743 - protein, 9 aa, Homo Sapiens
YRPGPWMKY

SEQ ID NO: 150744 - protein, 9 aa, Homo Sapiens
YRPHTITLL

SEQ ID NO: 150745 - protein, 9 aa, Homo Sapiens
YRPISASVL

SEQ ID NO: 150746 - protein, 9 aa, Homo Sapiens
YRPLQSTEF

SEQ ID NO: 150747 - protein, 9 aa, Homo Sapiens
YRPLTVLTF

SEQ ID NO: 150748 - protein, 9 aa, Homo Sapiens
YRPLYPFSL

SEQ ID NO: 150749 - protein, 9 aa, Homo Sapiens
YRPNETFHL

SEQ ID NO: 150750 - protein, 9 aa, Homo Sapiens
YRPPGARLT

SEQ ID NO: 150751 - protein, 9 aa, Homo Sapiens
YRPVLPLML

SEQ ID NO: 150752 - protein, 9 aa, Homo Sapiens
YRPVRQYVY

SEQ ID NO: 150753 - protein, 9 aa, Homo Sapiens
YRQKQVVIL

SEQ ID NO: 150754 - protein, 9 aa, Homo Sapiens
YRQPPVPQY

SEQ ID NO: 150755 - protein, 9 aa, Homo Sapiens
YRREIFIAF

SEQ ID NO: 150756 - protein, 9 aa, Homo Sapiens
YRRPVLLLH

SEQ ID NO: 150757 - protein, 9 aa, Homo Sapiens
YRTDLCLLY

SEQ ID NO: 150758 - protein, 9 aa, Homo Sapiens
YRTDMIQAL

SEQ ID NO: 150759 - protein, 9 aa, Homo Sapiens
YRTPTTHTM

SEQ ID NO: 150760 - protein, 9 aa, Homo Sapiens
YRTQSSASL

SEQ ID NO: 150761 - protein, 9 aa, Homo Sapiens
YRTTTVIFY

SEQ ID NO: 150762 - protein, 9 aa, Homo Sapiens
YRVGYCNQL

SEQ ID NO: 150763 - protein, 9 aa, Homo Sapiens
YRVHSIFVL

SEQ ID NO: 150764 - protein, 9 aa, Homo Sapiens
YRVNGQYIM

SEQ ID NO: 150765 - protein, 9 aa, Homo Sapiens
YRVPGQFML

SEQ ID NO: 150766 - protein, 9 aa, Homo Sapiens
YRVPNMRFL

SEQ ID NO: 150767 - protein, 9 aa, Homo Sapiens
YRVVFPLEL

SEQ ID NO: 150768 - protein, 9 aa, Homo Sapiens
YRVYQPVRY

SEQ ID NO: 150769 - protein, 9 aa, Homo Sapiens
YYFFTPYVY

SEQ ID NO: 150770 - protein, 9 aa, Homo Sapiens
YYFSKLIEF

SEQ ID NO: 150771 - protein, 9 aa, Homo Sapiens
YYFVFDHAL

SEQ ID NO: 150772 - protein, 9 aa, Homo Sapiens
YYGEHLFML

SEQ ID NO: 150773 - protein, 9 aa, Homo Sapiens
YYGNRAATL

SEQ ID NO: 150774 - protein, 9 aa, Homo Sapiens
YYHARVYEF

SEQ ID NO: 150775 - protein, 9 aa, Homo Sapiens
YYHVYKLTL

SEQ ID NO: 150776 - protein, 9 aa, Homo Sapiens
YYIDCIRQV

SEQ ID NO: 150777 - protein, 9 aa, Homo Sapiens
YYISPRITF

SEQ ID NO: 150778 - protein, 9 aa, Homo Sapiens
YYKPDSPEY

SEQ ID NO: 150779 - protein, 9 aa, Homo Sapiens
YYNETHKIL

SEQ ID NO: 150780 - protein, 9 aa, Homo Sapiens
YYPEYKLLF

SEQ ID NO: 150781 - protein, 9 aa, Homo Sapiens
YYPNCEVVF

SEQ ID NO: 150782 - protein, 9 aa, Homo Sapiens
YYPNPPLVL

SEQ ID NO: 150783 - protein, 9 aa, Homo Sapiens
YYPQQAIVF

SEQ ID NO: 150784 - protein, 9 aa, Homo Sapiens
YYRAWQEYY

SEQ ID NO: 150785 - protein, 9 aa, Homo Sapiens
YYRPLHDEY

SEQ ID NO: 150786 - protein, 9 aa, Homo Sapiens
YYSGLIYTY

SEQ ID NO: 150787 - protein, 9 aa, Homo Sapiens
YYSPHGHIL

SEQ ID NO: 150788 - protein, 9 aa, Homo Sapiens
YYSPSCREF

SEQ ID NO: 150789 - protein, 9 aa, Homo Sapiens
YYTEFPTVL

SEQ ID NO: 150790 - protein, 9 aa, Homo Sapiens
YYYTKEEQF

SEQ ID NO: 150791 - protein, 10 aa, Homo Sapiens
ARSDKPIFTL

SEQ ID NO: 150792 - protein, 10 aa, Homo Sapiens
ARSENLIYTY

SEQ ID NO: 150793 - protein, 10 aa, Homo Sapiens
ARYSGSYNDY

SEQ ID NO: 150794 - protein, 10 aa, Homo Sapiens
AYMDAPKAAL

SEQ ID NO: 150795 - protein, 10 aa, Homo Sapiens
AYREHPYGRY

SEQ ID NO: 150796 - protein, 10 aa, Homo Sapiens
AYRHLVGVCY

SEQ ID NO: 150797 - protein, 10 aa, Homo Sapiens
AYRVNGQYIM

SEQ ID NO: 150798 - protein, 10 aa, Homo Sapiens
AYYEEQHPEL

SEQ ID NO: 150799 - protein, 10 aa, Homo Sapiens
ELGRSQALFL

SEQ ID NO: 150800 - protein, 10 aa, Homo Sapiens
FRGPSGLLVY

SEQ ID NO: 150801 - protein, 10 aa, Homo Sapiens
FRKDGVPIGY

SEQ ID NO: 150802 - protein, 10 aa, Homo Sapiens
FRMQEGSEVY

SEQ ID NO: 150803 - protein, 10 aa, Homo Sapiens
FRPDLSSASF

SEQ ID NO: 150804 - protein, 10 aa, Homo Sapiens
FRPDVTSSSF

SEQ ID NO: 150805 - protein, 10 aa, Homo Sapiens
FRPVPLEQTY

SEQ ID NO: 150806 - protein, 10 aa, Homo Sapiens
FRQYAKDIGF

SEQ ID NO: 150807 - protein, 10 aa, Homo Sapiens
FRSLSTTNVF

SEQ ID NO: 150808 - protein, 10 aa, Homo Sapiens
FRSPTAPSVF

SEQ ID NO: 150809 - protein, 10 aa, Homo Sapiens
FRTGNPTGTY

SEQ ID NO: 150810 - protein, 10 aa, Homo Sapiens
FRYHGLSSLC

SEQ ID NO: 150811 - protein, 10 aa, Homo Sapiens
FRYNGLSFVY

SEQ ID NO: 150812 - protein, 10 aa, Homo Sapiens
GGYRDFFPEY

SEQ ID NO: 150813 - protein, 10 aa, Homo Sapiens
GSYRDSYDSY

SEQ ID NO: 150814 - protein, 10 aa, Homo Sapiens
GSYRDSYESY

SEQ ID NO: 150815 - protein, 10 aa, Homo Sapiens
HLHNMPPSAL

SEQ ID NO: 150816 - protein, 10 aa, Homo Sapiens
HRFEQAFYTY

SEQ ID NO: 150817 - protein, 10 aa, Homo Sapiens
HRPPASEYTM

SEQ ID NO: 150818 - protein, 10 aa, Homo Sapiens
HRPPGPFPIM

SEQ ID NO: 150819 - protein, 10 aa, Homo Sapiens
IREEYPDRIM

SEQ ID NO: 150820 - protein, 10 aa, Homo Sapiens
IYPGYHQSSY

SEQ ID NO: 150821 - protein, 10 aa, Homo Sapiens
IYPSVDKREY

SEQ ID NO: 150822 - protein, 10 aa, Homo Sapiens
KRHEMPPHIY

SEQ ID NO: 150823 - protein, 10 aa, Homo Sapiens
KRNGVIIAGY

SEQ ID NO: 150824 - protein, 10 aa, Homo Sapiens
KYFDSGDYNM

SEQ ID NO: 150825 - protein, 10 aa, Homo Sapiens
LRAPCLPVTY

SEQ ID NO: 150826 - protein, 10 aa, Homo Sapiens
LYWSHPRKFG

SEQ ID NO: 150827 - protein, 10 aa, Homo Sapiens
MRTIATALEY

SEQ ID NO: 150828 - protein, 10 aa, Homo Sapiens
NKKTVSIPSY

SEQ ID NO: 150829 - protein, 10 aa, Homo Sapiens
NRFAGFGIGL

SEQ ID NO: 150830 - protein, 10 aa, Homo Sapiens
NRIGGRIFTY

SEQ ID NO: 150831 - protein, 10 aa, Homo Sapiens
NRPAPVEVSY

SEQ ID NO: 150832 - protein, 10 aa, Homo Sapiens
NRPAPVEVTY

SEQ ID NO: 150833 - protein, 10 aa, Homo Sapiens
NRPDVLDTAL

SEQ ID NO: 150834 - protein, 10 aa, Homo Sapiens
NRVLVVHDGF

SEQ ID NO: 150835 - protein, 10 aa, Homo Sapiens
NRVPAGNWVL

SEQ ID NO: 150836 - protein, 10 aa, Homo Sapiens
NRYDGQVAVF

SEQ ID NO: 150837 - protein, 10 aa, Homo Sapiens
NTVDILLHHI

SEQ ID NO: 150838 - protein, 10 aa, Homo Sapiens
NYRTPNFQSY

SEQ ID NO: 150839 - protein, 10 aa, Homo Sapiens
QYGSEGRFTF

SEQ ID NO: 150840 - protein, 10 aa, Homo Sapiens
RRFDAMPFTL

SEQ ID NO: 150841 - protein, 10 aa, Homo Sapiens
RRSDPGHYSF

SEQ ID NO: 150842 - protein, 10 aa, Homo Sapiens
RRSINQPVAF

SEQ ID NO: 150843 - protein, 10 aa, Homo Sapiens
RYIDRIHIFF

SEQ ID NO: 150844 - protein, 10 aa, Homo Sapiens
RYREDLDFVL

SEQ ID NO: 150845 - protein, 10 aa, Homo Sapiens
SRADQFEYVM

SEQ ID NO: 150846 - protein, 10 aa, Homo Sapiens
SRAFQPSVSL

SEQ ID NO: 150847 - protein, 10 aa, Homo Sapiens
SREGRPIWQL

SEQ ID NO: 150848 - protein, 10 aa, Homo Sapiens
SRGPGTSFEF

SEQ ID NO: 150849 - protein, 10 aa, Homo Sapiens
SRHSGPFFTF

SEQ ID NO: 150850 - protein, 10 aa, Homo Sapiens
SRPPIIVSEF

SEQ ID NO: 150851 - protein, 10 aa, Homo Sapiens
SRYDGQIAVF

SEQ ID NO: 150852 - protein, 10 aa, Homo Sapiens
SYPERPIIFL

SEQ ID NO: 150853 - protein, 10 aa, Homo Sapiens
SYVTTSTRTY

SEQ ID NO: 150854 - protein, 10 aa, Homo Sapiens
TRTEPINTTY

SEQ ID NO: 150855 - protein, 10 aa, Homo Sapiens
TYPDRGQCHL

SEQ ID NO: 150856 - protein, 10 aa, Homo Sapiens
VAPVGSGSAL

SEQ ID NO: 150857 - protein, 10 aa, Homo Sapiens
VLSAADKGNV

SEQ ID NO: 150858 - protein, 10 aa, Homo Sapiens
VRFDSDVGEY

SEQ ID NO: 150859 - protein, 10 aa, Homo Sapiens
VRFDVHDVTL

SEQ ID NO: 150860 - protein, 10 aa, Homo Sapiens
VRGDGPWYYY

SEQ ID NO: 150861 - protein, 10 aa, Homo Sapiens
VRPCVSIEGY

SEQ ID NO: 150862 - protein, 10 aa, Homo Sapiens
VRPEQPFIVL

SEQ ID NO: 150863 - protein, 10 aa, Homo Sapiens
YKRPVLLIEF

SEQ ID NO: 150864 - protein, 10 aa, Homo Sapiens
YRIPSTPDSF

SEQ ID NO: 150865 - protein, 10 aa, Homo Sapiens
YRNPKGFSTL

SEQ ID NO: 150866 - protein, 10 aa, Homo Sapiens
YRPETGSWVF

SEQ ID NO: 150867 - protein, 10 aa, Homo Sapiens
YRPPPVLDAL

SEQ ID NO: 150868 - protein, 10 aa, Homo Sapiens
YRYDGQHFSL

SEQ ID NO: 150869 - protein, 10 aa, Homo Sapiens
YYRYPTGESY

SEQ ID NO: 150870 - protein, 10 aa, Homo Sapiens
YYYDGDIGNY

SEQ ID NO: 150871 - protein, 10 aa, Homo Sapiens
YYYDGDVGNY

SEQ ID NO: 150872 - protein, 10 aa, Homo Sapiens
YYYGKFMPVG

SEQ ID NO: 150873 - protein, 11 aa, Homo Sapiens
ARLDHKFDLMY

SEQ ID NO: 150874 - protein, 11 aa, Homo Sapiens
ARPDEKAIMTY

SEQ ID NO: 150875 - protein, 11 aa, Homo Sapiens
ARYSGSYNDYL

SEQ ID NO: 150876 - protein, 11 aa, Homo Sapiens
AVEAKKTYVRD

SEQ ID NO: 150877 - protein, 11 aa, Homo Sapiens
FRHDSGYEVHH

SEQ ID NO: 150878 - protein, 11 aa, Homo Sapiens
FRLAQEGIYTL

SEQ ID NO: 150879 - protein, 11 aa, Homo Sapiens
FRPDEPYYYGY

SEQ ID NO: 150880 - protein, 11 aa, Homo Sapiens
GGSYRDSYDSY

SEQ ID NO: 150881 - protein, 11 aa, Homo Sapiens
HRFSYDTFVDY

SEQ ID NO: 150882 - protein, 11 aa, Homo Sapiens
HYRPPEVILEL

SEQ ID NO: 150883 - protein, 11 aa, Homo Sapiens
KYFDKASYRVY

SEQ ID NO: 150884 - protein, 11 aa, Homo Sapiens
KYLDEDTIYHL

SEQ ID NO: 150885 - protein, 11 aa, Homo Sapiens
MKVELCSFSGY

SEQ ID NO: 150886 - protein, 11 aa, Homo Sapiens
NRPDIIDPAIL

SEQ ID NO: 150887 - protein, 11 aa, Homo Sapiens
PHRYRPGTVAL

SEQ ID NO: 150888 - protein, 11 aa, Homo Sapiens
SGPSIVHRKCF

SEQ ID NO: 150889 - protein, 11 aa, Homo Sapiens
SRKESYSIYVY

SEQ ID NO: 150890 - protein, 11 aa, Homo Sapiens
SRKESYSVYVY

SEQ ID NO: 150891 - protein, 11 aa, Homo Sapiens
SYYDRGYDRGY

SEQ ID NO: 150892 - protein, 11 aa, Homo Sapiens
VRPDTNIFTVY

SEQ ID NO: 150893 - protein, 11 aa, Homo Sapiens
VRTDITYPAGF

SEQ ID NO: 150894 - protein, 11 aa, Homo Sapiens
YRADTQTYQPY

SEQ ID NO: 150895 - protein, 11 aa, Homo Sapiens
YRATENDIYNF

SEQ ID NO: 150896 - protein, 11 aa, Homo Sapiens
YRGPAGDATVA

SEQ ID NO: 150897 - protein, 11 aa, Homo Sapiens
YRRLPDAHSDY

SEQ ID NO: 150898 - protein, 11 aa, Homo Sapiens
YRVTLNPPGTF

SEQ ID NO: 150899 - protein, 11 aa, Homo Sapiens
YYDGDVGNYYY

SEQ ID NO: 150900 - protein, 11 aa, Homo Sapiens
YYSPHGHILVL

SEQ ID NO: 150901 - protein, 8 aa, Homo Sapiens
AAAPPLTL

SEQ ID NO: 150902 - protein, 8 aa, Homo Sapiens
AAGPGFSL

SEQ ID NO: 150903 - protein, 8 aa, Homo Sapiens
AAGRPLEL

SEQ ID NO: 150904 - protein, 8 aa, Homo Sapiens
AAGVVLEM

SEQ ID NO: 150905 - protein, 8 aa, Homo Sapiens
ADFETVRM

SEQ ID NO: 150906 - protein, 8 aa, Homo Sapiens
ADFLVYEF

SEQ ID NO: 150907 - protein, 8 aa, Homo Sapiens
ADIVATGF

SEQ ID NO: 150908 - protein, 8 aa, Homo Sapiens
ADQIVTKL

SEQ ID NO: 150909 - protein, 8 aa, Homo Sapiens
AEMVRHAL

SEQ ID NO: 150910 - protein, 8 aa, Homo Sapiens
AEMYVAKF

SEQ ID NO: 150911 - protein, 8 aa, Homo Sapiens
AEPIKQAF

SEQ ID NO: 150912 - protein, 8 aa, Homo Sapiens
AGGHPLEL

SEQ ID NO: 150913 - protein, 8 aa, Homo Sapiens
AGGRVFVL

SEQ ID NO: 150914 - protein, 8 aa, Homo Sapiens
ASGMILVM

SEQ ID NO: 150915 - protein, 8 aa, Homo Sapiens
ASGQAFEL

SEQ ID NO: 150916 - protein, 8 aa, Homo Sapiens
ASLTVMVL

SEQ ID NO: 150917 - protein, 8 aa, Homo Sapiens
AVGIALVM

SEQ ID NO: 150918 - protein, 8 aa, Homo Sapiens
AVGKHFEL

SEQ ID NO: 150919 - protein, 8 aa, Homo Sapiens
AVGPDLYL

SEQ ID NO: 150920 - protein, 8 aa, Homo Sapiens
AVGPIVQL

SEQ ID NO: 150921 - protein, 8 aa, Homo Sapiens
CSGAIIVL

SEQ ID NO: 150922 - protein, 8 aa, Homo Sapiens
EEQLQQIR

SEQ ID NO: 150923 - protein, 8 aa, Homo Sapiens
FAGMPITL

SEQ ID NO: 150924 - protein, 8 aa, Homo Sapiens
FIGYPITL

SEQ ID NO: 150925 - protein, 8 aa, Homo Sapiens
FNEKSKEL

SEQ ID NO: 150926 - protein, 8 aa, Homo Sapiens
FSGPAITL

SEQ ID NO: 150927 - protein, 8 aa, Homo Sapiens
FSPVGSVL

SEQ ID NO: 150928 - protein, 8 aa, Homo Sapiens
FVGLDIEM

SEQ ID NO: 150929 - protein, 8 aa, Homo Sapiens
FVGQTVEL

SEQ ID NO: 150930 - protein, 8 aa, Homo Sapiens
FYQEHPDL

SEQ ID NO: 150931 - protein, 8 aa, Homo Sapiens
GDTLVTGF

SEQ ID NO: 150932 - protein, 8 aa, Homo Sapiens
HDKLSHYL

SEQ ID NO: 150933 - protein, 8 aa, Homo Sapiens
HDVPHQPF

SEQ ID NO: 150934 - protein, 8 aa, Homo Sapiens
HSGPIHVL

SEQ ID NO: 150935 - protein, 8 aa, Homo Sapiens
HVGTEVVL

SEQ ID NO: 150936 - protein, 8 aa, Homo Sapiens
HYNNIMAL

SEQ ID NO: 150937 - protein, 8 aa, Homo Sapiens
ILGPTFTL

SEQ ID NO: 150938 - protein, 8 aa, Homo Sapiens
ISGITMVL

SEQ ID NO: 150939 - protein, 8 aa, Homo Sapiens
ITGVDIVM

SEQ ID NO: 150940 - protein, 8 aa, Homo Sapiens
ITGVVITL

SEQ ID NO: 150941 - protein, 8 aa, Homo Sapiens
IVGPLVEM

SEQ ID NO: 150942 - protein, 8 aa, Homo Sapiens
IVGPVVGL

SEQ ID NO: 150943 - protein, 8 aa, Homo Sapiens
IVGVVVVV

SEQ ID NO: 150944 - protein, 8 aa, Homo Sapiens
KDSMIRKF

SEQ ID NO: 150945 - protein, 8 aa, Homo Sapiens
KDSYVVAF

SEQ ID NO: 150946 - protein, 8 aa, Homo Sapiens
KDVVIHRF

SEQ ID NO: 150947 - protein, 8 aa, Homo Sapiens
LAETEGRY

SEQ ID NO: 150948 - protein, 8 aa, Homo Sapiens
LAGPALEL

SEQ ID NO: 150949 - protein, 8 aa, Homo Sapiens
LDSVHQLL

SEQ ID NO: 150950 - protein, 8 aa, Homo Sapiens
LGGIPIAI

SEQ ID NO: 150951 - protein, 8 aa, Homo Sapiens
LGGIVVVL

SEQ ID NO: 150952 - protein, 8 aa, Homo Sapiens
LNNMRSQY

SEQ ID NO: 150953 - protein, 8 aa, Homo Sapiens
LQGVVVVL

SEQ ID NO: 150954 - protein, 8 aa, Homo Sapiens
LSGTVVEL

SEQ ID NO: 150955 - protein, 8 aa, Homo Sapiens
LTGCVLVL

SEQ ID NO: 150956 - protein, 8 aa, Homo Sapiens
LTVGDLVM

SEQ ID NO: 150957 - protein, 8 aa, Homo Sapiens
LVGACITL

SEQ ID NO: 150958 - protein, 8 aa, Homo Sapiens
LVGPQIYL

SEQ ID NO: 150959 - protein, 8 aa, Homo Sapiens
MVGTVVVL

SEQ ID NO: 150960 - protein, 8 aa, Homo Sapiens
NRGVIITM

SEQ ID NO: 150961 - protein, 8 aa, Homo Sapiens
NSGVPVYL

SEQ ID NO: 150962 - protein, 8 aa, Homo Sapiens
QLAHSVVL

SEQ ID NO: 150963 - protein, 8 aa, Homo Sapiens
QSGIVILL

SEQ ID NO: 150964 - protein, 8 aa, Homo Sapiens
RDALKTEF

SEQ ID NO: 150965 - protein, 8 aa, Homo Sapiens
RDFAARLV

SEQ ID NO: 150966 - protein, 8 aa, Homo Sapiens
RDFNHINV

SEQ ID NO: 150967 - protein, 8 aa, Homo Sapiens
RDFTVSAM

SEQ ID NO: 150968 - protein, 8 aa, Homo Sapiens
RDFVARNV

SEQ ID NO: 150969 - protein, 8 aa, Homo Sapiens
RDHIHVHF

SEQ ID NO: 150970 - protein, 8 aa, Homo Sapiens
RDHIKDSF

SEQ ID NO: 150971 - protein, 8 aa, Homo Sapiens
RDHLRVNL

SEQ ID NO: 150972 - protein, 8 aa, Homo Sapiens
RDLIHTGV

SEQ ID NO: 150973 - protein, 8 aa, Homo Sapiens
RDLLTRRL

SEQ ID NO: 150974 - protein, 8 aa, Homo Sapiens
RDNYVPEV

SEQ ID NO: 150975 - protein, 8 aa, Homo Sapiens
RDSLVERL

SEQ ID NO: 150976 - protein, 8 aa, Homo Sapiens
RDTYVSSF

SEQ ID NO: 150977 - protein, 8 aa, Homo Sapiens
RDWFSSQL

SEQ ID NO: 150978 - protein, 8 aa, Homo Sapiens
RDWYKRNF

SEQ ID NO: 150979 - protein, 8 aa, Homo Sapiens
RDYVRYRL

SEQ ID NO: 150980 - protein, 8 aa, Homo Sapiens
REALVKKF

SEQ ID NO: 150981 - protein, 8 aa, Homo Sapiens
REHPVPLL

SEQ ID NO: 150982 - protein, 8 aa, Homo Sapiens
REIIINAV

SEQ ID NO: 150983 - protein, 8 aa, Homo Sapiens
REKEWQRL

SEQ ID NO: 150984 - protein, 8 aa, Homo Sapiens
RELVAHHL

SEQ ID NO: 150985 - protein, 8 aa, Homo Sapiens
REYYVNQF

SEQ ID NO: 150986 - protein, 8 aa, Homo Sapiens
SDTLKTYF

SEQ ID NO: 150987 - protein, 8 aa, Homo Sapiens
SYGLNIEM

SEQ ID NO: 150988 - protein, 8 aa, Homo Sapiens
TDFISHLF

SEQ ID NO: 150989 - protein, 8 aa, Homo Sapiens
TDGKVFQF

SEQ ID NO: 150990 - protein, 8 aa, Homo Sapiens
TDLLKTGF

SEQ ID NO: 150991 - protein, 8 aa, Homo Sapiens
TEELAYLK

SEQ ID NO: 150992 - protein, 8 aa, Homo Sapiens
TRGPVVRL

SEQ ID NO: 150993 - protein, 8 aa, Homo Sapiens
TSGIVLVL

SEQ ID NO: 150994 - protein, 8 aa, Homo Sapiens
TSGPPLTM

SEQ ID NO: 150995 - protein, 8 aa, Homo Sapiens
TSGVALTL

SEQ ID NO: 150996 - protein, 8 aa, Homo Sapiens
TTGPIFSM

SEQ ID NO: 150997 - protein, 8 aa, Homo Sapiens
TVGPVQKL

SEQ ID NO: 150998 - protein, 8 aa, Homo Sapiens
TVGVDFAL

SEQ ID NO: 150999 - protein, 8 aa, Homo Sapiens
TVGVIVRL

SEQ ID NO: 151000 - protein, 8 aa, Homo Sapiens
VAGAVFTL

SEQ ID NO: 151001 - protein, 8 aa, Homo Sapiens
VGGPEIEL

SEQ ID NO: 151002 - protein, 8 aa, Homo Sapiens
VGGVPVTL

SEQ ID NO: 151003 - protein, 8 aa, Homo Sapiens
VIGPPVVL

SEQ ID NO: 151004 - protein, 8 aa, Homo Sapiens
VSLTACKV

SEQ ID NO: 151005 - protein, 8 aa, Homo Sapiens
VTDTNVIL

SEQ ID NO: 151006 - protein, 8 aa, Homo Sapiens
VVGPNITL

SEQ ID NO: 151007 - protein, 8 aa, Homo Sapiens
YDNPHEAL

SEQ ID NO: 151008 - protein, 8 aa, Homo Sapiens
YDSVKVYF

SEQ ID NO: 151009 - protein, 8 aa, Homo Sapiens
YEDIAQKS

SEQ ID NO: 151010 - protein, 8 aa, Homo Sapiens
YQGIAVVM

SEQ ID NO: 151011 - protein, 8 aa, Homo Sapiens
YQGVLVEL

SEQ ID NO: 151012 - protein, 8 aa, Homo Sapiens
YSGVLITL

SEQ ID NO: 151013 - protein, 8 aa, Homo Sapiens
YSNKEIFL

SEQ ID NO: 151014 - protein, 8 aa, Homo Sapiens
YVGPSLRM

SEQ ID NO: 151015 - protein, 8 aa, Homo Sapiens
YVGVVHRL

SEQ ID NO: 151016 - protein, 9 aa, Homo Sapiens
AAAGSPVFL

SEQ ID NO: 151017 - protein, 9 aa, Homo Sapiens
AAAHFYFEL

SEQ ID NO: 151018 - protein, 9 aa, Homo Sapiens
AAAPHLLLL

SEQ ID NO: 151019 - protein, 9 aa, Homo Sapiens
AAAPSLLIL

SEQ ID NO: 151020 - protein, 9 aa, Homo Sapiens
AAASHFFNL

SEQ ID NO: 151021 - protein, 9 aa, Homo Sapiens
AAAVQAFYL

SEQ ID NO: 151022 - protein, 9 aa, Homo Sapiens
AAGSHVIIL

SEQ ID NO: 151023 - protein, 9 aa, Homo Sapiens
AAHDALVEL

SEQ ID NO: 151024 - protein, 9 aa, Homo Sapiens
AAHPGPIVV

SEQ ID NO: 151025 - protein, 9 aa, Homo Sapiens
AAHTQATLL

SEQ ID NO: 151026 - protein, 9 aa, Homo Sapiens
AAHVSRVIL

SEQ ID NO: 151027 - protein, 9 aa, Homo Sapiens
AAIASLLYL

SEQ ID NO: 151028 - protein, 9 aa, Homo Sapiens
AAIDHQIEV

SEQ ID NO: 151029 - protein, 9 aa, Homo Sapiens
AAIWFRTYL

SEQ ID NO: 151030 - protein, 9 aa, Homo Sapiens
AAIYHVLHF

SEQ ID NO: 151031 - protein, 9 aa, Homo Sapiens
AALDKATVL

SEQ ID NO: 151032 - protein, 9 aa, Homo Sapiens
AALPKATIL

SEQ ID NO: 151033 - protein, 9 aa, Homo Sapiens
AAMDAEIVL

SEQ ID NO: 151034 - protein, 9 aa, Homo Sapiens
AAMKNVTEL

SEQ ID NO: 151035 - protein, 9 aa, Homo Sapiens
AAMSHLLEM

SEQ ID NO: 151036 - protein, 9 aa, Homo Sapiens
AANKTIIYL

SEQ ID NO: 151037 - protein, 9 aa, Homo Sapiens
AANPHSFVF

SEQ ID NO: 151038 - protein, 9 aa, Homo Sapiens
AANPIQFTL

SEQ ID NO: 151039 - protein, 9 aa, Homo Sapiens
AANTSTVEL

SEQ ID NO: 151040 - protein, 9 aa, Homo Sapiens
AAPAYSRAL

SEQ ID NO: 151041 - protein, 9 aa, Homo Sapiens
AAPVPTTTL

SEQ ID NO: 151042 - protein, 9 aa, Homo Sapiens
AAQQHETFL

SEQ ID NO: 151043 - protein, 9 aa, Homo Sapiens
AASKVMVEL

SEQ ID NO: 151044 - protein, 9 aa, Homo Sapiens
AASPSELHL

SEQ ID NO: 151045 - protein, 9 aa, Homo Sapiens
AATGHTVVL

SEQ ID NO: 151046 - protein, 9 aa, Homo Sapiens
AATGVVLDL

SEQ ID NO: 151047 - protein, 9 aa, Homo Sapiens
AATSVHVVA

SEQ ID NO: 151048 - protein, 9 aa, Homo Sapiens
AATVFCVVL

SEQ ID NO: 151049 - protein, 9 aa, Homo Sapiens
AAVEEGIVL

SEQ ID NO: 151050 - protein, 9 aa, Homo Sapiens
AAVGHVLVV

SEQ ID NO: 151051 - protein, 9 aa, Homo Sapiens
AAVNHISQL

SEQ ID NO: 151052 - protein, 9 aa, Homo Sapiens
ADALRPSVV

SEQ ID NO: 151053 - protein, 9 aa, Homo Sapiens
ADHIRSIHV

SEQ ID NO: 151054 - protein, 9 aa, Homo Sapiens
ADLERFFNF

SEQ ID NO: 151055 - protein, 9 aa, Homo Sapiens
ADLERVLGL

SEQ ID NO: 151056 - protein, 9 aa, Homo Sapiens
ADLYRVLGV

SEQ ID NO: 151057 - protein, 9 aa, Homo Sapiens
ADMAHISGL

SEQ ID NO: 151058 - protein, 9 aa, Homo Sapiens
ADNLRLIQV

SEQ ID NO: 151059 - protein, 9 aa, Homo Sapiens
ADQLRFSYL

SEQ ID NO: 151060 - protein, 9 aa, Homo Sapiens
ADSKRAFEL

SEQ ID NO: 151061 - protein, 9 aa, Homo Sapiens
ADSLRLQQL

SEQ ID NO: 151062 - protein, 9 aa, Homo Sapiens
ADSQRFRQF

SEQ ID NO: 151063 - protein, 9 aa, Homo Sapiens
ADVLKVEVF

SEQ ID NO: 151064 - protein, 9 aa, Homo Sapiens
AEAQRFARM

SEQ ID NO: 151065 - protein, 9 aa, Homo Sapiens
AELERNVAL

SEQ ID NO: 151066 - protein, 9 aa, Homo Sapiens
AELQRVQKV

SEQ ID NO: 151067 - protein, 9 aa, Homo Sapiens
AESLRYKLL

SEQ ID NO: 151068 - protein, 9 aa, Homo Sapiens
AEYIRTEML

SEQ ID NO: 151069 - protein, 9 aa, Homo Sapiens
AGADHIITM

SEQ ID NO: 151070 - protein, 9 aa, Homo Sapiens
AGAYHAVVL

SEQ ID NO: 151071 - protein, 9 aa, Homo Sapiens
AGHDQVVVL

SEQ ID NO: 151072 - protein, 9 aa, Homo Sapiens
AGHPHIITL

SEQ ID NO: 151073 - protein, 9 aa, Homo Sapiens
AGLTHIITM

SEQ ID NO: 151074 - protein, 9 aa, Homo Sapiens
AGMPTAYDL

SEQ ID NO: 151075 - protein, 9 aa, Homo Sapiens
AGQDAVIVL

SEQ ID NO: 151076 - protein, 9 aa, Homo Sapiens
AGQEAIFIL

SEQ ID NO: 151077 - protein, 9 aa, Homo Sapiens
AGQESPIIL

SEQ ID NO: 151078 - protein, 9 aa, Homo Sapiens
AGSPFHPAM

SEQ ID NO: 151079 - protein, 9 aa, Homo Sapiens
AGSPHALEM

SEQ ID NO: 151080 - protein, 9 aa, Homo Sapiens
AGVDHRVIL

SEQ ID NO: 151081 - protein, 9 aa, Homo Sapiens
AIHTAILTL

SEQ ID NO: 151082 - protein, 9 aa, Homo Sapiens
AIMPYCLHL

SEQ ID NO: 151083 - protein, 9 aa, Homo Sapiens
AINELLVEL

SEQ ID NO: 151084 - protein, 9 aa, Homo Sapiens
AIQEHPVVL

SEQ ID NO: 151085 - protein, 9 aa, Homo Sapiens
ALHHAVIFL

SEQ ID NO: 151086 - protein, 9 aa, Homo Sapiens
ALMYHTITL

SEQ ID NO: 151087 - protein, 9 aa, Homo Sapiens
ALPFFVITM

SEQ ID NO: 151088 - protein, 9 aa, Homo Sapiens
ALPSHVVTM

SEQ ID NO: 151089 - protein, 9 aa, Homo Sapiens
ALTPVVVTL

SEQ ID NO: 151090 - protein, 9 aa, Homo Sapiens
ARANQAIQM

SEQ ID NO: 151091 - protein, 9 aa, Homo Sapiens
ARHELQVEM

SEQ ID NO: 151092 - protein, 9 aa, Homo Sapiens
ARLKDIIVM

SEQ ID NO: 151093 - protein, 9 aa, Homo Sapiens
ARNDYLLTL

SEQ ID NO: 151094 - protein, 9 aa, Homo Sapiens
ARPKSAFKV

SEQ ID NO: 151095 - protein, 9 aa, Homo Sapiens
ARPPFVICV

SEQ ID NO: 151096 - protein, 9 aa, Homo Sapiens
ASADTAYVL

SEQ ID NO: 151097 - protein, 9 aa, Homo Sapiens
ASATVHIRM

SEQ ID NO: 151098 - protein, 9 aa, Homo Sapiens
ASHDSTLSL

SEQ ID NO: 151099 - protein, 9 aa, Homo Sapiens
ASSFVFLNL

SEQ ID NO: 151100 - protein, 9 aa, Homo Sapiens
ASSPHGLVM

SEQ ID NO: 151101 - protein, 9 aa, Homo Sapiens
ASTCVIIKL

SEQ ID NO: 151102 - protein, 9 aa, Homo Sapiens
ASVPAALAS

SEQ ID NO: 151103 - protein, 9 aa, Homo Sapiens
ATAPQAPVM

SEQ ID NO: 151104 - protein, 9 aa, Homo Sapiens
ATGNYIIIM

SEQ ID NO: 151105 - protein, 9 aa, Homo Sapiens
ATMGHWILL

SEQ ID NO: 151106 - protein, 9 aa, Homo Sapiens
ATPDHVLFM

SEQ ID NO: 151107 - protein, 9 aa, Homo Sapiens
ATSNVAISV

SEQ ID NO: 151108 - protein, 9 aa, Homo Sapiens
AVGAVPVVL

SEQ ID NO: 151109 - protein, 9 aa, Homo Sapiens
AVIEAEHTL

SEQ ID NO: 151110 - protein, 9 aa, Homo Sapiens
AVIESVTFL

SEQ ID NO: 151111 - protein, 9 aa, Homo Sapiens
AVMEEKTIL

SEQ ID NO: 151112 - protein, 9 aa, Homo Sapiens
AVMLHSFTL

SEQ ID NO: 151113 - protein, 9 aa, Homo Sapiens
AVNPHLFSL

SEQ ID NO: 151114 - protein, 9 aa, Homo Sapiens
AVQEKVFEL

SEQ ID NO: 151115 - protein, 9 aa, Homo Sapiens
AVSNHVFHL

SEQ ID NO: 151116 - protein, 9 aa, Homo Sapiens
AVSNHVFQL

SEQ ID NO: 151117 - protein, 9 aa, Homo Sapiens
AVSPVDLNL

SEQ ID NO: 151118 - protein, 9 aa, Homo Sapiens
AVSPYSIVL

SEQ ID NO: 151119 - protein, 9 aa, Homo Sapiens
AVTEHCITL

SEQ ID NO: 151120 - protein, 9 aa, Homo Sapiens
AVVAHAYYL

SEQ ID NO: 151121 - protein, 9 aa, Homo Sapiens
AYSEAIFEL

SEQ ID NO: 151122 - protein, 9 aa, Homo Sapiens
CAPRRKVAL

SEQ ID NO: 151123 - protein, 9 aa, Homo Sapiens
CGANHTLVL

SEQ ID NO: 151124 - protein, 9 aa, Homo Sapiens
CSSPHALVL

SEQ ID NO: 151125 - protein, 9 aa, Homo Sapiens
EDLIHEIAF

SEQ ID NO: 151126 - protein, 9 aa, Homo Sapiens
EDQLRGAGF

SEQ ID NO: 151127 - protein, 9 aa, Homo Sapiens
EELPHIHAF

SEQ ID NO: 151128 - protein, 9 aa, Homo Sapiens
FAFPGEILM

SEQ ID NO: 151129 - protein, 9 aa, Homo Sapiens
FAHPYQYEL

SEQ ID NO: 151130 - protein, 9 aa, Homo Sapiens
FAIHKKIVL

SEQ ID NO: 151131 - protein, 9 aa, Homo Sapiens
FAIPGSIFL

SEQ ID NO: 151132 - protein, 9 aa, Homo Sapiens
FALSGPLFL

SEQ ID NO: 151133 - protein, 9 aa, Homo Sapiens
FAMPYFIQV

SEQ ID NO: 151134 - protein, 9 aa, Homo Sapiens
FAPYHLVLL

SEQ ID NO: 151135 - protein, 9 aa, Homo Sapiens
FAQEALTVL

SEQ ID NO: 151136 - protein, 9 aa, Homo Sapiens
FASEYPLIL

SEQ ID NO: 151137 - protein, 9 aa, Homo Sapiens
FASHVSPEV

SEQ ID NO: 151138 - protein, 9 aa, Homo Sapiens
FASVVDIKL

SEQ ID NO: 151139 - protein, 9 aa, Homo Sapiens
FATTSPLVL

SEQ ID NO: 151140 - protein, 9 aa, Homo Sapiens
FGAGHLICL

SEQ ID NO: 151141 - protein, 9 aa, Homo Sapiens
FGSEFSPEL

SEQ ID NO: 151142 - protein, 9 aa, Homo Sapiens
FIGSHVIEL

SEQ ID NO: 151143 - protein, 9 aa, Homo Sapiens
FKPETYWVL

SEQ ID NO: 151144 - protein, 9 aa, Homo Sapiens
FLPDHPIVL

SEQ ID NO: 151145 - protein, 9 aa, Homo Sapiens
FLPDLQITM

SEQ ID NO: 151146 - protein, 9 aa, Homo Sapiens
FLPQKIIYL

SEQ ID NO: 151147 - protein, 9 aa, Homo Sapiens
FLPYHVLLL

SEQ ID NO: 151148 - protein, 9 aa, Homo Sapiens
FLSHIPITL

SEQ ID NO: 151149 - protein, 9 aa, Homo Sapiens
FLVEHVLTL

SEQ ID NO: 151150 - protein, 9 aa, Homo Sapiens
FNDPNAKEM

SEQ ID NO: 151151 - protein, 9 aa, Homo Sapiens
FNHPEIVQL

SEQ ID NO: 151152 - protein, 9 aa, Homo Sapiens
FQMPTPIQM

SEQ ID NO: 151153 - protein, 9 aa, Homo Sapiens
FQNPSTVTL

SEQ ID NO: 151154 - protein, 9 aa, Homo Sapiens
FRCPSNHQM

SEQ ID NO: 151155 - protein, 9 aa, Homo Sapiens
FRHPHIIKL

SEQ ID NO: 151156 - protein, 9 aa, Homo Sapiens
FRLPTAEVM

SEQ ID NO: 151157 - protein, 9 aa, Homo Sapiens
FRMDHEFVA

SEQ ID NO: 151158 - protein, 9 aa, Homo Sapiens
FRNPLAPAV

SEQ ID NO: 151159 - protein, 9 aa, Homo Sapiens
FRPPNPWTM

SEQ ID NO: 151160 - protein, 9 aa, Homo Sapiens
FRQDFHSEM

SEQ ID NO: 151161 - protein, 9 aa, Homo Sapiens
FRQIIAVVL

SEQ ID NO: 151162 - protein, 9 aa, Homo Sapiens
FRTDGHPVM

SEQ ID NO: 151163 - protein, 9 aa, Homo Sapiens
FRVDYILSV

SEQ ID NO: 151164 - protein, 9 aa, Homo Sapiens
FRVPTANVS

SEQ ID NO: 151165 - protein, 9 aa, Homo Sapiens
FSHAQTVVL

SEQ ID NO: 151166 - protein, 9 aa, Homo Sapiens
FSSDVTHEM

SEQ ID NO: 151167 - protein, 9 aa, Homo Sapiens
FSSPVCMAF

SEQ ID NO: 151168 - protein, 9 aa, Homo Sapiens
FTLSHITQL

SEQ ID NO: 151169 - protein, 9 aa, Homo Sapiens
FTVPHTHVF

SEQ ID NO: 151170 - protein, 9 aa, Homo Sapiens
FVAETHIVL

SEQ ID NO: 151171 - protein, 9 aa, Homo Sapiens
FVANAIIHL

SEQ ID NO: 151172 - protein, 9 aa, Homo Sapiens
FVDPAQITM

SEQ ID NO: 151173 - protein, 9 aa, Homo Sapiens
FVEPFVILL

SEQ ID NO: 151174 - protein, 9 aa, Homo Sapiens
FVFPGELLL

SEQ ID NO: 151175 - protein, 9 aa, Homo Sapiens
FVGQNVLIL

SEQ ID NO: 151176 - protein, 9 aa, Homo Sapiens
FVHDLVLYL

SEQ ID NO: 151177 - protein, 9 aa, Homo Sapiens
FVHPDPLWI

SEQ ID NO: 151178 - protein, 9 aa, Homo Sapiens
FVHPKPVSL

SEQ ID NO: 151179 - protein, 9 aa, Homo Sapiens
FVHQGETEL

SEQ ID NO: 151180 - protein, 9 aa, Homo Sapiens
FVHTGVYNL

SEQ ID NO: 151181 - protein, 9 aa, Homo Sapiens
FVMETFVHL

SEQ ID NO: 151182 - protein, 9 aa, Homo Sapiens
FVNPVQVVL

SEQ ID NO: 151183 - protein, 9 aa, Homo Sapiens
FVNSYPVTM

SEQ ID NO: 151184 - protein, 9 aa, Homo Sapiens
FVPLHHFYL

SEQ ID NO: 151185 - protein, 9 aa, Homo Sapiens
FVTPKVIKL

SEQ ID NO: 151186 - protein, 9 aa, Homo Sapiens
FVVDHVIKI

SEQ ID NO: 151187 - protein, 9 aa, Homo Sapiens
FVVEHDFIM

SEQ ID NO: 151188 - protein, 9 aa, Homo Sapiens
FVVPYGTPL

SEQ ID NO: 151189 - protein, 9 aa, Homo Sapiens
FYAELYHII

SEQ ID NO: 151190 - protein, 9 aa, Homo Sapiens
FYNERVVIM

SEQ ID NO: 151191 - protein, 9 aa, Homo Sapiens
FYQPTCIVL

SEQ ID NO: 151192 - protein, 9 aa, Homo Sapiens
FYRPHTITL

SEQ ID NO: 151193 - protein, 9 aa, Homo Sapiens
GAHSFVLTL

SEQ ID NO: 151194 - protein, 9 aa, Homo Sapiens
GDLQRELNL

SEQ ID NO: 151195 - protein, 9 aa, Homo Sapiens
GDLSHIHRL

SEQ ID NO: 151196 - protein, 9 aa, Homo Sapiens
GDLVKKESF

SEQ ID NO: 151197 - protein, 9 aa, Homo Sapiens
GDYIRTGFI

SEQ ID NO: 151198 - protein, 9 aa, Homo Sapiens
GDYLRVWRV

SEQ ID NO: 151199 - protein, 9 aa, Homo Sapiens
GELKRRLGL

SEQ ID NO: 151200 - protein, 9 aa, Homo Sapiens
GEMPRHMQL

SEQ ID NO: 151201 - protein, 9 aa, Homo Sapiens
GGPGGVGGL

SEQ ID NO: 151202 - protein, 9 aa, Homo Sapiens
GGSNVHIIL

SEQ ID NO: 151203 - protein, 9 aa, Homo Sapiens
GILSPSIVL

SEQ ID NO: 151204 - protein, 9 aa, Homo Sapiens
GLHGWAFTL

SEQ ID NO: 151205 - protein, 9 aa, Homo Sapiens
GRMVQVHEL

SEQ ID NO: 151206 - protein, 9 aa, Homo Sapiens
GRNALEIVM

SEQ ID NO: 151207 - protein, 9 aa, Homo Sapiens
GRPCKIVEM

SEQ ID NO: 151208 - protein, 9 aa, Homo Sapiens
GSDMRTERF

SEQ ID NO: 151209 - protein, 9 aa, Homo Sapiens
GTTDHVIVL

SEQ ID NO: 151210 - protein, 9 aa, Homo Sapiens
GVVDHQTEL

SEQ ID NO: 151211 - protein, 9 aa, Homo Sapiens
HAAVRSVLL

SEQ ID NO: 151212 - protein, 9 aa, Homo Sapiens
HDHPHALEF

SEQ ID NO: 151213 - protein, 9 aa, Homo Sapiens
HDYMKQMTF

SEQ ID NO: 151214 - protein, 9 aa, Homo Sapiens
HELIHGSSF

SEQ ID NO: 151215 - protein, 9 aa, Homo Sapiens
HEPEPHILL

SEQ ID NO: 151216 - protein, 9 aa, Homo Sapiens
HGAPGVIYM

SEQ ID NO: 151217 - protein, 9 aa, Homo Sapiens
HLMPHLLTL

SEQ ID NO: 151218 - protein, 9 aa, Homo Sapiens
HLPSGVKSL

SEQ ID NO: 151219 - protein, 9 aa, Homo Sapiens
HLTPVTLEL

SEQ ID NO: 151220 - protein, 9 aa, Homo Sapiens
HMHPAGIIL

SEQ ID NO: 151221 - protein, 9 aa, Homo Sapiens
HRHPDAFYL

SEQ ID NO: 151222 - protein, 9 aa, Homo Sapiens
HRNEVTVEL

SEQ ID NO: 151223 - protein, 9 aa, Homo Sapiens
HRNGGLITL

SEQ ID NO: 151224 - protein, 9 aa, Homo Sapiens
HRPESVVLV

SEQ ID NO: 151225 - protein, 9 aa, Homo Sapiens
HRPLDPLTM

SEQ ID NO: 151226 - protein, 9 aa, Homo Sapiens
HRPSHFLNF

SEQ ID NO: 151227 - protein, 9 aa, Homo Sapiens
HRTDLNPIL

SEQ ID NO: 151228 - protein, 9 aa, Homo Sapiens
HSHPRVVEL

SEQ ID NO: 151229 - protein, 9 aa, Homo Sapiens
HSIGSYFTL

SEQ ID NO: 151230 - protein, 9 aa, Homo Sapiens
HSTPLIVCA

SEQ ID NO: 151231 - protein, 9 aa, Homo Sapiens
HSVAHTVVL

SEQ ID NO: 151232 - protein, 9 aa, Homo Sapiens
HVHEKAILL

SEQ ID NO: 151233 - protein, 9 aa, Homo Sapiens
HVHPNYFSL

SEQ ID NO: 151234 - protein, 9 aa, Homo Sapiens
HVIHHTTVV

SEQ ID NO: 151235 - protein, 9 aa, Homo Sapiens
HVNQYDIVL

SEQ ID NO: 151236 - protein, 9 aa, Homo Sapiens
HVPEHAVVL

SEQ ID NO: 151237 - protein, 9 aa, Homo Sapiens
HVQPRTIYL

SEQ ID NO: 151238 - protein, 9 aa, Homo Sapiens
IAPGVTHEL

SEQ ID NO: 151239 - protein, 9 aa, Homo Sapiens
IAPSHVIEM

SEQ ID NO: 151240 - protein, 9 aa, Homo Sapiens
IDHPHTHVV

SEQ ID NO: 151241 - protein, 9 aa, Homo Sapiens
IDLLRVIHV

SEQ ID NO: 151242 - protein, 9 aa, Homo Sapiens
IEKGHGIRL

SEQ ID NO: 151243 - protein, 9 aa, Homo Sapiens
IINSNPIEL

SEQ ID NO: 151244 - protein, 9 aa, Homo Sapiens
ILMEHIHKL

SEQ ID NO: 151245 - protein, 9 aa, Homo Sapiens
INSSVHVIM

SEQ ID NO: 151246 - protein, 9 aa, Homo Sapiens
IRHPNIITL

SEQ ID NO: 151247 - protein, 9 aa, Homo Sapiens
IRLENEIQT

SEQ ID NO: 151248 - protein, 9 aa, Homo Sapiens
IRMEHVKIV

SEQ ID NO: 151249 - protein, 9 aa, Homo Sapiens
IRMEVGPTM

SEQ ID NO: 151250 - protein, 9 aa, Homo Sapiens
IRNDYYLNL

SEQ ID NO: 151251 - protein, 9 aa, Homo Sapiens
IRPEHVLRL

SEQ ID NO: 151252 - protein, 9 aa, Homo Sapiens
IRPEYAWIV

SEQ ID NO: 151253 - protein, 9 aa, Homo Sapiens
IRPGTAFEL

SEQ ID NO: 151254 - protein, 9 aa, Homo Sapiens
IRSSYIRVL

SEQ ID NO: 151255 - protein, 9 aa, Homo Sapiens
ISNPNSIIL

SEQ ID NO: 151256 - protein, 9 aa, Homo Sapiens
ITQIEHEVS

SEQ ID NO: 151257 - protein, 9 aa, Homo Sapiens
ITVGHETVM

SEQ ID NO: 151258 - protein, 9 aa, Homo Sapiens
IVMEHVVFL

SEQ ID NO: 151259 - protein, 9 aa, Homo Sapiens
IVMPNILVL

SEQ ID NO: 151260 - protein, 9 aa, Homo Sapiens
IVNEYAFLL

SEQ ID NO: 151261 - protein, 9 aa, Homo Sapiens
IVPGNVKSL

SEQ ID NO: 151262 - protein, 9 aa, Homo Sapiens
IYNTTELVM

SEQ ID NO: 151263 - protein, 9 aa, Homo Sapiens
KAMDDTFYL

SEQ ID NO: 151264 - protein, 9 aa, Homo Sapiens
KANHAELIL

SEQ ID NO: 151265 - protein, 9 aa, Homo Sapiens
KANPALYVL

SEQ ID NO: 151266 - protein, 9 aa, Homo Sapiens
KAPEPLSSL

SEQ ID NO: 151267 - protein, 9 aa, Homo Sapiens
KAPGSTSNL

SEQ ID NO: 151268 - protein, 9 aa, Homo Sapiens
KASDLYITL

SEQ ID NO: 151269 - protein, 9 aa, Homo Sapiens
KDFLKIFTF

SEQ ID NO: 151270 - protein, 9 aa, Homo Sapiens
KDIEHALSV

SEQ ID NO: 151271 - protein, 9 aa, Homo Sapiens
KDLIHDVSF

SEQ ID NO: 151272 - protein, 9 aa, Homo Sapiens
KDNERVVGF

SEQ ID NO: 151273 - protein, 9 aa, Homo Sapiens
KEALPKAAF

SEQ ID NO: 151274 - protein, 9 aa, Homo Sapiens
KECMRALGF

SEQ ID NO: 151275 - protein, 9 aa, Homo Sapiens
KELERVTSL

SEQ ID NO: 151276 - protein, 9 aa, Homo Sapiens
KELLRVAQI

SEQ ID NO: 151277 - protein, 9 aa, Homo Sapiens
KEMLPHVGV

SEQ ID NO: 151278 - protein, 9 aa, Homo Sapiens
KEQERIFQL

SEQ ID NO: 151279 - protein, 9 aa, Homo Sapiens
KEQMRIQSL

SEQ ID NO: 151280 - protein, 9 aa, Homo Sapiens
KEVERILGL

SEQ ID NO: 151281 - protein, 9 aa, Homo Sapiens
KGSGVVIIM

SEQ ID NO: 151282 - protein, 9 aa, Homo Sapiens
KINEAFIEM

SEQ ID NO: 151283 - protein, 9 aa, Homo Sapiens
KINELELRL

SEQ ID NO: 151284 - protein, 9 aa, Homo Sapiens
KINMLVIEL

SEQ ID NO: 151285 - protein, 9 aa, Homo Sapiens
KIPAHRVVL

SEQ ID NO: 151286 - protein, 9 aa, Homo Sapiens
KIPNFCVLL

SEQ ID NO: 151287 - protein, 9 aa, Homo Sapiens
KLHEYFPEM

SEQ ID NO: 151288 - protein, 9 aa, Homo Sapiens
KNTDLWIVM

SEQ ID NO: 151289 - protein, 9 aa, Homo Sapiens
KRCDIILVM

SEQ ID NO: 151290 - protein, 9 aa, Homo Sapiens
KRGDVIYIL

SEQ ID NO: 151291 - protein, 9 aa, Homo Sapiens
KRMQHVICV

SEQ ID NO: 151292 - protein, 9 aa, Homo Sapiens
KRQEAIFEL

SEQ ID NO: 151293 - protein, 9 aa, Homo Sapiens
KRQEVIYEL

SEQ ID NO: 151294 - protein, 9 aa, Homo Sapiens
KRVTWIVEF

SEQ ID NO: 151295 - protein, 9 aa, Homo Sapiens
KSIHIVVTM

SEQ ID NO: 151296 - protein, 9 aa, Homo Sapiens
KSNGTIIHV

SEQ ID NO: 151297 - protein, 9 aa, Homo Sapiens
KSTPVTVVL

SEQ ID NO: 151298 - protein, 9 aa, Homo Sapiens
KVPVHVIRM

SEQ ID NO: 151299 - protein, 9 aa, Homo Sapiens
KVSPNELIL

SEQ ID NO: 151300 - protein, 9 aa, Homo Sapiens
KVSPTEIVL

SEQ ID NO: 151301 - protein, 9 aa, Homo Sapiens
KYKDNPFSL

SEQ ID NO: 151302 - protein, 9 aa, Homo Sapiens
LASPVSPEL

SEQ ID NO: 151303 - protein, 9 aa, Homo Sapiens
LKPPHVILV

SEQ ID NO: 151304 - protein, 9 aa, Homo Sapiens
LLPEHFLFL

SEQ ID NO: 151305 - protein, 9 aa, Homo Sapiens
LNMDHTVVL

SEQ ID NO: 151306 - protein, 9 aa, Homo Sapiens
LQIDNARLA

SEQ ID NO: 151307 - protein, 9 aa, Homo Sapiens
LRHPNIVHM

SEQ ID NO: 151308 - protein, 9 aa, Homo Sapiens
LRHPNIVSL

SEQ ID NO: 151309 - protein, 9 aa, Homo Sapiens
LRPPYQISM

SEQ ID NO: 151310 - protein, 9 aa, Homo Sapiens
LRSDSYVEL

SEQ ID NO: 151311 - protein, 9 aa, Homo Sapiens
LSHPLALHL

SEQ ID NO: 151312 - protein, 9 aa, Homo Sapiens
LVHTEVVEL

SEQ ID NO: 151313 - protein, 9 aa, Homo Sapiens
MANGAVIHL

SEQ ID NO: 151314 - protein, 9 aa, Homo Sapiens
MANPTALLL

SEQ ID NO: 151315 - protein, 9 aa, Homo Sapiens
MAPLKMLAL

SEQ ID NO: 151316 - protein, 9 aa, Homo Sapiens
MLAKHVITL

SEQ ID NO: 151317 - protein, 9 aa, Homo Sapiens
MQNPNAIIL

SEQ ID NO: 151318 - protein, 9 aa, Homo Sapiens
MQSGPKPLF

SEQ ID NO: 151319 - protein, 9 aa, Homo Sapiens
MRNKNIVHM

SEQ ID NO: 151320 - protein, 9 aa, Homo Sapiens
MSSSVVVRL

SEQ ID NO: 151321 - protein, 9 aa, Homo Sapiens
NAHGKIIIL

SEQ ID NO: 151322 - protein, 9 aa, Homo Sapiens
NAHNLALVF

SEQ ID NO: 151323 - protein, 9 aa, Homo Sapiens
NAIGVLIYM

SEQ ID NO: 151324 - protein, 9 aa, Homo Sapiens
NATPDSHIM

SEQ ID NO: 151325 - protein, 9 aa, Homo Sapiens
NAYTGIVLL

SEQ ID NO: 151326 - protein, 9 aa, Homo Sapiens
NGHEFVFLL

SEQ ID NO: 151327 - protein, 9 aa, Homo Sapiens
NLPAHTVII

SEQ ID NO: 151328 - protein, 9 aa, Homo Sapiens
NLPPHIIRL

SEQ ID NO: 151329 - protein, 9 aa, Homo Sapiens
NRGVIITML

SEQ ID NO: 151330 - protein, 9 aa, Homo Sapiens
NRHPNFLVV

SEQ ID NO: 151331 - protein, 9 aa, Homo Sapiens
NRSNTVVIM

SEQ ID NO: 151332 - protein, 9 aa, Homo Sapiens
NSHEMAIVF

SEQ ID NO: 151333 - protein, 9 aa, Homo Sapiens
NSTPAVFTM

SEQ ID NO: 151334 - protein, 9 aa, Homo Sapiens
NVADLVVIL

SEQ ID NO: 151335 - protein, 9 aa, Homo Sapiens
NVSNVNLTL

SEQ ID NO: 151336 - protein, 9 aa, Homo Sapiens
NVTWVIVNL

SEQ ID NO: 151337 - protein, 9 aa, Homo Sapiens
PDLPRNAQV

SEQ ID NO: 151338 - protein, 9 aa, Homo Sapiens
QAIENAHVL

SEQ ID NO: 151339 - protein, 9 aa, Homo Sapiens
QDLERVRNL

SEQ ID NO: 151340 - protein, 9 aa, Homo Sapiens
QDVARVLGF

SEQ ID NO: 151341 - protein, 9 aa, Homo Sapiens
QDVKKIEKF

SEQ ID NO: 151342 - protein, 9 aa, Homo Sapiens
QIPEIKQTL

SEQ ID NO: 151343 - protein, 9 aa, Homo Sapiens
QKPNFVIIL

SEQ ID NO: 151344 - protein, 9 aa, Homo Sapiens
QRPTIYYVM

SEQ ID NO: 151345 - protein, 9 aa, Homo Sapiens
QRQPVYIIM

SEQ ID NO: 151346 - protein, 9 aa, Homo Sapiens
QRSRFIVVV

SEQ ID NO: 151347 - protein, 9 aa, Homo Sapiens
RAAIHVVVL

SEQ ID NO: 151348 - protein, 9 aa, Homo Sapiens
RAAPHRISL

SEQ ID NO: 151349 - protein, 9 aa, Homo Sapiens
RAFDHVLHL

SEQ ID NO: 151350 - protein, 9 aa, Homo Sapiens
RAHPQGLVL

SEQ ID NO: 151351 - protein, 9 aa, Homo Sapiens
RALDHYLTL

SEQ ID NO: 151352 - protein, 9 aa, Homo Sapiens
RAMDQKIIL

SEQ ID NO: 151353 - protein, 9 aa, Homo Sapiens
RANTFVAEL

SEQ ID NO: 151354 - protein, 9 aa, Homo Sapiens
RASQFTIVL

SEQ ID NO: 151355 - protein, 9 aa, Homo Sapiens
RDAFRTLGL

SEQ ID NO: 151356 - protein, 9 aa, Homo Sapiens
RDALVHARL

SEQ ID NO: 151357 - protein, 9 aa, Homo Sapiens
RDEIRPLSF

SEQ ID NO: 151358 - protein, 9 aa, Homo Sapiens
RDHAVVVGV

SEQ ID NO: 151359 - protein, 9 aa, Homo Sapiens
RDLERGVEI

SEQ ID NO: 151360 - protein, 9 aa, Homo Sapiens
RDNLKISDF

SEQ ID NO: 151361 - protein, 9 aa, Homo Sapiens
RDSERLLEV

SEQ ID NO: 151362 - protein, 9 aa, Homo Sapiens
RDVQHIIVF

SEQ ID NO: 151363 - protein, 9 aa, Homo Sapiens
RDVQKVVGF

SEQ ID NO: 151364 - protein, 9 aa, Homo Sapiens
RDYEKAIKF

SEQ ID NO: 151365 - protein, 9 aa, Homo Sapiens
REAPERPSL

SEQ ID NO: 151366 - protein, 9 aa, Homo Sapiens
REDVGKVKF

SEQ ID NO: 151367 - protein, 9 aa, Homo Sapiens
REEKRVLGL

SEQ ID NO: 151368 - protein, 9 aa, Homo Sapiens
REFPKFFTF

SEQ ID NO: 151369 - protein, 9 aa, Homo Sapiens
RELQKLSKF

SEQ ID NO: 151370 - protein, 9 aa, Homo Sapiens
RELYHVISF

SEQ ID NO: 151371 - protein, 9 aa, Homo Sapiens
REMLIRVNM

SEQ ID NO: 151372 - protein, 9 aa, Homo Sapiens
REPNVLICF

SEQ ID NO: 151373 - protein, 9 aa, Homo Sapiens
RESERQLRL

SEQ ID NO: 151374 - protein, 9 aa, Homo Sapiens
RESPRPLQL

SEQ ID NO: 151375 - protein, 9 aa, Homo Sapiens
RGSDVIIML

SEQ ID NO: 151376 - protein, 9 aa, Homo Sapiens
RIMEFTTTL

SEQ ID NO: 151377 - protein, 9 aa, Homo Sapiens
RIPSFVTEL

SEQ ID NO: 151378 - protein, 9 aa, Homo Sapiens
RLAEHIVSM

SEQ ID NO: 151379 - protein, 9 aa, Homo Sapiens
RLPAWQPIL

SEQ ID NO: 151380 - protein, 9 aa, Homo Sapiens
RQPPPRPFL

SEQ ID NO: 151381 - protein, 9 aa, Homo Sapiens
RQRSLFVVV

SEQ ID NO: 151382 - protein, 9 aa, Homo Sapiens
RRGDFIHVM

SEQ ID NO: 151383 - protein, 9 aa, Homo Sapiens
RRIQFPIEM

SEQ ID NO: 151384 - protein, 9 aa, Homo Sapiens
RRNDKIIVF

SEQ ID NO: 151385 - protein, 9 aa, Homo Sapiens
RRQEAIYEM

SEQ ID NO: 151386 - protein, 9 aa, Homo Sapiens
RSDPGHYSF

SEQ ID NO: 151387 - protein, 9 aa, Homo Sapiens
RSNPKIWNV

SEQ ID NO: 151388 - protein, 9 aa, Homo Sapiens
RSPNHIVVL

SEQ ID NO: 151389 - protein, 9 aa, Homo Sapiens
RSPPPGMGL

SEQ ID NO: 151390 - protein, 9 aa, Homo Sapiens
RSQEYKIVL

SEQ ID NO: 151391 - protein, 9 aa, Homo Sapiens
RSSPLTVTM

SEQ ID NO: 151392 - protein, 9 aa, Homo Sapiens
RSTDTVFHM

SEQ ID NO: 151393 - protein, 9 aa, Homo Sapiens
RVMEHFIKL

SEQ ID NO: 151394 - protein, 9 aa, Homo Sapiens
RVQSHILHL

SEQ ID NO: 151395 - protein, 9 aa, Homo Sapiens
RVTDAAFNF

SEQ ID NO: 151396 - protein, 9 aa, Homo Sapiens
RVVSHEVVL

SEQ ID NO: 151397 - protein, 9 aa, Homo Sapiens
SAHGVKLVL

SEQ ID NO: 151398 - protein, 9 aa, Homo Sapiens
SAHLFEVEL

SEQ ID NO: 151399 - protein, 9 aa, Homo Sapiens
SAHQDALIL

SEQ ID NO: 151400 - protein, 9 aa, Homo Sapiens
SAHSHFISL

SEQ ID NO: 151401 - protein, 9 aa, Homo Sapiens
SAIDRIFTL

SEQ ID NO: 151402 - protein, 9 aa, Homo Sapiens
SAIPHPLIM

SEQ ID NO: 151403 - protein, 9 aa, Homo Sapiens
SAISEGTVL

SEQ ID NO: 151404 - protein, 9 aa, Homo Sapiens
SALPFITYL

SEQ ID NO: 151405 - protein, 9 aa, Homo Sapiens
SANNVYLVM

SEQ ID NO: 151406 - protein, 9 aa, Homo Sapiens
SAPASQASL

SEQ ID NO: 151407 - protein, 9 aa, Homo Sapiens
SAPSSDKPL

SEQ ID NO: 151408 - protein, 9 aa, Homo Sapiens
SAPVPASPL

SEQ ID NO: 151409 - protein, 9 aa, Homo Sapiens
SASALAVAL

SEQ ID NO: 151410 - protein, 9 aa, Homo Sapiens
SATFAEIFL

SEQ ID NO: 151411 - protein, 9 aa, Homo Sapiens
SATPVAVTA

SEQ ID NO: 151412 - protein, 9 aa, Homo Sapiens
SATRVYIVL

SEQ ID NO: 151413 - protein, 9 aa, Homo Sapiens
SAVGHVFSL

SEQ ID NO: 151414 - protein, 9 aa, Homo Sapiens
SAVSHFFSL

SEQ ID NO: 151415 - protein, 9 aa, Homo Sapiens
SDHIHIIAL

SEQ ID NO: 151416 - protein, 9 aa, Homo Sapiens
SDLERVTSL

SEQ ID NO: 151417 - protein, 9 aa, Homo Sapiens
SDLKRINGF

SEQ ID NO: 151418 - protein, 9 aa, Homo Sapiens
SDLMRMEKI

SEQ ID NO: 151419 - protein, 9 aa, Homo Sapiens
SDLRHLRAV

SEQ ID NO: 151420 - protein, 9 aa, Homo Sapiens
SDLVRCLSV

SEQ ID NO: 151421 - protein, 9 aa, Homo Sapiens
SDSTHLVTL

SEQ ID NO: 151422 - protein, 9 aa, Homo Sapiens
SDYELKYCF

SEQ ID NO: 151423 - protein, 9 aa, Homo Sapiens
SDYIRCIAV

SEQ ID NO: 151424 - protein, 9 aa, Homo Sapiens
SEFQRLLGF

SEQ ID NO: 151425 - protein, 9 aa, Homo Sapiens
SEGPPLTSF

SEQ ID NO: 151426 - protein, 9 aa, Homo Sapiens
SELIRNVTL

SEQ ID NO: 151427 - protein, 9 aa, Homo Sapiens
SELKHWATF

SEQ ID NO: 151428 - protein, 9 aa, Homo Sapiens
SELVRHSSF

SEQ ID NO: 151429 - protein, 9 aa, Homo Sapiens
SEYARPHVM

SEQ ID NO: 151430 - protein, 9 aa, Homo Sapiens
SGAPHAILL

SEQ ID NO: 151431 - protein, 9 aa, Homo Sapiens
SGDVSLLHL

SEQ ID NO: 151432 - protein, 9 aa, Homo Sapiens
SGHTVVLTM

SEQ ID NO: 151433 - protein, 9 aa, Homo Sapiens
SGPGPAAAL

SEQ ID NO: 151434 - protein, 9 aa, Homo Sapiens
SGQAFELIL

SEQ ID NO: 151435 - protein, 9 aa, Homo Sapiens
SINDKIIEL

SEQ ID NO: 151436 - protein, 9 aa, Homo Sapiens
SIPDFPMHL

SEQ ID NO: 151437 - protein, 9 aa, Homo Sapiens
SIPEFFHIM

SEQ ID NO: 151438 - protein, 9 aa, Homo Sapiens
SISHYVIVM

SEQ ID NO: 151439 - protein, 9 aa, Homo Sapiens
SKPNHTLVL

SEQ ID NO: 151440 - protein, 9 aa, Homo Sapiens
SLMSHAIEL

SEQ ID NO: 151441 - protein, 9 aa, Homo Sapiens
SLPHNIIEL

SEQ ID NO: 151442 - protein, 9 aa, Homo Sapiens
SLSTVFVVL

SEQ ID NO: 151443 - protein, 9 aa, Homo Sapiens
SLTPVTLVL

SEQ ID NO: 151444 - protein, 9 aa, Homo Sapiens
SNTYVMVVM

SEQ ID NO: 151445 - protein, 9 aa, Homo Sapiens
SRGDVKVIM

SEQ ID NO: 151446 - protein, 9 aa, Homo Sapiens
SRITTHFEL

SEQ ID NO: 151447 - protein, 9 aa, Homo Sapiens
SRMLHFLTA

SEQ ID NO: 151448 - protein, 9 aa, Homo Sapiens
SRMVHAIKM

SEQ ID NO: 151449 - protein, 9 aa, Homo Sapiens
SRPALPFIL

SEQ ID NO: 151450 - protein, 9 aa, Homo Sapiens
SRPNIILVM

SEQ ID NO: 151451 - protein, 9 aa, Homo Sapiens
SRPSHYHVL

SEQ ID NO: 151452 - protein, 9 aa, Homo Sapiens
SRQGCTITM

SEQ ID NO: 151453 - protein, 9 aa, Homo Sapiens
SRSHAIFTI

SEQ ID NO: 151454 - protein, 9 aa, Homo Sapiens
SRSHSIFTV

SEQ ID NO: 151455 - protein, 9 aa, Homo Sapiens
SSHELFITL

SEQ ID NO: 151456 - protein, 9 aa, Homo Sapiens
SSHNSSFEL

SEQ ID NO: 151457 - protein, 9 aa, Homo Sapiens
SSHTFVPIL

SEQ ID NO: 151458 - protein, 9 aa, Homo Sapiens
SSLLEKGLD

SEQ ID NO: 151459 - protein, 9 aa, Homo Sapiens
SSNPVYMEM

SEQ ID NO: 151460 - protein, 9 aa, Homo Sapiens
SSNVVQLIM

SEQ ID NO: 151461 - protein, 9 aa, Homo Sapiens
SSSAFRPVM

SEQ ID NO: 151462 - protein, 9 aa, Homo Sapiens
SSSPVNILL

SEQ ID NO: 151463 - protein, 9 aa, Homo Sapiens
SSSPVSVVL

SEQ ID NO: 151464 - protein, 9 aa, Homo Sapiens
STPDHSFSL

SEQ ID NO: 151465 - protein, 9 aa, Homo Sapiens
SVHEKIFTL

SEQ ID NO: 151466 - protein, 9 aa, Homo Sapiens
SVIGFRILL

SEQ ID NO: 151467 - protein, 9 aa, Homo Sapiens
SVIPHILKM

SEQ ID NO: 151468 - protein, 9 aa, Homo Sapiens
SVNPYIVKL

SEQ ID NO: 151469 - protein, 9 aa, Homo Sapiens
SVPDTAFSL

SEQ ID NO: 151470 - protein, 9 aa, Homo Sapiens
SVVQHLIHL

SEQ ID NO: 151471 - protein, 9 aa, Homo Sapiens
SYKDSTLIM

SEQ ID NO: 151472 - protein, 9 aa, Homo Sapiens
TAPQGNVDL

SEQ ID NO: 151473 - protein, 9 aa, Homo Sapiens
TASPVAVSL

SEQ ID NO: 151474 - protein, 9 aa, Homo Sapiens
TDAPHFYGL

SEQ ID NO: 151475 - protein, 9 aa, Homo Sapiens
TDFIKIEEF

SEQ ID NO: 151476 - protein, 9 aa, Homo Sapiens
TDLTRKEGL

SEQ ID NO: 151477 - protein, 9 aa, Homo Sapiens
TDSPREVFF

SEQ ID NO: 151478 - protein, 9 aa, Homo Sapiens
TELERKLTF

SEQ ID NO: 151479 - protein, 9 aa, Homo Sapiens
TGNPTVIKM

SEQ ID NO: 151480 - protein, 9 aa, Homo Sapiens
TIMEKSLVL

SEQ ID NO: 151481 - protein, 9 aa, Homo Sapiens
TISSNVASK

SEQ ID NO: 151482 - protein, 9 aa, Homo Sapiens
TLPWHSLIL

SEQ ID NO: 151483 - protein, 9 aa, Homo Sapiens
TNSPTVIVM

SEQ ID NO: 151484 - protein, 9 aa, Homo Sapiens
TRHPENWTL

SEQ ID NO: 151485 - protein, 9 aa, Homo Sapiens
TRPEKALIL

SEQ ID NO: 151486 - protein, 9 aa, Homo Sapiens
TSAAHQVVL

SEQ ID NO: 151487 - protein, 9 aa, Homo Sapiens
TSHPYRLIL

SEQ ID NO: 151488 - protein, 9 aa, Homo Sapiens
TSIGHVVQL

SEQ ID NO: 151489 - protein, 9 aa, Homo Sapiens
TSSAHYIIL

SEQ ID NO: 151490 - protein, 9 aa, Homo Sapiens
TVILHSIYL

SEQ ID NO: 151491 - protein, 9 aa, Homo Sapiens
TVNGMTITM

SEQ ID NO: 151492 - protein, 9 aa, Homo Sapiens
TVNRTVITM

SEQ ID NO: 151493 - protein, 9 aa, Homo Sapiens
TYMPHVHIL

SEQ ID NO: 151494 - protein, 9 aa, Homo Sapiens
VAAAHSVVL

SEQ ID NO: 151495 - protein, 9 aa, Homo Sapiens
VAMDSIIHM

SEQ ID NO: 151496 - protein, 9 aa, Homo Sapiens
VAMTGEITL

SEQ ID NO: 151497 - protein, 9 aa, Homo Sapiens
VANPEHMEM

SEQ ID NO: 151498 - protein, 9 aa, Homo Sapiens
VAPPGCSHL

SEQ ID NO: 151499 - protein, 9 aa, Homo Sapiens
VASEYPVIL

SEQ ID NO: 151500 - protein, 9 aa, Homo Sapiens
VDHEKIYRM

SEQ ID NO: 151501 - protein, 9 aa, Homo Sapiens
VDHEKPLSF

SEQ ID NO: 151502 - protein, 9 aa, Homo Sapiens
VDLERTIAL

SEQ ID NO: 151503 - protein, 9 aa, Homo Sapiens
VELPHINLL

SEQ ID NO: 151504 - protein, 9 aa, Homo Sapiens
VGGEALELR

SEQ ID NO: 151505 - protein, 9 aa, Homo Sapiens
VGHPFVIQL

SEQ ID NO: 151506 - protein, 9 aa, Homo Sapiens
VINPEPITL

SEQ ID NO: 151507 - protein, 9 aa, Homo Sapiens
VIPESVILL

SEQ ID NO: 151508 - protein, 9 aa, Homo Sapiens
VIPGHLIFL

SEQ ID NO: 151509 - protein, 9 aa, Homo Sapiens
VIQEAFIEL

SEQ ID NO: 151510 - protein, 9 aa, Homo Sapiens
VITGVDIVM

SEQ ID NO: 151511 - protein, 9 aa, Homo Sapiens
VLMDHILNL

SEQ ID NO: 151512 - protein, 9 aa, Homo Sapiens
VNNPHFLIM

SEQ ID NO: 151513 - protein, 9 aa, Homo Sapiens
VQPTHVIHL

SEQ ID NO: 151514 - protein, 9 aa, Homo Sapiens
VRMENVTVL

SEQ ID NO: 151515 - protein, 9 aa, Homo Sapiens
VRNEHFWTL

SEQ ID NO: 151516 - protein, 9 aa, Homo Sapiens
VRNNVIIVM

SEQ ID NO: 151517 - protein, 9 aa, Homo Sapiens
VRNPFTVTV

SEQ ID NO: 151518 - protein, 9 aa, Homo Sapiens
VRNPRITSL

SEQ ID NO: 151519 - protein, 9 aa, Homo Sapiens
VRPSYWLVL

SEQ ID NO: 151520 - protein, 9 aa, Homo Sapiens
VRPTNVLEM

SEQ ID NO: 151521 - protein, 9 aa, Homo Sapiens
VRSPVVHSV

SEQ ID NO: 151522 - protein, 9 aa, Homo Sapiens
VSHDSTVCL

SEQ ID NO: 151523 - protein, 9 aa, Homo Sapiens
VSTWLAIIL

SEQ ID NO: 151524 - protein, 9 aa, Homo Sapiens
VTIKKDVDG

SEQ ID NO: 151525 - protein, 9 aa, Homo Sapiens
VTIPTAHVM

SEQ ID NO: 151526 - protein, 9 aa, Homo Sapiens
VTMPCTWVM

SEQ ID NO: 151527 - protein, 9 aa, Homo Sapiens
VVADHGLTL

SEQ ID NO: 151528 - protein, 9 aa, Homo Sapiens
VVAPHTLKL

SEQ ID NO: 151529 - protein, 9 aa, Homo Sapiens
VVMNVVHQL

SEQ ID NO: 151530 - protein, 9 aa, Homo Sapiens
VVPDHPVLL

SEQ ID NO: 151531 - protein, 9 aa, Homo Sapiens
VYNENLVHM

SEQ ID NO: 151532 - protein, 9 aa, Homo Sapiens
WLPNHVVFL

SEQ ID NO: 151533 - protein, 9 aa, Homo Sapiens
YAAPHFFHL

SEQ ID NO: 151534 - protein, 9 aa, Homo Sapiens
YAHILAVLL

SEQ ID NO: 151535 - protein, 9 aa, Homo Sapiens
YAIESQLQL

SEQ ID NO: 151536 - protein, 9 aa, Homo Sapiens
YAIEVDPVL

SEQ ID NO: 151537 - protein, 9 aa, Homo Sapiens
YANFNRIIL

SEQ ID NO: 151538 - protein, 9 aa, Homo Sapiens
YATDLVVCV

SEQ ID NO: 151539 - protein, 9 aa, Homo Sapiens
YDLLRNTNF

SEQ ID NO: 151540 - protein, 9 aa, Homo Sapiens
YGIEHALAL

SEQ ID NO: 151541 - protein, 9 aa, Homo Sapiens
YGIENEVFL

SEQ ID NO: 151542 - protein, 9 aa, Homo Sapiens
YGNPNTLRL

SEQ ID NO: 151543 - protein, 9 aa, Homo Sapiens
YGSPNALVL

SEQ ID NO: 151544 - protein, 9 aa, Homo Sapiens
YGYEHILTL

SEQ ID NO: 151545 - protein, 9 aa, Homo Sapiens
YIPNKVLIL

SEQ ID NO: 151546 - protein, 9 aa, Homo Sapiens
YIVDHTIIM

SEQ ID NO: 151547 - protein, 9 aa, Homo Sapiens
YKNGWIVMI

SEQ ID NO: 151548 - protein, 9 aa, Homo Sapiens
YLPQHTIET

SEQ ID NO: 151549 - protein, 9 aa, Homo Sapiens
YMIAHITGL

SEQ ID NO: 151550 - protein, 9 aa, Homo Sapiens
YMIDNVILL

SEQ ID NO: 151551 - protein, 9 aa, Homo Sapiens
YMLEHVITL

SEQ ID NO: 151552 - protein, 9 aa, Homo Sapiens
YNQGFEIVL

SEQ ID NO: 151553 - protein, 9 aa, Homo Sapiens
YRHPDPREL

SEQ ID NO: 151554 - protein, 9 aa, Homo Sapiens
YRNAYTMVL

SEQ ID NO: 151555 - protein, 9 aa, Homo Sapiens
YRNPVSQCM

SEQ ID NO: 151556 - protein, 9 aa, Homo Sapiens
YRPAYLVTL

SEQ ID NO: 151557 - protein, 9 aa, Homo Sapiens
YRPLYPFSL

SEQ ID NO: 151558 - protein, 9 aa, Homo Sapiens
YRPNETFHL

SEQ ID NO: 151559 - protein, 9 aa, Homo Sapiens
YRQKQVVIL

SEQ ID NO: 151560 - protein, 9 aa, Homo Sapiens
YRTDMIQAL

SEQ ID NO: 151561 - protein, 9 aa, Homo Sapiens
YRTPTTHTM

SEQ ID NO: 151562 - protein, 9 aa, Homo Sapiens
YSAPVIHVL

SEQ ID NO: 151563 - protein, 9 aa, Homo Sapiens
YSDDIPHAL

SEQ ID NO: 151564 - protein, 9 aa, Homo Sapiens
YSHPGVVFL

SEQ ID NO: 151565 - protein, 9 aa, Homo Sapiens
YSSPFDPVL

SEQ ID NO: 151566 - protein, 9 aa, Homo Sapiens
YSTPHAFTF

SEQ ID NO: 151567 - protein, 9 aa, Homo Sapiens
YTNGKCVIL

SEQ ID NO: 151568 - protein, 9 aa, Homo Sapiens
YTNPSGIVL

SEQ ID NO: 151569 - protein, 9 aa, Homo Sapiens
YTSNIPIIL

SEQ ID NO: 151570 - protein, 9 aa, Homo Sapiens
YVAPKAVWL

SEQ ID NO: 151571 - protein, 9 aa, Homo Sapiens
YVAVTPFSL

SEQ ID NO: 151572 - protein, 9 aa, Homo Sapiens
YVHELSLEM

SEQ ID NO: 151573 - protein, 9 aa, Homo Sapiens
YVHPFIFAL

SEQ ID NO: 151574 - protein, 9 aa, Homo Sapiens
YVIEDDVNM

SEQ ID NO: 151575 - protein, 9 aa, Homo Sapiens
YVINVTTHL

SEQ ID NO: 151576 - protein, 9 aa, Homo Sapiens
YVVPYTIHL

SEQ ID NO: 151577 - protein, 9 aa, Homo Sapiens
YYFVFDHAL

SEQ ID NO: 151578 - protein, 9 aa, Homo Sapiens
YYKPGLLMM

SEQ ID NO: 151579 - protein, 9 aa, Homo Sapiens
YYSPHGHIL

SEQ ID NO: 151580 - protein, 9 aa, Homo Sapiens
YYTDFLITL

SEQ ID NO: 151581 - protein, 10 aa, Homo Sapiens
AELEDLRQRL

SEQ ID NO: 151582 - protein, 10 aa, Homo Sapiens
ARANPFNTPH

SEQ ID NO: 151583 - protein, 10 aa, Homo Sapiens
EEQLQQIRAE

SEQ ID NO: 151584 - protein, 10 aa, Homo Sapiens
FRNPDTIFIL

SEQ ID NO: 151585 - protein, 10 aa, Homo Sapiens
GPPPPPGKPQ

SEQ ID NO: 151586 - protein, 10 aa, Homo Sapiens
IRLENEIQTY

SEQ ID NO: 151587 - protein, 10 aa, Homo Sapiens
LRIEPFTTYF

SEQ ID NO: 151588 - protein, 10 aa, Homo Sapiens
NRQDPFTVHM

SEQ ID NO: 151589 - protein, 10 aa, Homo Sapiens
RNVSTGDVNV

SEQ ID NO: 151590 - protein, 10 aa, Homo Sapiens
SIVGERGRLD

SEQ ID NO: 151591 - protein, 10 aa, Homo Sapiens
SYAGSIPLLI

SEQ ID NO: 151592 - protein, 10 aa, Homo Sapiens
TDGPNERIGM

SEQ ID NO: 151593 - protein, 10 aa, Homo Sapiens
TEKDSYVVAF

SEQ ID NO: 151594 - protein, 10 aa, Homo Sapiens
TISSNVASKA

SEQ ID NO: 151595 - protein, 10 aa, Homo Sapiens
VRPEQPFIVL

SEQ ID NO: 151596 - protein, 10 aa, Homo Sapiens
YAHPLETLIL

SEQ ID NO: 151597 - protein, 10 aa, Homo Sapiens
YGPPGTGKTL

SEQ ID NO: 151598 - protein, 10 aa, Homo Sapiens
YNIVDDHLVV

SEQ ID NO: 151599 - protein, 10 aa, Homo Sapiens
YRKGPPFYHA

SEQ ID NO: 151600 - protein, 10 aa, Homo Sapiens
YTGGSLIPLL

SEQ ID NO: 151601 - protein, 10 aa, Homo Sapiens
YVPPKGDKKG

SEQ ID NO: 151602 - protein, 11 aa, Homo Sapiens
AEQRGELAIKD

SEQ ID NO: 151603 - protein, 11 aa, Homo Sapiens
EGNCPERIITL

SEQ ID NO: 151604 - protein, 11 aa, Homo Sapiens
ESVGKGAVHDV

SEQ ID NO: 151605 - protein, 11 aa, Homo Sapiens
FAYDGKDYLTL

SEQ ID NO: 151606 - protein, 11 aa, Homo Sapiens
GVAGPKGPAGE

SEQ ID NO: 151607 - protein, 11 aa, Homo Sapiens
IDNNIEQISSY

SEQ ID NO: 151608 - protein, 11 aa, Homo Sapiens
ITQIEHEVSSS

SEQ ID NO: 151609 - protein, 11 aa, Homo Sapiens
LASDFEIGHFF

SEQ ID NO: 151610 - protein, 11 aa, Homo Sapiens
REHERLLKHKL

SEQ ID NO: 151611 - protein, 11 aa, Homo Sapiens
SSTISSNVASK

SEQ ID NO: 151612 - protein, 11 aa, Homo Sapiens
TEELNREVATN

SEQ ID NO: 151613 - protein, 11 aa, Homo Sapiens
VAPGKDLTKTL

SEQ ID NO: 151614 - protein, 11 aa, Homo Sapiens
VATTPLGPEHM

SEQ ID NO: 151615 - protein, 11 aa, Homo Sapiens
YQSKYEELQIT

SEQ ID NO: 151616 - protein, 8 aa, Homo Sapiens
AAAPPLTL

SEQ ID NO: 151617 - protein, 8 aa, Homo Sapiens
AAAWPLLL

SEQ ID NO: 151618 - protein, 8 aa, Homo Sapiens
AAPTSSAL

SEQ ID NO: 151619 - protein, 8 aa, Homo Sapiens
AASALPAL

SEQ ID NO: 151620 - protein, 8 aa, Homo Sapiens
AASHPLLL

SEQ ID NO: 151621 - protein, 8 aa, Homo Sapiens
AHSFFDEL

SEQ ID NO: 151622 - protein, 8 aa, Homo Sapiens
APRPAPVA

SEQ ID NO: 151623 - protein, 8 aa, Homo Sapiens
ASHVSPEV

SEQ ID NO: 151624 - protein, 8 aa, Homo Sapiens
ATAEPLCL

SEQ ID NO: 151625 - protein, 8 aa, Homo Sapiens
CAHTNVEL

SEQ ID NO: 151626 - protein, 8 aa, Homo Sapiens
CSSVHPSV

SEQ ID NO: 151627 - protein, 8 aa, Homo Sapiens
CTFVIEAL

SEQ ID NO: 151628 - protein, 8 aa, Homo Sapiens
DGIFKAEL

SEQ ID NO: 151629 - protein, 8 aa, Homo Sapiens
EAQPDLSI

SEQ ID NO: 151630 - protein, 8 aa, Homo Sapiens
FAARPVLL

SEQ ID NO: 151631 - protein, 8 aa, Homo Sapiens
FADAVQEL

SEQ ID NO: 151632 - protein, 8 aa, Homo Sapiens
FAFSSQEL

SEQ ID NO: 151633 - protein, 8 aa, Homo Sapiens
FAGLVQEI

SEQ ID NO: 151634 - protein, 8 aa, Homo Sapiens
FAGMPITL

SEQ ID NO: 151635 - protein, 8 aa, Homo Sapiens
FAGQPLTI

SEQ ID NO: 151636 - protein, 8 aa, Homo Sapiens
FAHGLGEL

SEQ ID NO: 151637 - protein, 8 aa, Homo Sapiens
FAHGNAEL

SEQ ID NO: 151638 - protein, 8 aa, Homo Sapiens
FAHHGRSL

SEQ ID NO: 151639 - protein, 8 aa, Homo Sapiens
FAHSFIEL

SEQ ID NO: 151640 - protein, 8 aa, Homo Sapiens
FALNHPEL

SEQ ID NO: 151641 - protein, 8 aa, Homo Sapiens
FASGAVEL

SEQ ID NO: 151642 - protein, 8 aa, Homo Sapiens
FITDPVVL

SEQ ID NO: 151643 - protein, 8 aa, Homo Sapiens
FLDKALEL

SEQ ID NO: 151644 - protein, 8 aa, Homo Sapiens
FNHINVEL

SEQ ID NO: 151645 - protein, 8 aa, Homo Sapiens
FSFVMPSL

SEQ ID NO: 151646 - protein, 8 aa, Homo Sapiens
FTADPLSL

SEQ ID NO: 151647 - protein, 8 aa, Homo Sapiens
FVNVQKEL

SEQ ID NO: 151648 - protein, 8 aa, Homo Sapiens
FWKEHPEI

SEQ ID NO: 151649 - protein, 8 aa, Homo Sapiens
FYQEHPDL

SEQ ID NO: 151650 - protein, 8 aa, Homo Sapiens
HAAEALLL

SEQ ID NO: 151651 - protein, 8 aa, Homo Sapiens
HPFYTRAA

SEQ ID NO: 151652 - protein, 8 aa, Homo Sapiens
HPTSIVKA

SEQ ID NO: 151653 - protein, 8 aa, Homo Sapiens
HTGPITCL

SEQ ID NO: 151654 - protein, 8 aa, Homo Sapiens
IAGPVVEI

SEQ ID NO: 151655 - protein, 8 aa, Homo Sapiens
ISHESPAV

SEQ ID NO: 151656 - protein, 8 aa, Homo Sapiens
ISHYHETL

SEQ ID NO: 151657 - protein, 8 aa, Homo Sapiens
ISQEHQEL

SEQ ID NO: 151658 - protein, 8 aa, Homo Sapiens
IVGPVVGL

SEQ ID NO: 151659 - protein, 8 aa, Homo Sapiens
KAHLGTAL

SEQ ID NO: 151660 - protein, 8 aa, Homo Sapiens
KSHFIVAL

SEQ ID NO: 151661 - protein, 8 aa, Homo Sapiens
KSQVHPVL

SEQ ID NO: 151662 - protein, 8 aa, Homo Sapiens
LAFVSPSL

SEQ ID NO: 151663 - protein, 8 aa, Homo Sapiens
LAGPALEL

SEQ ID NO: 151664 - protein, 8 aa, Homo Sapiens
LAGPPLEI

SEQ ID NO: 151665 - protein, 8 aa, Homo Sapiens
LAGPVLGL

SEQ ID NO: 151666 - protein, 8 aa, Homo Sapiens
LAGPVQEV

SEQ ID NO: 151667 - protein, 8 aa, Homo Sapiens
LAHEIEAL

SEQ ID NO: 151668 - protein, 8 aa, Homo Sapiens
LAHVGPRL

SEQ ID NO: 151669 - protein, 8 aa, Homo Sapiens
LIGPPLLI

SEQ ID NO: 151670 - protein, 8 aa, Homo Sapiens
LQGPILRL

SEQ ID NO: 151671 - protein, 8 aa, Homo Sapiens
LTAEILEL

SEQ ID NO: 151672 - protein, 8 aa, Homo Sapiens
LTAEVLEL

SEQ ID NO: 151673 - protein, 8 aa, Homo Sapiens
LTGPVLEL

SEQ ID NO: 151674 - protein, 8 aa, Homo Sapiens
MAGPRLEI

SEQ ID NO: 151675 - protein, 8 aa, Homo Sapiens
MPQPVPTA

SEQ ID NO: 151676 - protein, 8 aa, Homo Sapiens
MSQVAPSL

SEQ ID NO: 151677 - protein, 8 aa, Homo Sapiens
NAASPLIV

SEQ ID NO: 151678 - protein, 8 aa, Homo Sapiens
NAGPAIVI

SEQ ID NO: 151679 - protein, 8 aa, Homo Sapiens
NAHIQNEL

SEQ ID NO: 151680 - protein, 8 aa, Homo Sapiens
NSFTHEAL

SEQ ID NO: 151681 - protein, 8 aa, Homo Sapiens
PDQPHPEI

SEQ ID NO: 151682 - protein, 8 aa, Homo Sapiens
QAADVLEL

SEQ ID NO: 151683 - protein, 8 aa, Homo Sapiens
QAAPPIEL

SEQ ID NO: 151684 - protein, 8 aa, Homo Sapiens
RAAPGAEF

SEQ ID NO: 151685 - protein, 8 aa, Homo Sapiens
SAAPAIQL

SEQ ID NO: 151686 - protein, 8 aa, Homo Sapiens
SAHTHVEL

SEQ ID NO: 151687 - protein, 8 aa, Homo Sapiens
SDDIPHAL

SEQ ID NO: 151688 - protein, 8 aa, Homo Sapiens
SPVPVPRA

SEQ ID NO: 151689 - protein, 8 aa, Homo Sapiens
SWFTHPSL

SEQ ID NO: 151690 - protein, 8 aa, Homo Sapiens
TAQNHPML

SEQ ID NO: 151691 - protein, 8 aa, Homo Sapiens
TASEPLTL

SEQ ID NO: 151692 - protein, 8 aa, Homo Sapiens
TDHNLHEL

SEQ ID NO: 151693 - protein, 8 aa, Homo Sapiens
TFLNHPAL

SEQ ID NO: 151694 - protein, 8 aa, Homo Sapiens
TQHLHPSL

SEQ ID NO: 151695 - protein, 8 aa, Homo Sapiens
TTHLSPEL

SEQ ID NO: 151696 - protein, 8 aa, Homo Sapiens
VAAEILEI

SEQ ID NO: 151697 - protein, 8 aa, Homo Sapiens
VAAPILCL

SEQ ID NO: 151698 - protein, 8 aa, Homo Sapiens
VAGPEMQV

SEQ ID NO: 151699 - protein, 8 aa, Homo Sapiens
VAGPSVTL

SEQ ID NO: 151700 - protein, 8 aa, Homo Sapiens
VALDCEIP

SEQ ID NO: 151701 - protein, 8 aa, Homo Sapiens
VATTALEL

SEQ ID NO: 151702 - protein, 8 aa, Homo Sapiens
VAYEAPSL

SEQ ID NO: 151703 - protein, 8 aa, Homo Sapiens
VFFCHGEL

SEQ ID NO: 151704 - protein, 8 aa, Homo Sapiens
VIGPPVVL

SEQ ID NO: 151705 - protein, 8 aa, Homo Sapiens
VPTNIIAA

SEQ ID NO: 151706 - protein, 8 aa, Homo Sapiens
VSGPAMTL

SEQ ID NO: 151707 - protein, 8 aa, Homo Sapiens
VSQVGKEL

SEQ ID NO: 151708 - protein, 8 aa, Homo Sapiens
VTEQGHEL

SEQ ID NO: 151709 - protein, 8 aa, Homo Sapiens
VVAEPVEL

SEQ ID NO: 151710 - protein, 8 aa, Homo Sapiens
VWYESPSL

SEQ ID NO: 151711 - protein, 8 aa, Homo Sapiens
YAAAAEVL

SEQ ID NO: 151712 - protein, 8 aa, Homo Sapiens
YAAQPELL

SEQ ID NO: 151713 - protein, 8 aa, Homo Sapiens
YAGAILEV

SEQ ID NO: 151714 - protein, 8 aa, Homo Sapiens
YGFVNHAL

SEQ ID NO: 151715 - protein, 8 aa, Homo Sapiens
YSLDMWRL

SEQ ID NO: 151716 - protein, 8 aa, Homo Sapiens
YSYVTEEL

SEQ ID NO: 151717 - protein, 8 aa, Homo Sapiens
YTAEPVTL

SEQ ID NO: 151718 - protein, 8 aa, Homo Sapiens
YVSFPLEL

SEQ ID NO: 151719 - protein, 8 aa, Homo Sapiens
YWQNHPEL

SEQ ID NO: 151720 - protein, 9 aa, Homo Sapiens
AAAAANPTL

SEQ ID NO: 151721 - protein, 9 aa, Homo Sapiens
AAAAATMAL

SEQ ID NO: 151722 - protein, 9 aa, Homo Sapiens
AAAALHPAL

SEQ ID NO: 151723 - protein, 9 aa, Homo Sapiens
AAAAPRAVA

SEQ ID NO: 151724 - protein, 9 aa, Homo Sapiens
AAAAPSPVL

SEQ ID NO: 151725 - protein, 9 aa, Homo Sapiens
AAAAPSPVM

SEQ ID NO: 151726 - protein, 9 aa, Homo Sapiens
AAAAVGPAM

SEQ ID NO: 151727 - protein, 9 aa, Homo Sapiens
AAADASPSL

SEQ ID NO: 151728 - protein, 9 aa, Homo Sapiens
AAADITSSL

SEQ ID NO: 151729 - protein, 9 aa, Homo Sapiens
AAADVLEAL

SEQ ID NO: 151730 - protein, 9 aa, Homo Sapiens
AAAGDHVSL

SEQ ID NO: 151731 - protein, 9 aa, Homo Sapiens
AAAGGHEPL

SEQ ID NO: 151732 - protein, 9 aa, Homo Sapiens
AAAGPGEVL

SEQ ID NO: 151733 - protein, 9 aa, Homo Sapiens
AAAHFYFEL

SEQ ID NO: 151734 - protein, 9 aa, Homo Sapiens
AAAKCLLEL

SEQ ID NO: 151735 - protein, 9 aa, Homo Sapiens
AAAKTFEQL

SEQ ID NO: 151736 - protein, 9 aa, Homo Sapiens
AAAPAGTTF

SEQ ID NO: 151737 - protein, 9 aa, Homo Sapiens
AAAPASGAL

SEQ ID NO: 151738 - protein, 9 aa, Homo Sapiens
AAAPASGEM

SEQ ID NO: 151739 - protein, 9 aa, Homo Sapiens
AAAPHLLLL

SEQ ID NO: 151740 - protein, 9 aa, Homo Sapiens
AAAPPAKEI

SEQ ID NO: 151741 - protein, 9 aa, Homo Sapiens
AAAPPAPAA

SEQ ID NO: 151742 - protein, 9 aa, Homo Sapiens
AAAPQLLIV

SEQ ID NO: 151743 - protein, 9 aa, Homo Sapiens
AAAPSLLIL

SEQ ID NO: 151744 - protein, 9 aa, Homo Sapiens
AAAPVLTPA

SEQ ID NO: 151745 - protein, 9 aa, Homo Sapiens
AAAQPQPSV

SEQ ID NO: 151746 - protein, 9 aa, Homo Sapiens
AAASAFTSL

SEQ ID NO: 151747 - protein, 9 aa, Homo Sapiens
AAASHFFNL

SEQ ID NO: 151748 - protein, 9 aa, Homo Sapiens
AAATDFESL

SEQ ID NO: 151749 - protein, 9 aa, Homo Sapiens
AAAYPHTSL

SEQ ID NO: 151750 - protein, 9 aa, Homo Sapiens
AACDILSQL

SEQ ID NO: 151751 - protein, 9 aa, Homo Sapiens
AACDLLQSL

SEQ ID NO: 151752 - protein, 9 aa, Homo Sapiens
AACELLHSM

SEQ ID NO: 151753 - protein, 9 aa, Homo Sapiens
AACETFLKL

SEQ ID NO: 151754 - protein, 9 aa, Homo Sapiens
AACGGHVEL

SEQ ID NO: 151755 - protein, 9 aa, Homo Sapiens
AACNIYSTL

SEQ ID NO: 151756 - protein, 9 aa, Homo Sapiens
AACRVIARL

SEQ ID NO: 151757 - protein, 9 aa, Homo Sapiens
AACSAFATL

SEQ ID NO: 151758 - protein, 9 aa, Homo Sapiens
AADAKPESL

SEQ ID NO: 151759 - protein, 9 aa, Homo Sapiens
AADDIHRSL

SEQ ID NO: 151760 - protein, 9 aa, Homo Sapiens
AADDSKLVL

SEQ ID NO: 151761 - protein, 9 aa, Homo Sapiens
AADDSSVKL

SEQ ID NO: 151762 - protein, 9 aa, Homo Sapiens
AADEITHCI

SEQ ID NO: 151763 - protein, 9 aa, Homo Sapiens
AADETAVQL

SEQ ID NO: 151764 - protein, 9 aa, Homo Sapiens
AADEVLAVL

SEQ ID NO: 151765 - protein, 9 aa, Homo Sapiens
AADFAQMEL

SEQ ID NO: 151766 - protein, 9 aa, Homo Sapiens
AADGKGVVV

SEQ ID NO: 151767 - protein, 9 aa, Homo Sapiens
AADGKLLKL

SEQ ID NO: 151768 - protein, 9 aa, Homo Sapiens
AADGQLHTL

SEQ ID NO: 151769 - protein, 9 aa, Homo Sapiens
AADHTVYKL

SEQ ID NO: 151770 - protein, 9 aa, Homo Sapiens
AADKGVYII

SEQ ID NO: 151771 - protein, 9 aa, Homo Sapiens
AADLGSPSL

SEQ ID NO: 151772 - protein, 9 aa, Homo Sapiens
AADPEAPEI

SEQ ID NO: 151773 - protein, 9 aa, Homo Sapiens
AADPGLHET

SEQ ID NO: 151774 - protein, 9 aa, Homo Sapiens
AADPSVVNL

SEQ ID NO: 151775 - protein, 9 aa, Homo Sapiens
AADPVSPLL

SEQ ID NO: 151776 - protein, 9 aa, Homo Sapiens
AADRCGAAL

SEQ ID NO: 151777 - protein, 9 aa, Homo Sapiens
AADRPGVSL

SEQ ID NO: 151778 - protein, 9 aa, Homo Sapiens
AADSSPSEL

SEQ ID NO: 151779 - protein, 9 aa, Homo Sapiens
AADWHNLIL

SEQ ID NO: 151780 - protein, 9 aa, Homo Sapiens
AADYSQLEL

SEQ ID NO: 151781 - protein, 9 aa, Homo Sapiens
AAEEANAVL

SEQ ID NO: 151782 - protein, 9 aa, Homo Sapiens
AAEEGLREL

SEQ ID NO: 151783 - protein, 9 aa, Homo Sapiens
AAEQSFAEL

SEQ ID NO: 151784 - protein, 9 aa, Homo Sapiens
AAEYGAEAL

SEQ ID NO: 151785 - protein, 9 aa, Homo Sapiens
AAFFAADEL

SEQ ID NO: 151786 - protein, 9 aa, Homo Sapiens
AAFFARDEL

SEQ ID NO: 151787 - protein, 9 aa, Homo Sapiens
AAFGRDLFL

SEQ ID NO: 151788 - protein, 9 aa, Homo Sapiens
AAFHQIEAV

SEQ ID NO: 151789 - protein, 9 aa, Homo Sapiens
AAGPPLVAA

SEQ ID NO: 151790 - protein, 9 aa, Homo Sapiens
AAGPVGMAA

SEQ ID NO: 151791 - protein, 9 aa, Homo Sapiens
AAGPVGPAL

SEQ ID NO: 151792 - protein, 9 aa, Homo Sapiens
AAHALREHL

SEQ ID NO: 151793 - protein, 9 aa, Homo Sapiens
AAHDALVEL

SEQ ID NO: 151794 - protein, 9 aa, Homo Sapiens
AAHLLGSTL

SEQ ID NO: 151795 - protein, 9 aa, Homo Sapiens
AAHLLNDAL

SEQ ID NO: 151796 - protein, 9 aa, Homo Sapiens
AAHVIAEDV

SEQ ID NO: 151797 - protein, 9 aa, Homo Sapiens
AAHWQFETA

SEQ ID NO: 151798 - protein, 9 aa, Homo Sapiens
AAIDHQIEV

SEQ ID NO: 151799 - protein, 9 aa, Homo Sapiens
AAIEDLNAV

SEQ ID NO: 151800 - protein, 9 aa, Homo Sapiens
AAIEGNLQL

SEQ ID NO: 151801 - protein, 9 aa, Homo Sapiens
AAIEIFEKV

SEQ ID NO: 151802 - protein, 9 aa, Homo Sapiens
AAIESGHKL

SEQ ID NO: 151803 - protein, 9 aa, Homo Sapiens
AAIEVHEVL

SEQ ID NO: 151804 - protein, 9 aa, Homo Sapiens
AAIGTDKEL

SEQ ID NO: 151805 - protein, 9 aa, Homo Sapiens
AAIHPSLEI

SEQ ID NO: 151806 - protein, 9 aa, Homo Sapiens
AAIKAFIAV

SEQ ID NO: 151807 - protein, 9 aa, Homo Sapiens
AAIKPGTPL

SEQ ID NO: 151808 - protein, 9 aa, Homo Sapiens
AAILGMHTL

SEQ ID NO: 151809 - protein, 9 aa, Homo Sapiens
AAILPDMAL

SEQ ID NO: 151810 - protein, 9 aa, Homo Sapiens
AAINHYIEA

SEQ ID NO: 151811 - protein, 9 aa, Homo Sapiens
AAINPNHPL

SEQ ID NO: 151812 - protein, 9 aa, Homo Sapiens
AAISQVDRL

SEQ ID NO: 151813 - protein, 9 aa, Homo Sapiens
AAIVEMQEL

SEQ ID NO: 151814 - protein, 9 aa, Homo Sapiens
AALDDGSAL

SEQ ID NO: 151815 - protein, 9 aa, Homo Sapiens
AALDERSTI

SEQ ID NO: 151816 - protein, 9 aa, Homo Sapiens
AALDEYEEL

SEQ ID NO: 151817 - protein, 9 aa, Homo Sapiens
AALDIYETL

SEQ ID NO: 151818 - protein, 9 aa, Homo Sapiens
AALDKATVL

SEQ ID NO: 151819 - protein, 9 aa, Homo Sapiens
AALDVYNAV

SEQ ID NO: 151820 - protein, 9 aa, Homo Sapiens
AALEDKNSL

SEQ ID NO: 151821 - protein, 9 aa, Homo Sapiens
AALFKAWAL

SEQ ID NO: 151822 - protein, 9 aa, Homo Sapiens
AALGPIREL

SEQ ID NO: 151823 - protein, 9 aa, Homo Sapiens
AALKPLETL

SEQ ID NO: 151824 - protein, 9 aa, Homo Sapiens
AALPVYQEL

SEQ ID NO: 151825 - protein, 9 aa, Homo Sapiens
AALQCMHAL

SEQ ID NO: 151826 - protein, 9 aa, Homo Sapiens
AALQDRSIL

SEQ ID NO: 151827 - protein, 9 aa, Homo Sapiens
AALQGDPAL

SEQ ID NO: 151828 - protein, 9 aa, Homo Sapiens
AALVDLDSL

SEQ ID NO: 151829 - protein, 9 aa, Homo Sapiens
AAMDAEIVL

SEQ ID NO: 151830 - protein, 9 aa, Homo Sapiens
AAMEDLTRL

SEQ ID NO: 151831 - protein, 9 aa, Homo Sapiens
AAMEFLQEL

SEQ ID NO: 151832 - protein, 9 aa, Homo Sapiens
AAMKALQAL

SEQ ID NO: 151833 - protein, 9 aa, Homo Sapiens
AAMKLMTAL

SEQ ID NO: 151834 - protein, 9 aa, Homo Sapiens
AAMYKSLEL

SEQ ID NO: 151835 - protein, 9 aa, Homo Sapiens
AANCINIPL

SEQ ID NO: 151836 - protein, 9 aa, Homo Sapiens
AANLLNDAL

SEQ ID NO: 151837 - protein, 9 aa, Homo Sapiens
AAPAYSRAL

SEQ ID NO: 151838 - protein, 9 aa, Homo Sapiens
AAPDGTRNL

SEQ ID NO: 151839 - protein, 9 aa, Homo Sapiens
AAPVPTTTL

SEQ ID NO: 151840 - protein, 9 aa, Homo Sapiens
AAQWQKEEM

SEQ ID NO: 151841 - protein, 9 aa, Homo Sapiens
AASAQLLRL

SEQ ID NO: 151842 - protein, 9 aa, Homo Sapiens
AASGHFICV

SEQ ID NO: 151843 - protein, 9 aa, Homo Sapiens
AASGLPLMV

SEQ ID NO: 151844 - protein, 9 aa, Homo Sapiens
AASKVMVEL

SEQ ID NO: 151845 - protein, 9 aa, Homo Sapiens
AASSSVCKL

SEQ ID NO: 151846 - protein, 9 aa, Homo Sapiens
AASVINQAL

SEQ ID NO: 151847 - protein, 9 aa, Homo Sapiens
AASYISQSL

SEQ ID NO: 151848 - protein, 9 aa, Homo Sapiens
AATAVTQAL

SEQ ID NO: 151849 - protein, 9 aa, Homo Sapiens
AATDIFSYL

SEQ ID NO: 151850 - protein, 9 aa, Homo Sapiens
AATDITSSL

SEQ ID NO: 151851 - protein, 9 aa, Homo Sapiens
AATEEAQAL

SEQ ID NO: 151852 - protein, 9 aa, Homo Sapiens
AATKILTEL

SEQ ID NO: 151853 - protein, 9 aa, Homo Sapiens
AATKVTTVL

SEQ ID NO: 151854 - protein, 9 aa, Homo Sapiens
AATLLHLEL

SEQ ID NO: 151855 - protein, 9 aa, Homo Sapiens
AATSATHEL

SEQ ID NO: 151856 - protein, 9 aa, Homo Sapiens
AATTVLQEL

SEQ ID NO: 151857 - protein, 9 aa, Homo Sapiens
AAVAPGHPL

SEQ ID NO: 151858 - protein, 9 aa, Homo Sapiens
AAVAPVLSI

SEQ ID NO: 151859 - protein, 9 aa, Homo Sapiens
AAVDAGMAM

SEQ ID NO: 151860 - protein, 9 aa, Homo Sapiens
AAVDPDSGL

SEQ ID NO: 151861 - protein, 9 aa, Homo Sapiens
AAVDQSECL

SEQ ID NO: 151862 - protein, 9 aa, Homo Sapiens
AAVDRTTEL

SEQ ID NO: 151863 - protein, 9 aa, Homo Sapiens
AAVDTNLTL

SEQ ID NO: 151864 - protein, 9 aa, Homo Sapiens
AAVEPDVVV

SEQ ID NO: 151865 - protein, 9 aa, Homo Sapiens
AAVKATQTL

SEQ ID NO: 151866 - protein, 9 aa, Homo Sapiens
AAVNVICEL

SEQ ID NO: 151867 - protein, 9 aa, Homo Sapiens
AAVPPAEEL

SEQ ID NO: 151868 - protein, 9 aa, Homo Sapiens
AAVRDISEA

SEQ ID NO: 151869 - protein, 9 aa, Homo Sapiens
AAWLQVLPV

SEQ ID NO: 151870 - protein, 9 aa, Homo Sapiens
AAYGHRLCL

SEQ ID NO: 151871 - protein, 9 aa, Homo Sapiens
AAYYHPSYL

SEQ ID NO: 151872 - protein, 9 aa, Homo Sapiens
AGADPSDPL

SEQ ID NO: 151873 - protein, 9 aa, Homo Sapiens
AGWEGTESL

SEQ ID NO: 151874 - protein, 9 aa, Homo Sapiens
AIAAVFHTL

SEQ ID NO: 151875 - protein, 9 aa, Homo Sapiens
AIIALFHLL

SEQ ID NO: 151876 - protein, 9 aa, Homo Sapiens
ALFTCEMLV

SEQ ID NO: 151877 - protein, 9 aa, Homo Sapiens
APAPAAHVA

SEQ ID NO: 151878 - protein, 9 aa, Homo Sapiens
APAPPKAEA

SEQ ID NO: 151879 - protein, 9 aa, Homo Sapiens
APGYSYTAA

SEQ ID NO: 151880 - protein, 9 aa, Homo Sapiens
APIQSEPRV

SEQ ID NO: 151881 - protein, 9 aa, Homo Sapiens
APKAGPGVV

SEQ ID NO: 151882 - protein, 9 aa, Homo Sapiens
APMPPIIHA

SEQ ID NO: 151883 - protein, 9 aa, Homo Sapiens
APRLQSEVA

SEQ ID NO: 151884 - protein, 9 aa, Homo Sapiens
APRPPVSAA

SEQ ID NO: 151885 - protein, 9 aa, Homo Sapiens
APRQPGLMA

SEQ ID NO: 151886 - protein, 9 aa, Homo Sapiens
APRTVALTA

SEQ ID NO: 151887 - protein, 9 aa, Homo Sapiens
APSVGIKAA

SEQ ID NO: 151888 - protein, 9 aa, Homo Sapiens
APTGDLPRA

SEQ ID NO: 151889 - protein, 9 aa, Homo Sapiens
APVPTAPAA

SEQ ID NO: 151890 - protein, 9 aa, Homo Sapiens
AQAEVYKEL

SEQ ID NO: 151891 - protein, 9 aa, Homo Sapiens
AQCVIYHEL

SEQ ID NO: 151892 - protein, 9 aa, Homo Sapiens
AQYEHDLEV

SEQ ID NO: 151893 - protein, 9 aa, Homo Sapiens
ARAGVVLEM

SEQ ID NO: 151894 - protein, 9 aa, Homo Sapiens
ASAAVLLTL

SEQ ID NO: 151895 - protein, 9 aa, Homo Sapiens
ASAPPGPPA

SEQ ID NO: 151896 - protein, 9 aa, Homo Sapiens
ASDDHTICL

SEQ ID NO: 151897 - protein, 9 aa, Homo Sapiens
ASDDHTVCL

SEQ ID NO: 151898 - protein, 9 aa, Homo Sapiens
ASDKETYEL

SEQ ID NO: 151899 - protein, 9 aa, Homo Sapiens
ASFFDRNTL

SEQ ID NO: 151900 - protein, 9 aa, Homo Sapiens
ASHGFYEFL

SEQ ID NO: 151901 - protein, 9 aa, Homo Sapiens
ASHIQLDSL

SEQ ID NO: 151902 - protein, 9 aa, Homo Sapiens
ASHLNLDAL

SEQ ID NO: 151903 - protein, 9 aa, Homo Sapiens
ASIPYFHAM

SEQ ID NO: 151904 - protein, 9 aa, Homo Sapiens
ASLLIQQAL

SEQ ID NO: 151905 - protein, 9 aa, Homo Sapiens
ASPSSIRSL

SEQ ID NO: 151906 - protein, 9 aa, Homo Sapiens
ASSPEHPEL

SEQ ID NO: 151907 - protein, 9 aa, Homo Sapiens
ASYTGAETL

SEQ ID NO: 151908 - protein, 9 aa, Homo Sapiens
ATDDSLHQL

SEQ ID NO: 151909 - protein, 9 aa, Homo Sapiens
AVADTLLVL

SEQ ID NO: 151910 - protein, 9 aa, Homo Sapiens
AVCGYLVEL

SEQ ID NO: 151911 - protein, 9 aa, Homo Sapiens
AVDGNTVEL

SEQ ID NO: 151912 - protein, 9 aa, Homo Sapiens
AVIGSTEEL

SEQ ID NO: 151913 - protein, 9 aa, Homo Sapiens
CAHSFFDEL

SEQ ID NO: 151914 - protein, 9 aa, Homo Sapiens
CAIAQAESL

SEQ ID NO: 151915 - protein, 9 aa, Homo Sapiens
CAIPDLGPA

SEQ ID NO: 151916 - protein, 9 aa, Homo Sapiens
CSIHDNSVL

SEQ ID NO: 151917 - protein, 9 aa, Homo Sapiens
EAAPDGPAL

SEQ ID NO: 151918 - protein, 9 aa, Homo Sapiens
EACGVIVEL

SEQ ID NO: 151919 - protein, 9 aa, Homo Sapiens
FAAASREVL

SEQ ID NO: 151920 - protein, 9 aa, Homo Sapiens
FAADIISVL

SEQ ID NO: 151921 - protein, 9 aa, Homo Sapiens
FAADLAEEL

SEQ ID NO: 151922 - protein, 9 aa, Homo Sapiens
FAADVRLMF

SEQ ID NO: 151923 - protein, 9 aa, Homo Sapiens
FAALHGPAL

SEQ ID NO: 151924 - protein, 9 aa, Homo Sapiens
FAANVYEAF

SEQ ID NO: 151925 - protein, 9 aa, Homo Sapiens
FACEKNENL

SEQ ID NO: 151926 - protein, 9 aa, Homo Sapiens
FACEVLYNI

SEQ ID NO: 151927 - protein, 9 aa, Homo Sapiens
FACPKTDSL

SEQ ID NO: 151928 - protein, 9 aa, Homo Sapiens
FADAGLVCI

SEQ ID NO: 151929 - protein, 9 aa, Homo Sapiens
FADALEVIP

SEQ ID NO: 151930 - protein, 9 aa, Homo Sapiens
FADCAILLL

SEQ ID NO: 151931 - protein, 9 aa, Homo Sapiens
FADDPCSSV

SEQ ID NO: 151932 - protein, 9 aa, Homo Sapiens
FADELSHLL

SEQ ID NO: 151933 - protein, 9 aa, Homo Sapiens
FADFERHFL

SEQ ID NO: 151934 - protein, 9 aa, Homo Sapiens
FADGHVLEL

SEQ ID NO: 151935 - protein, 9 aa, Homo Sapiens
FADGKVYAL

SEQ ID NO: 151936 - protein, 9 aa, Homo Sapiens
FADGVYLVL

SEQ ID NO: 151937 - protein, 9 aa, Homo Sapiens
FADHVSSSL

SEQ ID NO: 151938 - protein, 9 aa, Homo Sapiens
FADHVVPLL

SEQ ID NO: 151939 - protein, 9 aa, Homo Sapiens
FADKHIQVL

SEQ ID NO: 151940 - protein, 9 aa, Homo Sapiens
FADKTLLEL

SEQ ID NO: 151941 - protein, 9 aa, Homo Sapiens
FADNPGPMV

SEQ ID NO: 151942 - protein, 9 aa, Homo Sapiens
FADPIAANL

SEQ ID NO: 151943 - protein, 9 aa, Homo Sapiens
FADQAEILL

SEQ ID NO: 151944 - protein, 9 aa, Homo Sapiens
FADQEVRSL

SEQ ID NO: 151945 - protein, 9 aa, Homo Sapiens
FADQTAVQL

SEQ ID NO: 151946 - protein, 9 aa, Homo Sapiens
FADREVQLL

SEQ ID NO: 151947 - protein, 9 aa, Homo Sapiens
FADVAPLQL

SEQ ID NO: 151948 - protein, 9 aa, Homo Sapiens
FADYLAHES

SEQ ID NO: 151949 - protein, 9 aa, Homo Sapiens
FADYNLLDL

SEQ ID NO: 151950 - protein, 9 aa, Homo Sapiens
FADYPCHTV

SEQ ID NO: 151951 - protein, 9 aa, Homo Sapiens
FADYRPTEV

SEQ ID NO: 151952 - protein, 9 aa, Homo Sapiens
FAEAGRSTL

SEQ ID NO: 151953 - protein, 9 aa, Homo Sapiens
FAEDPPTSL

SEQ ID NO: 151954 - protein, 9 aa, Homo Sapiens
FAEEPGLVL

SEQ ID NO: 151955 - protein, 9 aa, Homo Sapiens
FAEESYQKL

SEQ ID NO: 151956 - protein, 9 aa, Homo Sapiens
FAEEVGAAL

SEQ ID NO: 151957 - protein, 9 aa, Homo Sapiens
FAFLISERL

SEQ ID NO: 151958 - protein, 9 aa, Homo Sapiens
FAGDDAPRA

SEQ ID NO: 151959 - protein, 9 aa, Homo Sapiens
FAGYSEEVL

SEQ ID NO: 151960 - protein, 9 aa, Homo Sapiens
FAHCLELTV

SEQ ID NO: 151961 - protein, 9 aa, Homo Sapiens
FAHHLPVWL

SEQ ID NO: 151962 - protein, 9 aa, Homo Sapiens
FAHIDGDHL

SEQ ID NO: 151963 - protein, 9 aa, Homo Sapiens
FAHPPLLVL

SEQ ID NO: 151964 - protein, 9 aa, Homo Sapiens
FAHPYQYEL

SEQ ID NO: 151965 - protein, 9 aa, Homo Sapiens
FAHRIWDTL

SEQ ID NO: 151966 - protein, 9 aa, Homo Sapiens
FAHTNVESL

SEQ ID NO: 151967 - protein, 9 aa, Homo Sapiens
FAHVIFQNV

SEQ ID NO: 151968 - protein, 9 aa, Homo Sapiens
FAIDIGGSL

SEQ ID NO: 151969 - protein, 9 aa, Homo Sapiens
FAIDPHLLL

SEQ ID NO: 151970 - protein, 9 aa, Homo Sapiens
FAIPGSSFL

SEQ ID NO: 151971 - protein, 9 aa, Homo Sapiens
FAIPLIEKL

SEQ ID NO: 151972 - protein, 9 aa, Homo Sapiens
FAIPMIHAV

SEQ ID NO: 151973 - protein, 9 aa, Homo Sapiens
FAISILQQI

SEQ ID NO: 151974 - protein, 9 aa, Homo Sapiens
FALDSGLEI

SEQ ID NO: 151975 - protein, 9 aa, Homo Sapiens
FALNLFKHL

SEQ ID NO: 151976 - protein, 9 aa, Homo Sapiens
FALPILNAL

SEQ ID NO: 151977 - protein, 9 aa, Homo Sapiens
FALSKDASL

SEQ ID NO: 151978 - protein, 9 aa, Homo Sapiens
FAMAGHENL

SEQ ID NO: 151979 - protein, 9 aa, Homo Sapiens
FAMDVYKNL

SEQ ID NO: 151980 - protein, 9 aa, Homo Sapiens
FAMEIDPSL

SEQ ID NO: 151981 - protein, 9 aa, Homo Sapiens
FAMPYFIQV

SEQ ID NO: 151982 - protein, 9 aa, Homo Sapiens
FANDDRHVM

SEQ ID NO: 151983 - protein, 9 aa, Homo Sapiens
FANLIKEFV

SEQ ID NO: 151984 - protein, 9 aa, Homo Sapiens
FAQEAISVL

SEQ ID NO: 151985 - protein, 9 aa, Homo Sapiens
FAQEALTVL

SEQ ID NO: 151986 - protein, 9 aa, Homo Sapiens
FAQGDVITL

SEQ ID NO: 151987 - protein, 9 aa, Homo Sapiens
FAQTLHPSL

SEQ ID NO: 151988 - protein, 9 aa, Homo Sapiens
FASDVQFVL

SEQ ID NO: 151989 - protein, 9 aa, Homo Sapiens
FASEVSNVL

SEQ ID NO: 151990 - protein, 9 aa, Homo Sapiens
FASFPHMVL

SEQ ID NO: 151991 - protein, 9 aa, Homo Sapiens
FASHVSPEV

SEQ ID NO: 151992 - protein, 9 aa, Homo Sapiens
FASSFKIVL

SEQ ID NO: 151993 - protein, 9 aa, Homo Sapiens
FASTMVHAL

SEQ ID NO: 151994 - protein, 9 aa, Homo Sapiens
FASYMEQHL

SEQ ID NO: 151995 - protein, 9 aa, Homo Sapiens
FATADEYHL

SEQ ID NO: 151996 - protein, 9 aa, Homo Sapiens
FATEVRAVI

SEQ ID NO: 151997 - protein, 9 aa, Homo Sapiens
FATGSADAL

SEQ ID NO: 151998 - protein, 9 aa, Homo Sapiens
FAVATPEEL

SEQ ID NO: 151999 - protein, 9 aa, Homo Sapiens
FAVEEGDHL

SEQ ID NO: 152000 - protein, 9 aa, Homo Sapiens
FAVHPEPEA

SEQ ID NO: 152001 - protein, 9 aa, Homo Sapiens
FAVLEDHTL

SEQ ID NO: 152002 - protein, 9 aa, Homo Sapiens
FAVNMFRTL

SEQ ID NO: 152003 - protein, 9 aa, Homo Sapiens
FAVPENSSV

SEQ ID NO: 152004 - protein, 9 aa, Homo Sapiens
FAVPESDHL

SEQ ID NO: 152005 - protein, 9 aa, Homo Sapiens
FAVSDGLEL

SEQ ID NO: 152006 - protein, 9 aa, Homo Sapiens
FAVVPSTAT

SEQ ID NO: 152007 - protein, 9 aa, Homo Sapiens
FAYEGPMYL

SEQ ID NO: 152008 - protein, 9 aa, Homo Sapiens
FAYPAPLEV

SEQ ID NO: 152009 - protein, 9 aa, Homo Sapiens
FAYVEGESL

SEQ ID NO: 152010 - protein, 9 aa, Homo Sapiens
FGHIFNDAL

SEQ ID NO: 152011 - protein, 9 aa, Homo Sapiens
FGHVQRAEM

SEQ ID NO: 152012 - protein, 9 aa, Homo Sapiens
FGHYQQAEL

SEQ ID NO: 152013 - protein, 9 aa, Homo Sapiens
FGIDRPAEL

SEQ ID NO: 152014 - protein, 9 aa, Homo Sapiens
FGLNIFHQL

SEQ ID NO: 152015 - protein, 9 aa, Homo Sapiens
FGSEFSPEL

SEQ ID NO: 152016 - protein, 9 aa, Homo Sapiens
FGVDPDKEL

SEQ ID NO: 152017 - protein, 9 aa, Homo Sapiens
FGVIPSTPL

SEQ ID NO: 152018 - protein, 9 aa, Homo Sapiens
FGYDKDTSL

SEQ ID NO: 152019 - protein, 9 aa, Homo Sapiens
FGYDKPHVL

SEQ ID NO: 152020 - protein, 9 aa, Homo Sapiens
FIADHCPTL

SEQ ID NO: 152021 - protein, 9 aa, Homo Sapiens
FIAPTGHSL

SEQ ID NO: 152022 - protein, 9 aa, Homo Sapiens
FICNIFDYL

SEQ ID NO: 152023 - protein, 9 aa, Homo Sapiens
FICPITREL

SEQ ID NO: 152024 - protein, 9 aa, Homo Sapiens
FIDDANYSV

SEQ ID NO: 152025 - protein, 9 aa, Homo Sapiens
FIDGHFVEM

SEQ ID NO: 152026 - protein, 9 aa, Homo Sapiens
FIEDAVHVL

SEQ ID NO: 152027 - protein, 9 aa, Homo Sapiens
FIESAHTEL

SEQ ID NO: 152028 - protein, 9 aa, Homo Sapiens
FIFSDTHEL

SEQ ID NO: 152029 - protein, 9 aa, Homo Sapiens
FIHQHFVEV

SEQ ID NO: 152030 - protein, 9 aa, Homo Sapiens
FIIDDKGIL

SEQ ID NO: 152031 - protein, 9 aa, Homo Sapiens
FIISDFESV

SEQ ID NO: 152032 - protein, 9 aa, Homo Sapiens
FIISRTQAL

SEQ ID NO: 152033 - protein, 9 aa, Homo Sapiens
FIIYDTHSL

SEQ ID NO: 152034 - protein, 9 aa, Homo Sapiens
FISHLFMQL

SEQ ID NO: 152035 - protein, 9 aa, Homo Sapiens
FIVEETLPL

SEQ ID NO: 152036 - protein, 9 aa, Homo Sapiens
FIVSDESIL

SEQ ID NO: 152037 - protein, 9 aa, Homo Sapiens
FLAHIYTEL

SEQ ID NO: 152038 - protein, 9 aa, Homo Sapiens
FLCPFHLSV

SEQ ID NO: 152039 - protein, 9 aa, Homo Sapiens
FLDDNQIIT

SEQ ID NO: 152040 - protein, 9 aa, Homo Sapiens
FLDDNQIVT

SEQ ID NO: 152041 - protein, 9 aa, Homo Sapiens
FLDDVNLIL

SEQ ID NO: 152042 - protein, 9 aa, Homo Sapiens
FLDEKTHEL

SEQ ID NO: 152043 - protein, 9 aa, Homo Sapiens
FLDGNELTL

SEQ ID NO: 152044 - protein, 9 aa, Homo Sapiens
FLDGNEMTL

SEQ ID NO: 152045 - protein, 9 aa, Homo Sapiens
FLDSTSPLL

SEQ ID NO: 152046 - protein, 9 aa, Homo Sapiens
FLFSKFIEL

SEQ ID NO: 152047 - protein, 9 aa, Homo Sapiens
FLIRESETL

SEQ ID NO: 152048 - protein, 9 aa, Homo Sapiens
FLPDHPIVL

SEQ ID NO: 152049 - protein, 9 aa, Homo Sapiens
FLVPTFEQL

SEQ ID NO: 152050 - protein, 9 aa, Homo Sapiens
FLYPFPLAL

SEQ ID NO: 152051 - protein, 9 aa, Homo Sapiens
FMSLLEDTL

SEQ ID NO: 152052 - protein, 9 aa, Homo Sapiens
FNDSTRLIL

SEQ ID NO: 152053 - protein, 9 aa, Homo Sapiens
FQCQTKLEL

SEQ ID NO: 152054 - protein, 9 aa, Homo Sapiens
FQDHTKLIL

SEQ ID NO: 152055 - protein, 9 aa, Homo Sapiens
FQDPVPLTV

SEQ ID NO: 152056 - protein, 9 aa, Homo Sapiens
FQEADSPTL

SEQ ID NO: 152057 - protein, 9 aa, Homo Sapiens
FQVNHTVAL

SEQ ID NO: 152058 - protein, 9 aa, Homo Sapiens
FRVPTANVS

SEQ ID NO: 152059 - protein, 9 aa, Homo Sapiens
FSCGVISTL

SEQ ID NO: 152060 - protein, 9 aa, Homo Sapiens
FSDDSDLQL

SEQ ID NO: 152061 - protein, 9 aa, Homo Sapiens
FSDLTMHEL

SEQ ID NO: 152062 - protein, 9 aa, Homo Sapiens
FSDPESQTL

SEQ ID NO: 152063 - protein, 9 aa, Homo Sapiens
FSDPIHPQL

SEQ ID NO: 152064 - protein, 9 aa, Homo Sapiens
FSEETPVVL

SEQ ID NO: 152065 - protein, 9 aa, Homo Sapiens
FSEPFHLIV

SEQ ID NO: 152066 - protein, 9 aa, Homo Sapiens
FSFDGPEIM

SEQ ID NO: 152067 - protein, 9 aa, Homo Sapiens
FSFPEPEAL

SEQ ID NO: 152068 - protein, 9 aa, Homo Sapiens
FSFYFHEAL

SEQ ID NO: 152069 - protein, 9 aa, Homo Sapiens
FSHAQTVVL

SEQ ID NO: 152070 - protein, 9 aa, Homo Sapiens
FSHGQVVSL

SEQ ID NO: 152071 - protein, 9 aa, Homo Sapiens
FSHTQVIEL

SEQ ID NO: 152072 - protein, 9 aa, Homo Sapiens
FSHYMEENL

SEQ ID NO: 152073 - protein, 9 aa, Homo Sapiens
FSIDSPDSL

SEQ ID NO: 152074 - protein, 9 aa, Homo Sapiens
FSIEPWLKV

SEQ ID NO: 152075 - protein, 9 aa, Homo Sapiens
FSIGADTAL

SEQ ID NO: 152076 - protein, 9 aa, Homo Sapiens
FSITPLSEL

SEQ ID NO: 152077 - protein, 9 aa, Homo Sapiens
FSLDDVEVL

SEQ ID NO: 152078 - protein, 9 aa, Homo Sapiens
FSLDLVHTL

SEQ ID NO: 152079 - protein, 9 aa, Homo Sapiens
FSLPHPEAL

SEQ ID NO: 152080 - protein, 9 aa, Homo Sapiens
FSNVFEHYL

SEQ ID NO: 152081 - protein, 9 aa, Homo Sapiens
FSQALQHAL

SEQ ID NO: 152082 - protein, 9 aa, Homo Sapiens
FSQVIPVSL

SEQ ID NO: 152083 - protein, 9 aa, Homo Sapiens
FSSDVTHEM

SEQ ID NO: 152084 - protein, 9 aa, Homo Sapiens
FSSSDFSDL

SEQ ID NO: 152085 - protein, 9 aa, Homo Sapiens
FSVGADTAL

SEQ ID NO: 152086 - protein, 9 aa, Homo Sapiens
FSYAFPKAV

SEQ ID NO: 152087 - protein, 9 aa, Homo Sapiens
FTAPATVSL

SEQ ID NO: 152088 - protein, 9 aa, Homo Sapiens
FTDDQLLVL

SEQ ID NO: 152089 - protein, 9 aa, Homo Sapiens
FTEWLHEVL

SEQ ID NO: 152090 - protein, 9 aa, Homo Sapiens
FTFIFCHEL

SEQ ID NO: 152091 - protein, 9 aa, Homo Sapiens
FTSAAFHEL

SEQ ID NO: 152092 - protein, 9 aa, Homo Sapiens
FVADVRLIF

SEQ ID NO: 152093 - protein, 9 aa, Homo Sapiens
FVAEGGPEL

SEQ ID NO: 152094 - protein, 9 aa, Homo Sapiens
FVAETHIVL

SEQ ID NO: 152095 - protein, 9 aa, Homo Sapiens
FVALPGVAV

SEQ ID NO: 152096 - protein, 9 aa, Homo Sapiens
FVAPPTAAV

SEQ ID NO: 152097 - protein, 9 aa, Homo Sapiens
FVCDIRPEI

SEQ ID NO: 152098 - protein, 9 aa, Homo Sapiens
FVCPTEIVA

SEQ ID NO: 152099 - protein, 9 aa, Homo Sapiens
FVDELRITL

SEQ ID NO: 152100 - protein, 9 aa, Homo Sapiens
FVDGSAIQV

SEQ ID NO: 152101 - protein, 9 aa, Homo Sapiens
FVDPAQITM

SEQ ID NO: 152102 - protein, 9 aa, Homo Sapiens
FVDQCKTVL

SEQ ID NO: 152103 - protein, 9 aa, Homo Sapiens
FVDRSLLTL

SEQ ID NO: 152104 - protein, 9 aa, Homo Sapiens
FVFDERYAL

SEQ ID NO: 152105 - protein, 9 aa, Homo Sapiens
FVFPGELLL

SEQ ID NO: 152106 - protein, 9 aa, Homo Sapiens
FVHAQCLEL

SEQ ID NO: 152107 - protein, 9 aa, Homo Sapiens
FVHDLVLYL

SEQ ID NO: 152108 - protein, 9 aa, Homo Sapiens
FVIDEAHCV

SEQ ID NO: 152109 - protein, 9 aa, Homo Sapiens
FVIDLQTRL

SEQ ID NO: 152110 - protein, 9 aa, Homo Sapiens
FVINEVCEM

SEQ ID NO: 152111 - protein, 9 aa, Homo Sapiens
FVIPVVQAL

SEQ ID NO: 152112 - protein, 9 aa, Homo Sapiens
FVMETFVHL

SEQ ID NO: 152113 - protein, 9 aa, Homo Sapiens
FVNDIFERI

SEQ ID NO: 152114 - protein, 9 aa, Homo Sapiens
FVYEDMEAL

SEQ ID NO: 152115 - protein, 9 aa, Homo Sapiens
FVYGESVEL

SEQ ID NO: 152116 - protein, 9 aa, Homo Sapiens
GADPSTVEM

SEQ ID NO: 152117 - protein, 9 aa, Homo Sapiens
GATAAAPVP

SEQ ID NO: 152118 - protein, 9 aa, Homo Sapiens
GAVDPLLAL

SEQ ID NO: 152119 - protein, 9 aa, Homo Sapiens
GAVEPICSV

SEQ ID NO: 152120 - protein, 9 aa, Homo Sapiens
GAVPIFIEL

SEQ ID NO: 152121 - protein, 9 aa, Homo Sapiens
GPLVAMILA

SEQ ID NO: 152122 - protein, 9 aa, Homo Sapiens
HAAASFETL

SEQ ID NO: 152123 - protein, 9 aa, Homo Sapiens
HAAHIISEL

SEQ ID NO: 152124 - protein, 9 aa, Homo Sapiens
HAASVFLTL

SEQ ID NO: 152125 - protein, 9 aa, Homo Sapiens
HACALAASL

SEQ ID NO: 152126 - protein, 9 aa, Homo Sapiens
HACGVIATI

SEQ ID NO: 152127 - protein, 9 aa, Homo Sapiens
HACPLLSTL

SEQ ID NO: 152128 - protein, 9 aa, Homo Sapiens
HADDSFLVL

SEQ ID NO: 152129 - protein, 9 aa, Homo Sapiens
HADHSSLTL

SEQ ID NO: 152130 - protein, 9 aa, Homo Sapiens
HADPEPSVI

SEQ ID NO: 152131 - protein, 9 aa, Homo Sapiens
HADPTELAL

SEQ ID NO: 152132 - protein, 9 aa, Homo Sapiens
HAHTIKPAL

SEQ ID NO: 152133 - protein, 9 aa, Homo Sapiens
HAIEESVVL

SEQ ID NO: 152134 - protein, 9 aa, Homo Sapiens
HAIPPTLAM

SEQ ID NO: 152135 - protein, 9 aa, Homo Sapiens
HALDYADEL

SEQ ID NO: 152136 - protein, 9 aa, Homo Sapiens
HAMVILLTL

SEQ ID NO: 152137 - protein, 9 aa, Homo Sapiens
HASDAYTAL

SEQ ID NO: 152138 - protein, 9 aa, Homo Sapiens
HAVGPSTAM

SEQ ID NO: 152139 - protein, 9 aa, Homo Sapiens
HAVGPSTSL

SEQ ID NO: 152140 - protein, 9 aa, Homo Sapiens
HAVSDPSIL

SEQ ID NO: 152141 - protein, 9 aa, Homo Sapiens
HAYDGKDYI

SEQ ID NO: 152142 - protein, 9 aa, Homo Sapiens
HICMVFEVL

SEQ ID NO: 152143 - protein, 9 aa, Homo Sapiens
HICQLYHVL

SEQ ID NO: 152144 - protein, 9 aa, Homo Sapiens
HIDPNFASL

SEQ ID NO: 152145 - protein, 9 aa, Homo Sapiens
HIIEDPCTL

SEQ ID NO: 152146 - protein, 9 aa, Homo Sapiens
HPYRLILTV

SEQ ID NO: 152147 - protein, 9 aa, Homo Sapiens
HSMLDINAL

SEQ ID NO: 152148 - protein, 9 aa, Homo Sapiens
HSNTIVVSL

SEQ ID NO: 152149 - protein, 9 aa, Homo Sapiens
HVDGHLYEL

SEQ ID NO: 152150 - protein, 9 aa, Homo Sapiens
HVDSTWLLL

SEQ ID NO: 152151 - protein, 9 aa, Homo Sapiens
IAAGIFNDL

SEQ ID NO: 152152 - protein, 9 aa, Homo Sapiens
IAAGVCGAL

SEQ ID NO: 152153 - protein, 9 aa, Homo Sapiens
IAAMPLISL

SEQ ID NO: 152154 - protein, 9 aa, Homo Sapiens
IAAPELETL

SEQ ID NO: 152155 - protein, 9 aa, Homo Sapiens
IAAPTSSAL

SEQ ID NO: 152156 - protein, 9 aa, Homo Sapiens
IAAVTDIPL

SEQ ID NO: 152157 - protein, 9 aa, Homo Sapiens
IADDTRVVV

SEQ ID NO: 152158 - protein, 9 aa, Homo Sapiens
IADEAFYGL

SEQ ID NO: 152159 - protein, 9 aa, Homo Sapiens
IADEGTYTL

SEQ ID NO: 152160 - protein, 9 aa, Homo Sapiens
IADGLCLEV

SEQ ID NO: 152161 - protein, 9 aa, Homo Sapiens
IADGLPVAV

SEQ ID NO: 152162 - protein, 9 aa, Homo Sapiens
IADHYMQVL

SEQ ID NO: 152163 - protein, 9 aa, Homo Sapiens
IADNVFLFL

SEQ ID NO: 152164 - protein, 9 aa, Homo Sapiens
IADPDQPVL

SEQ ID NO: 152165 - protein, 9 aa, Homo Sapiens
IADPNIAKL

SEQ ID NO: 152166 - protein, 9 aa, Homo Sapiens
IADPRGNTL

SEQ ID NO: 152167 - protein, 9 aa, Homo Sapiens
IADPTLAEM

SEQ ID NO: 152168 - protein, 9 aa, Homo Sapiens
IADSNPMVV

SEQ ID NO: 152169 - protein, 9 aa, Homo Sapiens
IADSPSPAV

SEQ ID NO: 152170 - protein, 9 aa, Homo Sapiens
IADTNFDVL

SEQ ID NO: 152171 - protein, 9 aa, Homo Sapiens
IAFPTSISV

SEQ ID NO: 152172 - protein, 9 aa, Homo Sapiens
IAGEFKEQL

SEQ ID NO: 152173 - protein, 9 aa, Homo Sapiens
IAHELGHSL

SEQ ID NO: 152174 - protein, 9 aa, Homo Sapiens
IAHFLDRHL

SEQ ID NO: 152175 - protein, 9 aa, Homo Sapiens
IAHLEITAL

SEQ ID NO: 152176 - protein, 9 aa, Homo Sapiens
IAHNMQSTL

SEQ ID NO: 152177 - protein, 9 aa, Homo Sapiens
IAIAPNGAL

SEQ ID NO: 152178 - protein, 9 aa, Homo Sapiens
IAIEDPFSV

SEQ ID NO: 152179 - protein, 9 aa, Homo Sapiens
IAIEDPYSV

SEQ ID NO: 152180 - protein, 9 aa, Homo Sapiens
IALDKDAPL

SEQ ID NO: 152181 - protein, 9 aa, Homo Sapiens
IALGEFSTL

SEQ ID NO: 152182 - protein, 9 aa, Homo Sapiens
IAMDLILKM

SEQ ID NO: 152183 - protein, 9 aa, Homo Sapiens
IAQDFKTDL

SEQ ID NO: 152184 - protein, 9 aa, Homo Sapiens
IAQGSYIAL

SEQ ID NO: 152185 - protein, 9 aa, Homo Sapiens
IASAIVNEL

SEQ ID NO: 152186 - protein, 9 aa, Homo Sapiens
IASPVIAAV

SEQ ID NO: 152187 - protein, 9 aa, Homo Sapiens
IASPVQPVL

SEQ ID NO: 152188 - protein, 9 aa, Homo Sapiens
IATDDITEL

SEQ ID NO: 152189 - protein, 9 aa, Homo Sapiens
IATELLKLN

SEQ ID NO: 152190 - protein, 9 aa, Homo Sapiens
IAVEAQEIL

SEQ ID NO: 152191 - protein, 9 aa, Homo Sapiens
IAYLIVKEL

SEQ ID NO: 152192 - protein, 9 aa, Homo Sapiens
IGAPVGISL

SEQ ID NO: 152193 - protein, 9 aa, Homo Sapiens
IIDDPNLVV

SEQ ID NO: 152194 - protein, 9 aa, Homo Sapiens
IIDDTIFNL

SEQ ID NO: 152195 - protein, 9 aa, Homo Sapiens
IIDDVMKEL

SEQ ID NO: 152196 - protein, 9 aa, Homo Sapiens
IIDETMAQL

SEQ ID NO: 152197 - protein, 9 aa, Homo Sapiens
IIDRTNTTL

SEQ ID NO: 152198 - protein, 9 aa, Homo Sapiens
IIFEDDRCL

SEQ ID NO: 152199 - protein, 9 aa, Homo Sapiens
IITDFDMTL

SEQ ID NO: 152200 - protein, 9 aa, Homo Sapiens
IITKAYLEV

SEQ ID NO: 152201 - protein, 9 aa, Homo Sapiens
IITTVGPEL

SEQ ID NO: 152202 - protein, 9 aa, Homo Sapiens
IIVDIFHGL

SEQ ID NO: 152203 - protein, 9 aa, Homo Sapiens
IIYDIMNEL

SEQ ID NO: 152204 - protein, 9 aa, Homo Sapiens
ILADCTLIL

SEQ ID NO: 152205 - protein, 9 aa, Homo Sapiens
ILDPHVVLL

SEQ ID NO: 152206 - protein, 9 aa, Homo Sapiens
INKKEGICA

SEQ ID NO: 152207 - protein, 9 aa, Homo Sapiens
IPFYGILGA

SEQ ID NO: 152208 - protein, 9 aa, Homo Sapiens
IPHLVTHDA

SEQ ID NO: 152209 - protein, 9 aa, Homo Sapiens
IQCEIFQVL

SEQ ID NO: 152210 - protein, 9 aa, Homo Sapiens
IQRTPKIQV

SEQ ID NO: 152211 - protein, 9 aa, Homo Sapiens
ISCKEELLL

SEQ ID NO: 152212 - protein, 9 aa, Homo Sapiens
ISDPFIFNL

SEQ ID NO: 152213 - protein, 9 aa, Homo Sapiens
ISDTQRISL

SEQ ID NO: 152214 - protein, 9 aa, Homo Sapiens
ISFECSEAL

SEQ ID NO: 152215 - protein, 9 aa, Homo Sapiens
ISFFIGQEL

SEQ ID NO: 152216 - protein, 9 aa, Homo Sapiens
ISHCYPEYL

SEQ ID NO: 152217 - protein, 9 aa, Homo Sapiens
ISHVIVDEI

SEQ ID NO: 152218 - protein, 9 aa, Homo Sapiens
ISISDHTAL

SEQ ID NO: 152219 - protein, 9 aa, Homo Sapiens
ISQVFEIAL

SEQ ID NO: 152220 - protein, 9 aa, Homo Sapiens
ISSLLEEQF

SEQ ID NO: 152221 - protein, 9 aa, Homo Sapiens
ISSPVVTSL

SEQ ID NO: 152222 - protein, 9 aa, Homo Sapiens
ISVASFQEL

SEQ ID NO: 152223 - protein, 9 aa, Homo Sapiens
ITAPPGTAA

SEQ ID NO: 152224 - protein, 9 aa, Homo Sapiens
ITAPPSRVL

SEQ ID NO: 152225 - protein, 9 aa, Homo Sapiens
ITDPSVIVM

SEQ ID NO: 152226 - protein, 9 aa, Homo Sapiens
ITHLLGVAL

SEQ ID NO: 152227 - protein, 9 aa, Homo Sapiens
ITTDCLQIL

SEQ ID NO: 152228 - protein, 9 aa, Homo Sapiens
ITTEVVNEL

SEQ ID NO: 152229 - protein, 9 aa, Homo Sapiens
ITYDDRFNL

SEQ ID NO: 152230 - protein, 9 aa, Homo Sapiens
IVDNTTMQL

SEQ ID NO: 152231 - protein, 9 aa, Homo Sapiens
IVDQVMVTL

SEQ ID NO: 152232 - protein, 9 aa, Homo Sapiens
IVIDPKNPL

SEQ ID NO: 152233 - protein, 9 aa, Homo Sapiens
IVIGVLHQL

SEQ ID NO: 152234 - protein, 9 aa, Homo Sapiens
IVKPVKVSA

SEQ ID NO: 152235 - protein, 9 aa, Homo Sapiens
KAAAAKVEL

SEQ ID NO: 152236 - protein, 9 aa, Homo Sapiens
KAADIDQEV

SEQ ID NO: 152237 - protein, 9 aa, Homo Sapiens
KAADTIEAL

SEQ ID NO: 152238 - protein, 9 aa, Homo Sapiens
KAAELEMEL

SEQ ID NO: 152239 - protein, 9 aa, Homo Sapiens
KAASVRPVL

SEQ ID NO: 152240 - protein, 9 aa, Homo Sapiens
KACDYIQEL

SEQ ID NO: 152241 - protein, 9 aa, Homo Sapiens
KACDYIREL

SEQ ID NO: 152242 - protein, 9 aa, Homo Sapiens
KACFLYFKL

SEQ ID NO: 152243 - protein, 9 aa, Homo Sapiens
KADAVVPEL

SEQ ID NO: 152244 - protein, 9 aa, Homo Sapiens
KADGVGPPL

SEQ ID NO: 152245 - protein, 9 aa, Homo Sapiens
KADGVPVYL

SEQ ID NO: 152246 - protein, 9 aa, Homo Sapiens
KADMNVHLL

SEQ ID NO: 152247 - protein, 9 aa, Homo Sapiens
KADNVGSAL

SEQ ID NO: 152248 - protein, 9 aa, Homo Sapiens
KADPQGPEL

SEQ ID NO: 152249 - protein, 9 aa, Homo Sapiens
KADPSHFEL

SEQ ID NO: 152250 - protein, 9 aa, Homo Sapiens
KADSVVVLL

SEQ ID NO: 152251 - protein, 9 aa, Homo Sapiens
KAFADPEVL

SEQ ID NO: 152252 - protein, 9 aa, Homo Sapiens
KAFADSSYL

SEQ ID NO: 152253 - protein, 9 aa, Homo Sapiens
KAFFDRSSL

SEQ ID NO: 152254 - protein, 9 aa, Homo Sapiens
KAFFTSKAL

SEQ ID NO: 152255 - protein, 9 aa, Homo Sapiens
KAFNDPSAL

SEQ ID NO: 152256 - protein, 9 aa, Homo Sapiens
KAFQKIVVL

SEQ ID NO: 152257 - protein, 9 aa, Homo Sapiens
KAFSDCSAL

SEQ ID NO: 152258 - protein, 9 aa, Homo Sapiens
KAFSDHSSL

SEQ ID NO: 152259 - protein, 9 aa, Homo Sapiens
KAFTQTSHL

SEQ ID NO: 152260 - protein, 9 aa, Homo Sapiens
KAFVFSVAL

SEQ ID NO: 152261 - protein, 9 aa, Homo Sapiens
KAHLMEIQV

SEQ ID NO: 152262 - protein, 9 aa, Homo Sapiens
KAHVFECNL

SEQ ID NO: 152263 - protein, 9 aa, Homo Sapiens
KAIDIYEQV

SEQ ID NO: 152264 - protein, 9 aa, Homo Sapiens
KAIDLMNAL

SEQ ID NO: 152265 - protein, 9 aa, Homo Sapiens
KAIEQADLL

SEQ ID NO: 152266 - protein, 9 aa, Homo Sapiens
KAIEVLLTL

SEQ ID NO: 152267 - protein, 9 aa, Homo Sapiens
KAIGLFISF

SEQ ID NO: 152268 - protein, 9 aa, Homo Sapiens
KAIGPHDVL

SEQ ID NO: 152269 - protein, 9 aa, Homo Sapiens
KAINVFVSA

SEQ ID NO: 152270 - protein, 9 aa, Homo Sapiens
KAIQDTNNL

SEQ ID NO: 152271 - protein, 9 aa, Homo Sapiens
KAIRPQIDL

SEQ ID NO: 152272 - protein, 9 aa, Homo Sapiens
KAIRPYHAL

SEQ ID NO: 152273 - protein, 9 aa, Homo Sapiens
KAISGVHTV

SEQ ID NO: 152274 - protein, 9 aa, Homo Sapiens
KALEEANAL

SEQ ID NO: 152275 - protein, 9 aa, Homo Sapiens
KALGIDNVL

SEQ ID NO: 152276 - protein, 9 aa, Homo Sapiens
KALSIFNEL

SEQ ID NO: 152277 - protein, 9 aa, Homo Sapiens
KAMDDTFYL

SEQ ID NO: 152278 - protein, 9 aa, Homo Sapiens
KAMELIREL

SEQ ID NO: 152279 - protein, 9 aa, Homo Sapiens
KAPGSTSNL

SEQ ID NO: 152280 - protein, 9 aa, Homo Sapiens
KAQLQQVEA

SEQ ID NO: 152281 - protein, 9 aa, Homo Sapiens
KASAVYQAL

SEQ ID NO: 152282 - protein, 9 aa, Homo Sapiens
KASDLYITL

SEQ ID NO: 152283 - protein, 9 aa, Homo Sapiens
KASIEHEAL

SEQ ID NO: 152284 - protein, 9 aa, Homo Sapiens
KASIIFVTL

SEQ ID NO: 152285 - protein, 9 aa, Homo Sapiens
KAVDNTCKL

SEQ ID NO: 152286 - protein, 9 aa, Homo Sapiens
KAVEHLDDL

SEQ ID NO: 152287 - protein, 9 aa, Homo Sapiens
KAVEIYASV

SEQ ID NO: 152288 - protein, 9 aa, Homo Sapiens
KAVNPDEAV

SEQ ID NO: 152289 - protein, 9 aa, Homo Sapiens
KAVNPGRSL

SEQ ID NO: 152290 - protein, 9 aa, Homo Sapiens
KAYYAGHVL

SEQ ID NO: 152291 - protein, 9 aa, Homo Sapiens
KICDQWDAL

SEQ ID NO: 152292 - protein, 9 aa, Homo Sapiens
KICDVGVSL

SEQ ID NO: 152293 - protein, 9 aa, Homo Sapiens
KICEVDLVI

SEQ ID NO: 152294 - protein, 9 aa, Homo Sapiens
KIDRLILEL

SEQ ID NO: 152295 - protein, 9 aa, Homo Sapiens
KIIDIFTTL

SEQ ID NO: 152296 - protein, 9 aa, Homo Sapiens
KIIESEEEL

SEQ ID NO: 152297 - protein, 9 aa, Homo Sapiens
KILDTFEKL

SEQ ID NO: 152298 - protein, 9 aa, Homo Sapiens
KILNDDTAL

SEQ ID NO: 152299 - protein, 9 aa, Homo Sapiens
KITECLSEL

SEQ ID NO: 152300 - protein, 9 aa, Homo Sapiens
KITEDFRAL

SEQ ID NO: 152301 - protein, 9 aa, Homo Sapiens
KLCDVTLKI

SEQ ID NO: 152302 - protein, 9 aa, Homo Sapiens
KPANVFITA

SEQ ID NO: 152303 - protein, 9 aa, Homo Sapiens
KPFKEFVEA

SEQ ID NO: 152304 - protein, 9 aa, Homo Sapiens
KPKEPQPEV

SEQ ID NO: 152305 - protein, 9 aa, Homo Sapiens
KPKPIGKLA

SEQ ID NO: 152306 - protein, 9 aa, Homo Sapiens
KPMKSVLVV

SEQ ID NO: 152307 - protein, 9 aa, Homo Sapiens
KQFVQWDEL

SEQ ID NO: 152308 - protein, 9 aa, Homo Sapiens
KQWLMTEAL

SEQ ID NO: 152309 - protein, 9 aa, Homo Sapiens
KSCDLLLFL

SEQ ID NO: 152310 - protein, 9 aa, Homo Sapiens
KSDPSIVRL

SEQ ID NO: 152311 - protein, 9 aa, Homo Sapiens
KSEGNHPAL

SEQ ID NO: 152312 - protein, 9 aa, Homo Sapiens
KSNTLPISL

SEQ ID NO: 152313 - protein, 9 aa, Homo Sapiens
KSYDDAESL

SEQ ID NO: 152314 - protein, 9 aa, Homo Sapiens
KTDEMHTAL

SEQ ID NO: 152315 - protein, 9 aa, Homo Sapiens
KTPDFILQV

SEQ ID NO: 152316 - protein, 9 aa, Homo Sapiens
KTTTPGPSL

SEQ ID NO: 152317 - protein, 9 aa, Homo Sapiens
KTVDNFVAL

SEQ ID NO: 152318 - protein, 9 aa, Homo Sapiens
KVADLVLML

SEQ ID NO: 152319 - protein, 9 aa, Homo Sapiens
KVDEAVAVL

SEQ ID NO: 152320 - protein, 9 aa, Homo Sapiens
KVVDPDHPL

SEQ ID NO: 152321 - protein, 9 aa, Homo Sapiens
LAAARLAAA

SEQ ID NO: 152322 - protein, 9 aa, Homo Sapiens
LAADCAHEL

SEQ ID NO: 152323 - protein, 9 aa, Homo Sapiens
LAADIHQAL

SEQ ID NO: 152324 - protein, 9 aa, Homo Sapiens
LAAGPSAAA

SEQ ID NO: 152325 - protein, 9 aa, Homo Sapiens
LAAHIPLFL

SEQ ID NO: 152326 - protein, 9 aa, Homo Sapiens
LAAPVISVL

SEQ ID NO: 152327 - protein, 9 aa, Homo Sapiens
LAASVFTCL

SEQ ID NO: 152328 - protein, 9 aa, Homo Sapiens
LAATPHSLP

SEQ ID NO: 152329 - protein, 9 aa, Homo Sapiens
LADDSVRSL

SEQ ID NO: 152330 - protein, 9 aa, Homo Sapiens
LADEAFFSV

SEQ ID NO: 152331 - protein, 9 aa, Homo Sapiens
LADETLLKV

SEQ ID NO: 152332 - protein, 9 aa, Homo Sapiens
LADGLKVVL

SEQ ID NO: 152333 - protein, 9 aa, Homo Sapiens
LADGSIAVL

SEQ ID NO: 152334 - protein, 9 aa, Homo Sapiens
LADGVPVAL

SEQ ID NO: 152335 - protein, 9 aa, Homo Sapiens
LADHTVHVL

SEQ ID NO: 152336 - protein, 9 aa, Homo Sapiens
LADPGIITI

SEQ ID NO: 152337 - protein, 9 aa, Homo Sapiens
LADPHAQLL

SEQ ID NO: 152338 - protein, 9 aa, Homo Sapiens
LADRNVTVL

SEQ ID NO: 152339 - protein, 9 aa, Homo Sapiens
LADVIIHEI

SEQ ID NO: 152340 - protein, 9 aa, Homo Sapiens
LADVTHLLL

SEQ ID NO: 152341 - protein, 9 aa, Homo Sapiens
LAFPGEMLL

SEQ ID NO: 152342 - protein, 9 aa, Homo Sapiens
LAFSRALEL

SEQ ID NO: 152343 - protein, 9 aa, Homo Sapiens
LAIDAIHQL

SEQ ID NO: 152344 - protein, 9 aa, Homo Sapiens
LAIDTEERL

SEQ ID NO: 152345 - protein, 9 aa, Homo Sapiens
LAIESANEL

SEQ ID NO: 152346 - protein, 9 aa, Homo Sapiens
LAIGPCKSL

SEQ ID NO: 152347 - protein, 9 aa, Homo Sapiens
LAIHGMETL

SEQ ID NO: 152348 - protein, 9 aa, Homo Sapiens
LAIVPVNTL

SEQ ID NO: 152349 - protein, 9 aa, Homo Sapiens
LALAIAQEL

SEQ ID NO: 152350 - protein, 9 aa, Homo Sapiens
LALFPGVAL

SEQ ID NO: 152351 - protein, 9 aa, Homo Sapiens
LAMEPTPEL

SEQ ID NO: 152352 - protein, 9 aa, Homo Sapiens
LAMRPLASL

SEQ ID NO: 152353 - protein, 9 aa, Homo Sapiens
LANIIYYSL

SEQ ID NO: 152354 - protein, 9 aa, Homo Sapiens
LAQAMETAL

SEQ ID NO: 152355 - protein, 9 aa, Homo Sapiens
LASEIYDIL

SEQ ID NO: 152356 - protein, 9 aa, Homo Sapiens
LASEPQEVL

SEQ ID NO: 152357 - protein, 9 aa, Homo Sapiens
LASPVSPEL

SEQ ID NO: 152358 - protein, 9 aa, Homo Sapiens
LATDVQTVA

SEQ ID NO: 152359 - protein, 9 aa, Homo Sapiens
LATRAIPEL

SEQ ID NO: 152360 - protein, 9 aa, Homo Sapiens
LAVDKSASL

SEQ ID NO: 152361 - protein, 9 aa, Homo Sapiens
LAVDPNRAV

SEQ ID NO: 152362 - protein, 9 aa, Homo Sapiens
LAVPDMSSL

SEQ ID NO: 152363 - protein, 9 aa, Homo Sapiens
LAVRDVSEL

SEQ ID NO: 152364 - protein, 9 aa, Homo Sapiens
LAVTDTGAL

SEQ ID NO: 152365 - protein, 9 aa, Homo Sapiens
LAWLDEHTL

SEQ ID NO: 152366 - protein, 9 aa, Homo Sapiens
LAYCQSEEL

SEQ ID NO: 152367 - protein, 9 aa, Homo Sapiens
LAYHLAVVL

SEQ ID NO: 152368 - protein, 9 aa, Homo Sapiens
LAYLQRIAL

SEQ ID NO: 152369 - protein, 9 aa, Homo Sapiens
LGFERFHAL

SEQ ID NO: 152370 - protein, 9 aa, Homo Sapiens
LIDDLQHCL

SEQ ID NO: 152371 - protein, 9 aa, Homo Sapiens
LIKPESKVA

SEQ ID NO: 152372 - protein, 9 aa, Homo Sapiens
LIVEPSREL

SEQ ID NO: 152373 - protein, 9 aa, Homo Sapiens
LLCNLDIIL

SEQ ID NO: 152374 - protein, 9 aa, Homo Sapiens
LLPPRAATL

SEQ ID NO: 152375 - protein, 9 aa, Homo Sapiens
LLSDTKLEL

SEQ ID NO: 152376 - protein, 9 aa, Homo Sapiens
LLSDVRFVL

SEQ ID NO: 152377 - protein, 9 aa, Homo Sapiens
LMQLLQESL

SEQ ID NO: 152378 - protein, 9 aa, Homo Sapiens
LPASETPKA

SEQ ID NO: 152379 - protein, 9 aa, Homo Sapiens
LPKPPGRGV

SEQ ID NO: 152380 - protein, 9 aa, Homo Sapiens
LPLSLLKTA

SEQ ID NO: 152381 - protein, 9 aa, Homo Sapiens
LPRKPVAGA

SEQ ID NO: 152382 - protein, 9 aa, Homo Sapiens
LPWQGLKAA

SEQ ID NO: 152383 - protein, 9 aa, Homo Sapiens
LSAPLIGAL

SEQ ID NO: 152384 - protein, 9 aa, Homo Sapiens
LSDDHVLIL

SEQ ID NO: 152385 - protein, 9 aa, Homo Sapiens
LSDETLLEI

SEQ ID NO: 152386 - protein, 9 aa, Homo Sapiens
LSDPQVHTV

SEQ ID NO: 152387 - protein, 9 aa, Homo Sapiens
LSHLLAIGL

SEQ ID NO: 152388 - protein, 9 aa, Homo Sapiens
LSHLQQDSL

SEQ ID NO: 152389 - protein, 9 aa, Homo Sapiens
LSHSLLVTL

SEQ ID NO: 152390 - protein, 9 aa, Homo Sapiens
LSLFIDDKL

SEQ ID NO: 152391 - protein, 9 aa, Homo Sapiens
LSSPPTESL

SEQ ID NO: 152392 - protein, 9 aa, Homo Sapiens
LSYLEKEAL

SEQ ID NO: 152393 - protein, 9 aa, Homo Sapiens
LTDANIHEL

SEQ ID NO: 152394 - protein, 9 aa, Homo Sapiens
LTDDTLQEL

SEQ ID NO: 152395 - protein, 9 aa, Homo Sapiens
LTDGHPLTL

SEQ ID NO: 152396 - protein, 9 aa, Homo Sapiens
LTDQTLIYL

SEQ ID NO: 152397 - protein, 9 aa, Homo Sapiens
LTTEVHPEL

SEQ ID NO: 152398 - protein, 9 aa, Homo Sapiens
LTVEPGASL

SEQ ID NO: 152399 - protein, 9 aa, Homo Sapiens
LVAPPLPAA

SEQ ID NO: 152400 - protein, 9 aa, Homo Sapiens
LVDDHFVEL

SEQ ID NO: 152401 - protein, 9 aa, Homo Sapiens
LVDDNYFYL

SEQ ID NO: 152402 - protein, 9 aa, Homo Sapiens
LVDENFTEL

SEQ ID NO: 152403 - protein, 9 aa, Homo Sapiens
LVDGQIFCL

SEQ ID NO: 152404 - protein, 9 aa, Homo Sapiens
MAAEPYETI

SEQ ID NO: 152405 - protein, 9 aa, Homo Sapiens
MAAPVDLEL

SEQ ID NO: 152406 - protein, 9 aa, Homo Sapiens
MACDTFIKI

SEQ ID NO: 152407 - protein, 9 aa, Homo Sapiens
MADGNQAQL

SEQ ID NO: 152408 - protein, 9 aa, Homo Sapiens
MADKCSPTL

SEQ ID NO: 152409 - protein, 9 aa, Homo Sapiens
MADPEVQQI

SEQ ID NO: 152410 - protein, 9 aa, Homo Sapiens
MADSGHYCV

SEQ ID NO: 152411 - protein, 9 aa, Homo Sapiens
MAFHQEHEV

SEQ ID NO: 152412 - protein, 9 aa, Homo Sapiens
MAHADPTEL

SEQ ID NO: 152413 - protein, 9 aa, Homo Sapiens
MAHGLFHEL

SEQ ID NO: 152414 - protein, 9 aa, Homo Sapiens
MAHSLATTL

SEQ ID NO: 152415 - protein, 9 aa, Homo Sapiens
MAIADEVEI

SEQ ID NO: 152416 - protein, 9 aa, Homo Sapiens
MAVIDGNVM

SEQ ID NO: 152417 - protein, 9 aa, Homo Sapiens
MAVQPKETL

SEQ ID NO: 152418 - protein, 9 aa, Homo Sapiens
MIDDTYQCL

SEQ ID NO: 152419 - protein, 9 aa, Homo Sapiens
MIIENFEAL

SEQ ID NO: 152420 - protein, 9 aa, Homo Sapiens
MQAPLLIAL

SEQ ID NO: 152421 - protein, 9 aa, Homo Sapiens
MSADVPLVV

SEQ ID NO: 152422 - protein, 9 aa, Homo Sapiens
MSCLLEVAL

SEQ ID NO: 152423 - protein, 9 aa, Homo Sapiens
MSHLLEMCV

SEQ ID NO: 152424 - protein, 9 aa, Homo Sapiens
MSSDVFPLL

SEQ ID NO: 152425 - protein, 9 aa, Homo Sapiens
MSVQPTVSL

SEQ ID NO: 152426 - protein, 9 aa, Homo Sapiens
MTCLSHPLQ

SEQ ID NO: 152427 - protein, 9 aa, Homo Sapiens
MTDGAQQAL

SEQ ID NO: 152428 - protein, 9 aa, Homo Sapiens
MVDGTLLLL

SEQ ID NO: 152429 - protein, 9 aa, Homo Sapiens
MVVDIVQEL

SEQ ID NO: 152430 - protein, 9 aa, Homo Sapiens
NAAAIYDLL

SEQ ID NO: 152431 - protein, 9 aa, Homo Sapiens
NAAGVMHYL

SEQ ID NO: 152432 - protein, 9 aa, Homo Sapiens
NAAMVFEFL

SEQ ID NO: 152433 - protein, 9 aa, Homo Sapiens
NAANIFERL

SEQ ID NO: 152434 - protein, 9 aa, Homo Sapiens
NACGLYHKM

SEQ ID NO: 152435 - protein, 9 aa, Homo Sapiens
NACGLYYKL

SEQ ID NO: 152436 - protein, 9 aa, Homo Sapiens
NADAIVVKL

SEQ ID NO: 152437 - protein, 9 aa, Homo Sapiens
NADETPICL

SEQ ID NO: 152438 - protein, 9 aa, Homo Sapiens
NADHTTLLL

SEQ ID NO: 152439 - protein, 9 aa, Homo Sapiens
NADPASHEI

SEQ ID NO: 152440 - protein, 9 aa, Homo Sapiens
NADPQAVTM

SEQ ID NO: 152441 - protein, 9 aa, Homo Sapiens
NADSQFWSL

SEQ ID NO: 152442 - protein, 9 aa, Homo Sapiens
NADSSNTAL

SEQ ID NO: 152443 - protein, 9 aa, Homo Sapiens
NADSSVQLL

SEQ ID NO: 152444 - protein, 9 aa, Homo Sapiens
NAENIFHSM

SEQ ID NO: 152445 - protein, 9 aa, Homo Sapiens
NAEPEPRSL

SEQ ID NO: 152446 - protein, 9 aa, Homo Sapiens
NAFDIAEEL

SEQ ID NO: 152447 - protein, 9 aa, Homo Sapiens
NAFSGVMML

SEQ ID NO: 152448 - protein, 9 aa, Homo Sapiens
NAIDDGCVV

SEQ ID NO: 152449 - protein, 9 aa, Homo Sapiens
NAIDKLFVL

SEQ ID NO: 152450 - protein, 9 aa, Homo Sapiens
NAIEGGTQL

SEQ ID NO: 152451 - protein, 9 aa, Homo Sapiens
NAIGPLVAL

SEQ ID NO: 152452 - protein, 9 aa, Homo Sapiens
NAILVDTPL

SEQ ID NO: 152453 - protein, 9 aa, Homo Sapiens
NAINITSAL

SEQ ID NO: 152454 - protein, 9 aa, Homo Sapiens
NAIREVLEL

SEQ ID NO: 152455 - protein, 9 aa, Homo Sapiens
NAISIHHAL

SEQ ID NO: 152456 - protein, 9 aa, Homo Sapiens
NALDLNSVL

SEQ ID NO: 152457 - protein, 9 aa, Homo Sapiens
NALGVILQV

SEQ ID NO: 152458 - protein, 9 aa, Homo Sapiens
NAMEDAQTL

SEQ ID NO: 152459 - protein, 9 aa, Homo Sapiens
NASEDRLEL

SEQ ID NO: 152460 - protein, 9 aa, Homo Sapiens
NASESKLEL

SEQ ID NO: 152461 - protein, 9 aa, Homo Sapiens
NASPVISSV

SEQ ID NO: 152462 - protein, 9 aa, Homo Sapiens
NATHQHCVL

SEQ ID NO: 152463 - protein, 9 aa, Homo Sapiens
NATWVRAEL

SEQ ID NO: 152464 - protein, 9 aa, Homo Sapiens
NAVAAAHSV

SEQ ID NO: 152465 - protein, 9 aa, Homo Sapiens
NAVAALSEI

SEQ ID NO: 152466 - protein, 9 aa, Homo Sapiens
NAVDPDVSA

SEQ ID NO: 152467 - protein, 9 aa, Homo Sapiens
NAVFTFEQL

SEQ ID NO: 152468 - protein, 9 aa, Homo Sapiens
NAVGDGIVL

SEQ ID NO: 152469 - protein, 9 aa, Homo Sapiens
NAVPLFLRL

SEQ ID NO: 152470 - protein, 9 aa, Homo Sapiens
NAVSGQESL

SEQ ID NO: 152471 - protein, 9 aa, Homo Sapiens
NAYDEHQTL

SEQ ID NO: 152472 - protein, 9 aa, Homo Sapiens
NITSSTCEL

SEQ ID NO: 152473 - protein, 9 aa, Homo Sapiens
NIVKVFEIL

SEQ ID NO: 152474 - protein, 9 aa, Homo Sapiens
NSAPAGETL

SEQ ID NO: 152475 - protein, 9 aa, Homo Sapiens
NSDPYSVAL

SEQ ID NO: 152476 - protein, 9 aa, Homo Sapiens
NSFTLDADF

SEQ ID NO: 152477 - protein, 9 aa, Homo Sapiens
NSHCFPAFL

SEQ ID NO: 152478 - protein, 9 aa, Homo Sapiens
NSHVIQEYL

SEQ ID NO: 152479 - protein, 9 aa, Homo Sapiens
NSHWDPVSL

SEQ ID NO: 152480 - protein, 9 aa, Homo Sapiens
NSSPVINHL

SEQ ID NO: 152481 - protein, 9 aa, Homo Sapiens
NSTGVLLEV

SEQ ID NO: 152482 - protein, 9 aa, Homo Sapiens
NSVEPAQPL

SEQ ID NO: 152483 - protein, 9 aa, Homo Sapiens
NTATIFHEL

SEQ ID NO: 152484 - protein, 9 aa, Homo Sapiens
NTIDPSHPM

SEQ ID NO: 152485 - protein, 9 aa, Homo Sapiens
NTIETFNEL

SEQ ID NO: 152486 - protein, 9 aa, Homo Sapiens
NVDGHLYEL

SEQ ID NO: 152487 - protein, 9 aa, Homo Sapiens
NVDPDNVVL

SEQ ID NO: 152488 - protein, 9 aa, Homo Sapiens
NVDPDSVVL

SEQ ID NO: 152489 - protein, 9 aa, Homo Sapiens
NVLDHFSEL

SEQ ID NO: 152490 - protein, 9 aa, Homo Sapiens
NVVDVFHAV

SEQ ID NO: 152491 - protein, 9 aa, Homo Sapiens
NVVEALIAL

SEQ ID NO: 152492 - protein, 9 aa, Homo Sapiens
PASPAISVV

SEQ ID NO: 152493 - protein, 9 aa, Homo Sapiens
PIRLLAAAA

SEQ ID NO: 152494 - protein, 9 aa, Homo Sapiens
QAADSILVL

SEQ ID NO: 152495 - protein, 9 aa, Homo Sapiens
QACGITAVL

SEQ ID NO: 152496 - protein, 9 aa, Homo Sapiens
QADAPNPSL

SEQ ID NO: 152497 - protein, 9 aa, Homo Sapiens
QADARQVVL

SEQ ID NO: 152498 - protein, 9 aa, Homo Sapiens
QADCAVLIV

SEQ ID NO: 152499 - protein, 9 aa, Homo Sapiens
QADEVIAIL

SEQ ID NO: 152500 - protein, 9 aa, Homo Sapiens
QADNPHVAL

SEQ ID NO: 152501 - protein, 9 aa, Homo Sapiens
QADPSAPCL

SEQ ID NO: 152502 - protein, 9 aa, Homo Sapiens
QADPTKLEL

SEQ ID NO: 152503 - protein, 9 aa, Homo Sapiens
QADQTFISL

SEQ ID NO: 152504 - protein, 9 aa, Homo Sapiens
QADTTRLEL

SEQ ID NO: 152505 - protein, 9 aa, Homo Sapiens
QAFGIMNEL

SEQ ID NO: 152506 - protein, 9 aa, Homo Sapiens
QAFIGEEVL

SEQ ID NO: 152507 - protein, 9 aa, Homo Sapiens
QAIENAHVL

SEQ ID NO: 152508 - protein, 9 aa, Homo Sapiens
QAIPVTSEL

SEQ ID NO: 152509 - protein, 9 aa, Homo Sapiens
QALEQFHQL

SEQ ID NO: 152510 - protein, 9 aa, Homo Sapiens
QALLDLHAL

SEQ ID NO: 152511 - protein, 9 aa, Homo Sapiens
QIPEIKQTL

SEQ ID NO: 152512 - protein, 9 aa, Homo Sapiens
RAADVLVYL

SEQ ID NO: 152513 - protein, 9 aa, Homo Sapiens
RAAELFHQL

SEQ ID NO: 152514 - protein, 9 aa, Homo Sapiens
RAAEPLLTL

SEQ ID NO: 152515 - protein, 9 aa, Homo Sapiens
RAASPIITL

SEQ ID NO: 152516 - protein, 9 aa, Homo Sapiens
RACPATQAL

SEQ ID NO: 152517 - protein, 9 aa, Homo Sapiens
RADDTFEAL

SEQ ID NO: 152518 - protein, 9 aa, Homo Sapiens
RADESTYVL

SEQ ID NO: 152519 - protein, 9 aa, Homo Sapiens
RADPESPIL

SEQ ID NO: 152520 - protein, 9 aa, Homo Sapiens
RAFGIPIRV

SEQ ID NO: 152521 - protein, 9 aa, Homo Sapiens
RAFSDRSSL

SEQ ID NO: 152522 - protein, 9 aa, Homo Sapiens
RAHDDPVAL

SEQ ID NO: 152523 - protein, 9 aa, Homo Sapiens
RAHSEPLAL

SEQ ID NO: 152524 - protein, 9 aa, Homo Sapiens
RAIEIYTDM

SEQ ID NO: 152525 - protein, 9 aa, Homo Sapiens
RAIENIDTL

SEQ ID NO: 152526 - protein, 9 aa, Homo Sapiens
RALDHYLTL

SEQ ID NO: 152527 - protein, 9 aa, Homo Sapiens
RALDVNVAL

SEQ ID NO: 152528 - protein, 9 aa, Homo Sapiens
RALEDRHSL

SEQ ID NO: 152529 - protein, 9 aa, Homo Sapiens
RALEHFTDL

SEQ ID NO: 152530 - protein, 9 aa, Homo Sapiens
RALGFSEEL

SEQ ID NO: 152531 - protein, 9 aa, Homo Sapiens
RALHQGDSL

SEQ ID NO: 152532 - protein, 9 aa, Homo Sapiens
RALLDRDAL

SEQ ID NO: 152533 - protein, 9 aa, Homo Sapiens
RALYDFEAL

SEQ ID NO: 152534 - protein, 9 aa, Homo Sapiens
RAMYLPDTL

SEQ ID NO: 152535 - protein, 9 aa, Homo Sapiens
RAQDPSEVL

SEQ ID NO: 152536 - protein, 9 aa, Homo Sapiens
RAQLQQVEL

SEQ ID NO: 152537 - protein, 9 aa, Homo Sapiens
RASFIFISV

SEQ ID NO: 152538 - protein, 9 aa, Homo Sapiens
RASSIYSKL

SEQ ID NO: 152539 - protein, 9 aa, Homo Sapiens
RAVAPTMSL

SEQ ID NO: 152540 - protein, 9 aa, Homo Sapiens
RAVEVSAEL

SEQ ID NO: 152541 - protein, 9 aa, Homo Sapiens
RAVQDVESL

SEQ ID NO: 152542 - protein, 9 aa, Homo Sapiens
RAVSETESL

SEQ ID NO: 152543 - protein, 9 aa, Homo Sapiens
RAYDGTTYL

SEQ ID NO: 152544 - protein, 9 aa, Homo Sapiens
RAYNHLDEL

SEQ ID NO: 152545 - protein, 9 aa, Homo Sapiens
RGDETFAVL

SEQ ID NO: 152546 - protein, 9 aa, Homo Sapiens
RICPIDITL

SEQ ID NO: 152547 - protein, 9 aa, Homo Sapiens
RIDDLQMVL

SEQ ID NO: 152548 - protein, 9 aa, Homo Sapiens
RIPSFVTEL

SEQ ID NO: 152549 - protein, 9 aa, Homo Sapiens
RIVDPEIAL

SEQ ID NO: 152550 - protein, 9 aa, Homo Sapiens
RPAPVAVAA

SEQ ID NO: 152551 - protein, 9 aa, Homo Sapiens
RPFHGISTV

SEQ ID NO: 152552 - protein, 9 aa, Homo Sapiens
RPLLKAITA

SEQ ID NO: 152553 - protein, 9 aa, Homo Sapiens
RPNDIMAEV

SEQ ID NO: 152554 - protein, 9 aa, Homo Sapiens
RPRPGTGLG

SEQ ID NO: 152555 - protein, 9 aa, Homo Sapiens
RPSPAPPAA

SEQ ID NO: 152556 - protein, 9 aa, Homo Sapiens
RPSPPVQSV

SEQ ID NO: 152557 - protein, 9 aa, Homo Sapiens
RPVLPRTEA

SEQ ID NO: 152558 - protein, 9 aa, Homo Sapiens
RPYDKNISP

SEQ ID NO: 152559 - protein, 9 aa, Homo Sapiens
RQALLLLAL

SEQ ID NO: 152560 - protein, 9 aa, Homo Sapiens
RQAPPHIEL

SEQ ID NO: 152561 - protein, 9 aa, Homo Sapiens
RSAEPAEAL

SEQ ID NO: 152562 - protein, 9 aa, Homo Sapiens
RSAEVTLEV

SEQ ID NO: 152563 - protein, 9 aa, Homo Sapiens
RSDCTYIVL

SEQ ID NO: 152564 - protein, 9 aa, Homo Sapiens
RSHYSPIYL

SEQ ID NO: 152565 - protein, 9 aa, Homo Sapiens
RSIGEYDVL

SEQ ID NO: 152566 - protein, 9 aa, Homo Sapiens
RSIHIFDTL

SEQ ID NO: 152567 - protein, 9 aa, Homo Sapiens
RTDDNCIVL

SEQ ID NO: 152568 - protein, 9 aa, Homo Sapiens
RTDDTPVVL

SEQ ID NO: 152569 - protein, 9 aa, Homo Sapiens
RTLDCIHVL

SEQ ID NO: 152570 - protein, 9 aa, Homo Sapiens
RTVDLFPVL

SEQ ID NO: 152571 - protein, 9 aa, Homo Sapiens
RVCEVDNEL

SEQ ID NO: 152572 - protein, 9 aa, Homo Sapiens
RVCEVEFVF

SEQ ID NO: 152573 - protein, 9 aa, Homo Sapiens
RVFLDHNAL

SEQ ID NO: 152574 - protein, 9 aa, Homo Sapiens
RVMELFFTV

SEQ ID NO: 152575 - protein, 9 aa, Homo Sapiens
RVYEFLDKL

SEQ ID NO: 152576 - protein, 9 aa, Homo Sapiens
SAACPGLQL

SEQ ID NO: 152577 - protein, 9 aa, Homo Sapiens
SAAEAYQVL

SEQ ID NO: 152578 - protein, 9 aa, Homo Sapiens
SAAEIMAVL

SEQ ID NO: 152579 - protein, 9 aa, Homo Sapiens
SAAELDLVL

SEQ ID NO: 152580 - protein, 9 aa, Homo Sapiens
SAAENFLVL

SEQ ID NO: 152581 - protein, 9 aa, Homo Sapiens
SAAEPPTAL

SEQ ID NO: 152582 - protein, 9 aa, Homo Sapiens
SAAEPTPAV

SEQ ID NO: 152583 - protein, 9 aa, Homo Sapiens
SAAEPVPAA

SEQ ID NO: 152584 - protein, 9 aa, Homo Sapiens
SAAFPGASL

SEQ ID NO: 152585 - protein, 9 aa, Homo Sapiens
SAAGAECEL

SEQ ID NO: 152586 - protein, 9 aa, Homo Sapiens
SAAGLKLYL

SEQ ID NO: 152587 - protein, 9 aa, Homo Sapiens
SAAGPGFSL

SEQ ID NO: 152588 - protein, 9 aa, Homo Sapiens
SAAHAIVSV

SEQ ID NO: 152589 - protein, 9 aa, Homo Sapiens
SAAMPGASL

SEQ ID NO: 152590 - protein, 9 aa, Homo Sapiens
SAAMVFSAL

SEQ ID NO: 152591 - protein, 9 aa, Homo Sapiens
SAAPGTASL

SEQ ID NO: 152592 - protein, 9 aa, Homo Sapiens
SAAPPEPAV

SEQ ID NO: 152593 - protein, 9 aa, Homo Sapiens
SAAPPGLEA

SEQ ID NO: 152594 - protein, 9 aa, Homo Sapiens
SAAPPLPSL

SEQ ID NO: 152595 - protein, 9 aa, Homo Sapiens
SAAQPGVAF

SEQ ID NO: 152596 - protein, 9 aa, Homo Sapiens
SAASPAVAL

SEQ ID NO: 152597 - protein, 9 aa, Homo Sapiens
SACDGIFHL

SEQ ID NO: 152598 - protein, 9 aa, Homo Sapiens
SACFTLQEL

SEQ ID NO: 152599 - protein, 9 aa, Homo Sapiens
SACGHTAVL

SEQ ID NO: 152600 - protein, 9 aa, Homo Sapiens
SACHLLVSL

SEQ ID NO: 152601 - protein, 9 aa, Homo Sapiens
SACHVSNTL

SEQ ID NO: 152602 - protein, 9 aa, Homo Sapiens
SACPLLLTL

SEQ ID NO: 152603 - protein, 9 aa, Homo Sapiens
SADACHAEL

SEQ ID NO: 152604 - protein, 9 aa, Homo Sapiens
SADATPLHV

SEQ ID NO: 152605 - protein, 9 aa, Homo Sapiens
SADENYRPL

SEQ ID NO: 152606 - protein, 9 aa, Homo Sapiens
SADGMRLAL

SEQ ID NO: 152607 - protein, 9 aa, Homo Sapiens
SADHLAHEV

SEQ ID NO: 152608 - protein, 9 aa, Homo Sapiens
SADKFQVLL

SEQ ID NO: 152609 - protein, 9 aa, Homo Sapiens
SADMSHVAL

SEQ ID NO: 152610 - protein, 9 aa, Homo Sapiens
SADNVRQQL

SEQ ID NO: 152611 - protein, 9 aa, Homo Sapiens
SADPEVMLL

SEQ ID NO: 152612 - protein, 9 aa, Homo Sapiens
SADPGILVL

SEQ ID NO: 152613 - protein, 9 aa, Homo Sapiens
SADPNVVDL

SEQ ID NO: 152614 - protein, 9 aa, Homo Sapiens
SADPRPLAV

SEQ ID NO: 152615 - protein, 9 aa, Homo Sapiens
SADQSPSAL

SEQ ID NO: 152616 - protein, 9 aa, Homo Sapiens
SADSLEHVL

SEQ ID NO: 152617 - protein, 9 aa, Homo Sapiens
SAEHSHPAL

SEQ ID NO: 152618 - protein, 9 aa, Homo Sapiens
SAETPTIPL

SEQ ID NO: 152619 - protein, 9 aa, Homo Sapiens
SAFDHFASV

SEQ ID NO: 152620 - protein, 9 aa, Homo Sapiens
SAFFDSTTL

SEQ ID NO: 152621 - protein, 9 aa, Homo Sapiens
SAFGYFITA

SEQ ID NO: 152622 - protein, 9 aa, Homo Sapiens
SAFPFPVTV

SEQ ID NO: 152623 - protein, 9 aa, Homo Sapiens
SAFSSWEEL

SEQ ID NO: 152624 - protein, 9 aa, Homo Sapiens
SAFYDVDFL

SEQ ID NO: 152625 - protein, 9 aa, Homo Sapiens
SAGPPLLAV

SEQ ID NO: 152626 - protein, 9 aa, Homo Sapiens
SAGPVGDDL

SEQ ID NO: 152627 - protein, 9 aa, Homo Sapiens
SAGPVGDDM

SEQ ID NO: 152628 - protein, 9 aa, Homo Sapiens
SAHIMGEAM

SEQ ID NO: 152629 - protein, 9 aa, Homo Sapiens
SAHLFEVEL

SEQ ID NO: 152630 - protein, 9 aa, Homo Sapiens
SAHSHFISL

SEQ ID NO: 152631 - protein, 9 aa, Homo Sapiens
SAIDTREEL

SEQ ID NO: 152632 - protein, 9 aa, Homo Sapiens
SAIFNFQSL

SEQ ID NO: 152633 - protein, 9 aa, Homo Sapiens
SAIFPDVAL

SEQ ID NO: 152634 - protein, 9 aa, Homo Sapiens
SAIGYIHSL

SEQ ID NO: 152635 - protein, 9 aa, Homo Sapiens
SAIHILDVL

SEQ ID NO: 152636 - protein, 9 aa, Homo Sapiens
SAINQVEAL

SEQ ID NO: 152637 - protein, 9 aa, Homo Sapiens
SAIPVTCLL

SEQ ID NO: 152638 - protein, 9 aa, Homo Sapiens
SALDSTPAL

SEQ ID NO: 152639 - protein, 9 aa, Homo Sapiens
SALEFLTQL

SEQ ID NO: 152640 - protein, 9 aa, Homo Sapiens
SALKAIHAL

SEQ ID NO: 152641 - protein, 9 aa, Homo Sapiens
SALQIFEKL

SEQ ID NO: 152642 - protein, 9 aa, Homo Sapiens
SAMEVVPAL

SEQ ID NO: 152643 - protein, 9 aa, Homo Sapiens
SANVVPEAL

SEQ ID NO: 152644 - protein, 9 aa, Homo Sapiens
SANYTEIAL

SEQ ID NO: 152645 - protein, 9 aa, Homo Sapiens
SASALAVAL

SEQ ID NO: 152646 - protein, 9 aa, Homo Sapiens
SASDWYDAL

SEQ ID NO: 152647 - protein, 9 aa, Homo Sapiens
SASESILEL

SEQ ID NO: 152648 - protein, 9 aa, Homo Sapiens
SASEVEVQL

SEQ ID NO: 152649 - protein, 9 aa, Homo Sapiens
SASEVPSEL

SEQ ID NO: 152650 - protein, 9 aa, Homo Sapiens
SASGPFESH

SEQ ID NO: 152651 - protein, 9 aa, Homo Sapiens
SASPPGPTL

SEQ ID NO: 152652 - protein, 9 aa, Homo Sapiens
SASPPPPAL

SEQ ID NO: 152653 - protein, 9 aa, Homo Sapiens
SASRVVQVV

SEQ ID NO: 152654 - protein, 9 aa, Homo Sapiens
SASSDFNTL

SEQ ID NO: 152655 - protein, 9 aa, Homo Sapiens
SATELMNIL

SEQ ID NO: 152656 - protein, 9 aa, Homo Sapiens
SATQVYTIL

SEQ ID NO: 152657 - protein, 9 aa, Homo Sapiens
SATRVYIVL

SEQ ID NO: 152658 - protein, 9 aa, Homo Sapiens
SATSVHTSV

SEQ ID NO: 152659 - protein, 9 aa, Homo Sapiens
SAVADKHEL

SEQ ID NO: 152660 - protein, 9 aa, Homo Sapiens
SAVDLPVTL

SEQ ID NO: 152661 - protein, 9 aa, Homo Sapiens
SAVDPVAVL

SEQ ID NO: 152662 - protein, 9 aa, Homo Sapiens
SAVDVHINM

SEQ ID NO: 152663 - protein, 9 aa, Homo Sapiens
SAVEPSDEI

SEQ ID NO: 152664 - protein, 9 aa, Homo Sapiens
SAVGQFVSL

SEQ ID NO: 152665 - protein, 9 aa, Homo Sapiens
SAVSHFFSL

SEQ ID NO: 152666 - protein, 9 aa, Homo Sapiens
SAVSIFHEL

SEQ ID NO: 152667 - protein, 9 aa, Homo Sapiens
SAVSPSESV

SEQ ID NO: 152668 - protein, 9 aa, Homo Sapiens
SAVTAFVTF

SEQ ID NO: 152669 - protein, 9 aa, Homo Sapiens
SAVTEEAAL

SEQ ID NO: 152670 - protein, 9 aa, Homo Sapiens
SAVTICDEL

SEQ ID NO: 152671 - protein, 9 aa, Homo Sapiens
SAVTTFEAL

SEQ ID NO: 152672 - protein, 9 aa, Homo Sapiens
SAVVDFEAL

SEQ ID NO: 152673 - protein, 9 aa, Homo Sapiens
SAYAGFLAL

SEQ ID NO: 152674 - protein, 9 aa, Homo Sapiens
SAYLQREEL

SEQ ID NO: 152675 - protein, 9 aa, Homo Sapiens
SGCPLFFPL

SEQ ID NO: 152676 - protein, 9 aa, Homo Sapiens
SGHLQNDTL

SEQ ID NO: 152677 - protein, 9 aa, Homo Sapiens
SGPGPAAAL

SEQ ID NO: 152678 - protein, 9 aa, Homo Sapiens
SIAGIFKEV

SEQ ID NO: 152679 - protein, 9 aa, Homo Sapiens
SICTTVLEL

SEQ ID NO: 152680 - protein, 9 aa, Homo Sapiens
SIEDICHVL

SEQ ID NO: 152681 - protein, 9 aa, Homo Sapiens
SIEPNFHSL

SEQ ID NO: 152682 - protein, 9 aa, Homo Sapiens
SIESIHSEM

SEQ ID NO: 152683 - protein, 9 aa, Homo Sapiens
SIIDDRVIL

SEQ ID NO: 152684 - protein, 9 aa, Homo Sapiens
SILSHFQSL

SEQ ID NO: 152685 - protein, 9 aa, Homo Sapiens
SIPEPIDPL

SEQ ID NO: 152686 - protein, 9 aa, Homo Sapiens
SISGITMVL

SEQ ID NO: 152687 - protein, 9 aa, Homo Sapiens
SIVDDEATL

SEQ ID NO: 152688 - protein, 9 aa, Homo Sapiens
SIVEPKDEI

SEQ ID NO: 152689 - protein, 9 aa, Homo Sapiens
SIWDGSEVL

SEQ ID NO: 152690 - protein, 9 aa, Homo Sapiens
SNHLLEDSL

SEQ ID NO: 152691 - protein, 9 aa, Homo Sapiens
SNHWQIPEL

SEQ ID NO: 152692 - protein, 9 aa, Homo Sapiens
SPADRQLVA

SEQ ID NO: 152693 - protein, 9 aa, Homo Sapiens
SPFGTITSA

SEQ ID NO: 152694 - protein, 9 aa, Homo Sapiens
SPFHFQPSA

SEQ ID NO: 152695 - protein, 9 aa, Homo Sapiens
SPHLGPAPA

SEQ ID NO: 152696 - protein, 9 aa, Homo Sapiens
SPHPSPLGA

SEQ ID NO: 152697 - protein, 9 aa, Homo Sapiens
SPHSQVLTA

SEQ ID NO: 152698 - protein, 9 aa, Homo Sapiens
SPIENIQRV

SEQ ID NO: 152699 - protein, 9 aa, Homo Sapiens
SPKQILDPA

SEQ ID NO: 152700 - protein, 9 aa, Homo Sapiens
SPLKHFVTA

SEQ ID NO: 152701 - protein, 9 aa, Homo Sapiens
SPLSAARAA

SEQ ID NO: 152702 - protein, 9 aa, Homo Sapiens
SPNRYWLCA

SEQ ID NO: 152703 - protein, 9 aa, Homo Sapiens
SPRVPNSSV

SEQ ID NO: 152704 - protein, 9 aa, Homo Sapiens
SPVTDFREA

SEQ ID NO: 152705 - protein, 9 aa, Homo Sapiens
SPYHNFDSV

SEQ ID NO: 152706 - protein, 9 aa, Homo Sapiens
SQDPGTHVV

SEQ ID NO: 152707 - protein, 9 aa, Homo Sapiens
SSAKPGPAL

SEQ ID NO: 152708 - protein, 9 aa, Homo Sapiens
SSAPPLSEL

SEQ ID NO: 152709 - protein, 9 aa, Homo Sapiens
SSDGHEFIV

SEQ ID NO: 152710 - protein, 9 aa, Homo Sapiens
SSDPKVLTL

SEQ ID NO: 152711 - protein, 9 aa, Homo Sapiens
SSHFLEQTL

SEQ ID NO: 152712 - protein, 9 aa, Homo Sapiens
SSHLLSLTL

SEQ ID NO: 152713 - protein, 9 aa, Homo Sapiens
SSHTLLQVL

SEQ ID NO: 152714 - protein, 9 aa, Homo Sapiens
SSHVQQQAL

SEQ ID NO: 152715 - protein, 9 aa, Homo Sapiens
SSHYLLCAL

SEQ ID NO: 152716 - protein, 9 aa, Homo Sapiens
SSNWQKEAM

SEQ ID NO: 152717 - protein, 9 aa, Homo Sapiens
SSPQAGSSL

SEQ ID NO: 152718 - protein, 9 aa, Homo Sapiens
STADVYCKL

SEQ ID NO: 152719 - protein, 9 aa, Homo Sapiens
STAGPSEAL

SEQ ID NO: 152720 - protein, 9 aa, Homo Sapiens
STCEAVMIL

SEQ ID NO: 152721 - protein, 9 aa, Homo Sapiens
STIGTYATL

SEQ ID NO: 152722 - protein, 9 aa, Homo Sapiens
STSAPGPAL

SEQ ID NO: 152723 - protein, 9 aa, Homo Sapiens
STYDGAETL

SEQ ID NO: 152724 - protein, 9 aa, Homo Sapiens
SVCDILLAL

SEQ ID NO: 152725 - protein, 9 aa, Homo Sapiens
SVCDYFFEA

SEQ ID NO: 152726 - protein, 9 aa, Homo Sapiens
SVDDTIVAL

SEQ ID NO: 152727 - protein, 9 aa, Homo Sapiens
SVDPTRLLL

SEQ ID NO: 152728 - protein, 9 aa, Homo Sapiens
SVDSHFCHL

SEQ ID NO: 152729 - protein, 9 aa, Homo Sapiens
SVDSHFQEV

SEQ ID NO: 152730 - protein, 9 aa, Homo Sapiens
SVIGHHETL

SEQ ID NO: 152731 - protein, 9 aa, Homo Sapiens
SVVDVFAQL

SEQ ID NO: 152732 - protein, 9 aa, Homo Sapiens
SVVKEMLEL

SEQ ID NO: 152733 - protein, 9 aa, Homo Sapiens
TAAAVNLLL

SEQ ID NO: 152734 - protein, 9 aa, Homo Sapiens
TAADDHQAL

SEQ ID NO: 152735 - protein, 9 aa, Homo Sapiens
TAAPPAQPL

SEQ ID NO: 152736 - protein, 9 aa, Homo Sapiens
TAAPTIGVL

SEQ ID NO: 152737 - protein, 9 aa, Homo Sapiens
TAAPTVCLL

SEQ ID NO: 152738 - protein, 9 aa, Homo Sapiens
TAAPVPTTL

SEQ ID NO: 152739 - protein, 9 aa, Homo Sapiens
TAAPVQETL

SEQ ID NO: 152740 - protein, 9 aa, Homo Sapiens
TAASPTIAL

SEQ ID NO: 152741 - protein, 9 aa, Homo Sapiens
TACDIQTHM

SEQ ID NO: 152742 - protein, 9 aa, Homo Sapiens
TADDFLVFL

SEQ ID NO: 152743 - protein, 9 aa, Homo Sapiens
TADDPSLSL

SEQ ID NO: 152744 - protein, 9 aa, Homo Sapiens
TADEVHYFL

SEQ ID NO: 152745 - protein, 9 aa, Homo Sapiens
TADGAHFEL

SEQ ID NO: 152746 - protein, 9 aa, Homo Sapiens
TADGDLYTL

SEQ ID NO: 152747 - protein, 9 aa, Homo Sapiens
TADGMVHLL

SEQ ID NO: 152748 - protein, 9 aa, Homo Sapiens
TADSYLLQL

SEQ ID NO: 152749 - protein, 9 aa, Homo Sapiens
TAHFEQNTL

SEQ ID NO: 152750 - protein, 9 aa, Homo Sapiens
TAHVMPSTL

SEQ ID NO: 152751 - protein, 9 aa, Homo Sapiens
TAHWLNTVL

SEQ ID NO: 152752 - protein, 9 aa, Homo Sapiens
TAIDDRCEL

SEQ ID NO: 152753 - protein, 9 aa, Homo Sapiens
TAIDVQVGL

SEQ ID NO: 152754 - protein, 9 aa, Homo Sapiens
TAIEAQHLL

SEQ ID NO: 152755 - protein, 9 aa, Homo Sapiens
TAIPVTQEL

SEQ ID NO: 152756 - protein, 9 aa, Homo Sapiens
TAISLFYEL

SEQ ID NO: 152757 - protein, 9 aa, Homo Sapiens
TALAIYHVI

SEQ ID NO: 152758 - protein, 9 aa, Homo Sapiens
TALNLFFKL

SEQ ID NO: 152759 - protein, 9 aa, Homo Sapiens
TALSFFHML

SEQ ID NO: 152760 - protein, 9 aa, Homo Sapiens
TAMDAQEAL

SEQ ID NO: 152761 - protein, 9 aa, Homo Sapiens
TAPQGNVDL

SEQ ID NO: 152762 - protein, 9 aa, Homo Sapiens
TAQILLKAL

SEQ ID NO: 152763 - protein, 9 aa, Homo Sapiens
TASEMILVL

SEQ ID NO: 152764 - protein, 9 aa, Homo Sapiens
TASEVLDSL

SEQ ID NO: 152765 - protein, 9 aa, Homo Sapiens
TASPVAVSL

SEQ ID NO: 152766 - protein, 9 aa, Homo Sapiens
TASPVIKAV

SEQ ID NO: 152767 - protein, 9 aa, Homo Sapiens
TASQVYETL

SEQ ID NO: 152768 - protein, 9 aa, Homo Sapiens
TAVAPNVAL

SEQ ID NO: 152769 - protein, 9 aa, Homo Sapiens
TAVAVFEIL

SEQ ID NO: 152770 - protein, 9 aa, Homo Sapiens
TAYDNFVEL

SEQ ID NO: 152771 - protein, 9 aa, Homo Sapiens
TAYLDGVSL

SEQ ID NO: 152772 - protein, 9 aa, Homo Sapiens
TIANPTDVL

SEQ ID NO: 152773 - protein, 9 aa, Homo Sapiens
TIDADAPEL

SEQ ID NO: 152774 - protein, 9 aa, Homo Sapiens
TIDPIPHQL

SEQ ID NO: 152775 - protein, 9 aa, Homo Sapiens
TIFKDHVSL

SEQ ID NO: 152776 - protein, 9 aa, Homo Sapiens
TIIDKSKSV

SEQ ID NO: 152777 - protein, 9 aa, Homo Sapiens
TIIEATHVL

SEQ ID NO: 152778 - protein, 9 aa, Homo Sapiens
TLCDVILMV

SEQ ID NO: 152779 - protein, 9 aa, Homo Sapiens
TNHLHQTPL

SEQ ID NO: 152780 - protein, 9 aa, Homo Sapiens
TPAHVLPSA

SEQ ID NO: 152781 - protein, 9 aa, Homo Sapiens
TPKPPGTGP

SEQ ID NO: 152782 - protein, 9 aa, Homo Sapiens
TPSAAALAA

SEQ ID NO: 152783 - protein, 9 aa, Homo Sapiens
TSAAIYHVL

SEQ ID NO: 152784 - protein, 9 aa, Homo Sapiens
TSAPITCEL

SEQ ID NO: 152785 - protein, 9 aa, Homo Sapiens
TSDPLELFL

SEQ ID NO: 152786 - protein, 9 aa, Homo Sapiens
TSNVITESL

SEQ ID NO: 152787 - protein, 9 aa, Homo Sapiens
TSVPPGSAL

SEQ ID NO: 152788 - protein, 9 aa, Homo Sapiens
TTDDSICVL

SEQ ID NO: 152789 - protein, 9 aa, Homo Sapiens
TTDGYLLRL

SEQ ID NO: 152790 - protein, 9 aa, Homo Sapiens
TTMVPTAAL

SEQ ID NO: 152791 - protein, 9 aa, Homo Sapiens
TTSPVLPSL

SEQ ID NO: 152792 - protein, 9 aa, Homo Sapiens
TVCHVVIVV

SEQ ID NO: 152793 - protein, 9 aa, Homo Sapiens
TVDGSPHEL

SEQ ID NO: 152794 - protein, 9 aa, Homo Sapiens
TVIDYFHQL

SEQ ID NO: 152795 - protein, 9 aa, Homo Sapiens
TVKGVSLSS

SEQ ID NO: 152796 - protein, 9 aa, Homo Sapiens
TVKPPTSVA

SEQ ID NO: 152797 - protein, 9 aa, Homo Sapiens
TVTTVILEV

SEQ ID NO: 152798 - protein, 9 aa, Homo Sapiens
TVYEGFISA

SEQ ID NO: 152799 - protein, 9 aa, Homo Sapiens
TVYGGSDEL

SEQ ID NO: 152800 - protein, 9 aa, Homo Sapiens
VAAAHSVVL

SEQ ID NO: 152801 - protein, 9 aa, Homo Sapiens
VAAAVDLII

SEQ ID NO: 152802 - protein, 9 aa, Homo Sapiens
VAAAVPVII

SEQ ID NO: 152803 - protein, 9 aa, Homo Sapiens
VAAAYADEL

SEQ ID NO: 152804 - protein, 9 aa, Homo Sapiens
VAADAVASL

SEQ ID NO: 152805 - protein, 9 aa, Homo Sapiens
VAAEAFSEL

SEQ ID NO: 152806 - protein, 9 aa, Homo Sapiens
VAAGVLCEL

SEQ ID NO: 152807 - protein, 9 aa, Homo Sapiens
VAAPASLSL

SEQ ID NO: 152808 - protein, 9 aa, Homo Sapiens
VAATVYCML

SEQ ID NO: 152809 - protein, 9 aa, Homo Sapiens
VAAYEFTTL

SEQ ID NO: 152810 - protein, 9 aa, Homo Sapiens
VACGAFHSL

SEQ ID NO: 152811 - protein, 9 aa, Homo Sapiens
VACGANHTL

SEQ ID NO: 152812 - protein, 9 aa, Homo Sapiens
VACGASHVL

SEQ ID NO: 152813 - protein, 9 aa, Homo Sapiens
VACGLNHTL

SEQ ID NO: 152814 - protein, 9 aa, Homo Sapiens
VACGSAHTL

SEQ ID NO: 152815 - protein, 9 aa, Homo Sapiens
VACGSYHSL

SEQ ID NO: 152816 - protein, 9 aa, Homo Sapiens
VACITEQVL

SEQ ID NO: 152817 - protein, 9 aa, Homo Sapiens
VACLDKNEL

SEQ ID NO: 152818 - protein, 9 aa, Homo Sapiens
VACPPMYHL

SEQ ID NO: 152819 - protein, 9 aa, Homo Sapiens
VACRAIGIL

SEQ ID NO: 152820 - protein, 9 aa, Homo Sapiens
VADDTPVLL

SEQ ID NO: 152821 - protein, 9 aa, Homo Sapiens
VADEGICYL

SEQ ID NO: 152822 - protein, 9 aa, Homo Sapiens
VADFQRYIL

SEQ ID NO: 152823 - protein, 9 aa, Homo Sapiens
VADGLITTL

SEQ ID NO: 152824 - protein, 9 aa, Homo Sapiens
VADGYPVRL

SEQ ID NO: 152825 - protein, 9 aa, Homo Sapiens
VADHPFLFL

SEQ ID NO: 152826 - protein, 9 aa, Homo Sapiens
VADKILWEI

SEQ ID NO: 152827 - protein, 9 aa, Homo Sapiens
VADNLAIQL

SEQ ID NO: 152828 - protein, 9 aa, Homo Sapiens
VADNRIQEL

SEQ ID NO: 152829 - protein, 9 aa, Homo Sapiens
VADPDNPLV

SEQ ID NO: 152830 - protein, 9 aa, Homo Sapiens
VADPETRTV

SEQ ID NO: 152831 - protein, 9 aa, Homo Sapiens
VADPIIYVL

SEQ ID NO: 152832 - protein, 9 aa, Homo Sapiens
VADPTPFHI

SEQ ID NO: 152833 - protein, 9 aa, Homo Sapiens
VADPVEAVL

SEQ ID NO: 152834 - protein, 9 aa, Homo Sapiens
VADPYVVIM

SEQ ID NO: 152835 - protein, 9 aa, Homo Sapiens
VADRLLVEL

SEQ ID NO: 152836 - protein, 9 aa, Homo Sapiens
VADRLMLEL

SEQ ID NO: 152837 - protein, 9 aa, Homo Sapiens
VADTVARVL

SEQ ID NO: 152838 - protein, 9 aa, Homo Sapiens
VADTVYRAL

SEQ ID NO: 152839 - protein, 9 aa, Homo Sapiens
VAEDKFITL

SEQ ID NO: 152840 - protein, 9 aa, Homo Sapiens
VAEERGAVL

SEQ ID NO: 152841 - protein, 9 aa, Homo Sapiens
VAEEVNAIL

SEQ ID NO: 152842 - protein, 9 aa, Homo Sapiens
VAEGGKAEL

SEQ ID NO: 152843 - protein, 9 aa, Homo Sapiens
VAEGPGAEL

SEQ ID NO: 152844 - protein, 9 aa, Homo Sapiens
VAEHHVATL

SEQ ID NO: 152845 - protein, 9 aa, Homo Sapiens
VAESGLPAL

SEQ ID NO: 152846 - protein, 9 aa, Homo Sapiens
VAFSPVTEL

SEQ ID NO: 152847 - protein, 9 aa, Homo Sapiens
VAGPALEAL

SEQ ID NO: 152848 - protein, 9 aa, Homo Sapiens
VAGPVGGSL

SEQ ID NO: 152849 - protein, 9 aa, Homo Sapiens
VAHSPPSTL

SEQ ID NO: 152850 - protein, 9 aa, Homo Sapiens
VAHTSLDAL

SEQ ID NO: 152851 - protein, 9 aa, Homo Sapiens
VAIKAGTTL

SEQ ID NO: 152852 - protein, 9 aa, Homo Sapiens
VAILDINRL

SEQ ID NO: 152853 - protein, 9 aa, Homo Sapiens
VAISECHTL

SEQ ID NO: 152854 - protein, 9 aa, Homo Sapiens
VAITEHTEV

SEQ ID NO: 152855 - protein, 9 aa, Homo Sapiens
VALAWLHVL

SEQ ID NO: 152856 - protein, 9 aa, Homo Sapiens
VALDFEQEM

SEQ ID NO: 152857 - protein, 9 aa, Homo Sapiens
VALHSAVSA

SEQ ID NO: 152858 - protein, 9 aa, Homo Sapiens
VALNSFDDL

SEQ ID NO: 152859 - protein, 9 aa, Homo Sapiens
VALPMVLVL

SEQ ID NO: 152860 - protein, 9 aa, Homo Sapiens
VALPPGLAV

SEQ ID NO: 152861 - protein, 9 aa, Homo Sapiens
VAMTGEITL

SEQ ID NO: 152862 - protein, 9 aa, Homo Sapiens
VANFQKTTL

SEQ ID NO: 152863 - protein, 9 aa, Homo Sapiens
VANTMRTSL

SEQ ID NO: 152864 - protein, 9 aa, Homo Sapiens
VANVSLLAL

SEQ ID NO: 152865 - protein, 9 aa, Homo Sapiens
VAPEEHPVL

SEQ ID NO: 152866 - protein, 9 aa, Homo Sapiens
VAPPGCSHL

SEQ ID NO: 152867 - protein, 9 aa, Homo Sapiens
VAPPVSGDL

SEQ ID NO: 152868 - protein, 9 aa, Homo Sapiens
VAQELPTTL

SEQ ID NO: 152869 - protein, 9 aa, Homo Sapiens
VAQSNFEAL

SEQ ID NO: 152870 - protein, 9 aa, Homo Sapiens
VASAVCLRL

SEQ ID NO: 152871 - protein, 9 aa, Homo Sapiens
VASEIMAVL

SEQ ID NO: 152872 - protein, 9 aa, Homo Sapiens
VASELHTSL

SEQ ID NO: 152873 - protein, 9 aa, Homo Sapiens
VASEVNLTA

SEQ ID NO: 152874 - protein, 9 aa, Homo Sapiens
VASEVSTSL

SEQ ID NO: 152875 - protein, 9 aa, Homo Sapiens
VASEVYKAV

SEQ ID NO: 152876 - protein, 9 aa, Homo Sapiens
VASEYPVIL

SEQ ID NO: 152877 - protein, 9 aa, Homo Sapiens
VASKVFYHL

SEQ ID NO: 152878 - protein, 9 aa, Homo Sapiens
VASPPTHAA

SEQ ID NO: 152879 - protein, 9 aa, Homo Sapiens
VASQITEAL

SEQ ID NO: 152880 - protein, 9 aa, Homo Sapiens
VASSLYDIL

SEQ ID NO: 152881 - protein, 9 aa, Homo Sapiens
VATAADLEL

SEQ ID NO: 152882 - protein, 9 aa, Homo Sapiens
VATDFFTVL

SEQ ID NO: 152883 - protein, 9 aa, Homo Sapiens
VATEGAEVL

SEQ ID NO: 152884 - protein, 9 aa, Homo Sapiens
VATGVISTL

SEQ ID NO: 152885 - protein, 9 aa, Homo Sapiens
VATKIFQEL

SEQ ID NO: 152886 - protein, 9 aa, Homo Sapiens
VATWVDETL

SEQ ID NO: 152887 - protein, 9 aa, Homo Sapiens
VAVDGINAL

SEQ ID NO: 152888 - protein, 9 aa, Homo Sapiens
VAVEPGAAV

SEQ ID NO: 152889 - protein, 9 aa, Homo Sapiens
VAVGAEHTL

SEQ ID NO: 152890 - protein, 9 aa, Homo Sapiens
VAVGEFQEV

SEQ ID NO: 152891 - protein, 9 aa, Homo Sapiens
VAVGVIKAV

SEQ ID NO: 152892 - protein, 9 aa, Homo Sapiens
VAVISGEAL

SEQ ID NO: 152893 - protein, 9 aa, Homo Sapiens
VAVPLYDTL

SEQ ID NO: 152894 - protein, 9 aa, Homo Sapiens
VAVQHFSLL

SEQ ID NO: 152895 - protein, 9 aa, Homo Sapiens
VAVQPGEQL

SEQ ID NO: 152896 - protein, 9 aa, Homo Sapiens
VAWADARSL

SEQ ID NO: 152897 - protein, 9 aa, Homo Sapiens
VAYDSDYAL

SEQ ID NO: 152898 - protein, 9 aa, Homo Sapiens
VAYGLHELL

SEQ ID NO: 152899 - protein, 9 aa, Homo Sapiens
VAYIDGQVL

SEQ ID NO: 152900 - protein, 9 aa, Homo Sapiens
VAYLQAHAL

SEQ ID NO: 152901 - protein, 9 aa, Homo Sapiens
VAYVSSVAL

SEQ ID NO: 152902 - protein, 9 aa, Homo Sapiens
VGAPVGIAL

SEQ ID NO: 152903 - protein, 9 aa, Homo Sapiens
VGDPHTVTV

SEQ ID NO: 152904 - protein, 9 aa, Homo Sapiens
VGDPSVHLL

SEQ ID NO: 152905 - protein, 9 aa, Homo Sapiens
VGHVMGSAL

SEQ ID NO: 152906 - protein, 9 aa, Homo Sapiens
VIAPPDFVL

SEQ ID NO: 152907 - protein, 9 aa, Homo Sapiens
VIDGEFKEL

SEQ ID NO: 152908 - protein, 9 aa, Homo Sapiens
VIDGHIYAV

SEQ ID NO: 152909 - protein, 9 aa, Homo Sapiens
VIDGKMYEL

SEQ ID NO: 152910 - protein, 9 aa, Homo Sapiens
VIHDFLFSL

SEQ ID NO: 152911 - protein, 9 aa, Homo Sapiens
VIIDDHPEV

SEQ ID NO: 152912 - protein, 9 aa, Homo Sapiens
VIIGSTHVL

SEQ ID NO: 152913 - protein, 9 aa, Homo Sapiens
VIISDAHVL

SEQ ID NO: 152914 - protein, 9 aa, Homo Sapiens
VILEPMQEL

SEQ ID NO: 152915 - protein, 9 aa, Homo Sapiens
VIMDNFEYL

SEQ ID NO: 152916 - protein, 9 aa, Homo Sapiens
VIMEPHKEV

SEQ ID NO: 152917 - protein, 9 aa, Homo Sapiens
VIQEAFIEL

SEQ ID NO: 152918 - protein, 9 aa, Homo Sapiens
VIQENEHAL

SEQ ID NO: 152919 - protein, 9 aa, Homo Sapiens
VISLEGKPL

SEQ ID NO: 152920 - protein, 9 aa, Homo Sapiens
VIVEPLEQL

SEQ ID NO: 152921 - protein, 9 aa, Homo Sapiens
VIVPLYDTL

SEQ ID NO: 152922 - protein, 9 aa, Homo Sapiens
VLDAHFLVL

SEQ ID NO: 152923 - protein, 9 aa, Homo Sapiens
VLYPGCDTL

SEQ ID NO: 152924 - protein, 9 aa, Homo Sapiens
VNHFQKDSI

SEQ ID NO: 152925 - protein, 9 aa, Homo Sapiens
VPAALTPRA

SEQ ID NO: 152926 - protein, 9 aa, Homo Sapiens
VPAKKITAA

SEQ ID NO: 152927 - protein, 9 aa, Homo Sapiens
VPHQPFSQA

SEQ ID NO: 152928 - protein, 9 aa, Homo Sapiens
VPRPPSNPP

SEQ ID NO: 152929 - protein, 9 aa, Homo Sapiens
VPSAVLIVA

SEQ ID NO: 152930 - protein, 9 aa, Homo Sapiens
VPSYPSKSA

SEQ ID NO: 152931 - protein, 9 aa, Homo Sapiens
VPTKRPPVL

SEQ ID NO: 152932 - protein, 9 aa, Homo Sapiens
VPYGTPLSV

SEQ ID NO: 152933 - protein, 9 aa, Homo Sapiens
VPYGVGKAA

SEQ ID NO: 152934 - protein, 9 aa, Homo Sapiens
VPYPPLLRA

SEQ ID NO: 152935 - protein, 9 aa, Homo Sapiens
VSAGIQTSF

SEQ ID NO: 152936 - protein, 9 aa, Homo Sapiens
VSAPVTHQL

SEQ ID NO: 152937 - protein, 9 aa, Homo Sapiens
VSCGEAHTL

SEQ ID NO: 152938 - protein, 9 aa, Homo Sapiens
VSDDTVMHL

SEQ ID NO: 152939 - protein, 9 aa, Homo Sapiens
VSDGVPLVL

SEQ ID NO: 152940 - protein, 9 aa, Homo Sapiens
VSDQANHVL

SEQ ID NO: 152941 - protein, 9 aa, Homo Sapiens
VSDSGAHVL

SEQ ID NO: 152942 - protein, 9 aa, Homo Sapiens
VSFPGQEAL

SEQ ID NO: 152943 - protein, 9 aa, Homo Sapiens
VSHALQAAL

SEQ ID NO: 152944 - protein, 9 aa, Homo Sapiens
VSHLLQDNL

SEQ ID NO: 152945 - protein, 9 aa, Homo Sapiens
VSHVIVDEV

SEQ ID NO: 152946 - protein, 9 aa, Homo Sapiens
VSIGDSHCL

SEQ ID NO: 152947 - protein, 9 aa, Homo Sapiens
VSQAQKDEL

SEQ ID NO: 152948 - protein, 9 aa, Homo Sapiens
VSQELKEPL

SEQ ID NO: 152949 - protein, 9 aa, Homo Sapiens
VSSNDFSSL

SEQ ID NO: 152950 - protein, 9 aa, Homo Sapiens
VSYYEKHSL

SEQ ID NO: 152951 - protein, 9 aa, Homo Sapiens
VTDGALVVV

SEQ ID NO: 152952 - protein, 9 aa, Homo Sapiens
VTDHNLHEL

SEQ ID NO: 152953 - protein, 9 aa, Homo Sapiens
VTEAVFHSL

SEQ ID NO: 152954 - protein, 9 aa, Homo Sapiens
VTHLLQQEL

SEQ ID NO: 152955 - protein, 9 aa, Homo Sapiens
VTLEPHIEL

SEQ ID NO: 152956 - protein, 9 aa, Homo Sapiens
VTVPPGPSL

SEQ ID NO: 152957 - protein, 9 aa, Homo Sapiens
VTVRPGLAM

SEQ ID NO: 152958 - protein, 9 aa, Homo Sapiens
VTVSPDGSL

SEQ ID NO: 152959 - protein, 9 aa, Homo Sapiens
VTYPGELLL

SEQ ID NO: 152960 - protein, 9 aa, Homo Sapiens
VVADLFHSL

SEQ ID NO: 152961 - protein, 9 aa, Homo Sapiens
VVANVQLVL

SEQ ID NO: 152962 - protein, 9 aa, Homo Sapiens
VVAPAGITL

SEQ ID NO: 152963 - protein, 9 aa, Homo Sapiens
VVCGLIFRL

SEQ ID NO: 152964 - protein, 9 aa, Homo Sapiens
VVCPVSDIL

SEQ ID NO: 152965 - protein, 9 aa, Homo Sapiens
VVDGGAIPA

SEQ ID NO: 152966 - protein, 9 aa, Homo Sapiens
VVDGTPLVA

SEQ ID NO: 152967 - protein, 9 aa, Homo Sapiens
VVDHVFPLL

SEQ ID NO: 152968 - protein, 9 aa, Homo Sapiens
VVFDDSEPV

SEQ ID NO: 152969 - protein, 9 aa, Homo Sapiens
VVIEPISEL

SEQ ID NO: 152970 - protein, 9 aa, Homo Sapiens
VVQGDPREL

SEQ ID NO: 152971 - protein, 9 aa, Homo Sapiens
VVVAVGRAL

SEQ ID NO: 152972 - protein, 9 aa, Homo Sapiens
VVVDPIQSV

SEQ ID NO: 152973 - protein, 9 aa, Homo Sapiens
VVVQPYNSL

SEQ ID NO: 152974 - protein, 9 aa, Homo Sapiens
WALDDHHAL

SEQ ID NO: 152975 - protein, 9 aa, Homo Sapiens
YAAGAKLVL

SEQ ID NO: 152976 - protein, 9 aa, Homo Sapiens
YAAGVHSVL

SEQ ID NO: 152977 - protein, 9 aa, Homo Sapiens
YAAQASQAL

SEQ ID NO: 152978 - protein, 9 aa, Homo Sapiens
YAAYPLTEV

SEQ ID NO: 152979 - protein, 9 aa, Homo Sapiens
YACGFSVLL

SEQ ID NO: 152980 - protein, 9 aa, Homo Sapiens
YADGYSPPL

SEQ ID NO: 152981 - protein, 9 aa, Homo Sapiens
YADPNFVRT

SEQ ID NO: 152982 - protein, 9 aa, Homo Sapiens
YADPSILYI

SEQ ID NO: 152983 - protein, 9 aa, Homo Sapiens
YADQHSVQV

SEQ ID NO: 152984 - protein, 9 aa, Homo Sapiens
YADTCFSTI

SEQ ID NO: 152985 - protein, 9 aa, Homo Sapiens
YAEQLHVQL

SEQ ID NO: 152986 - protein, 9 aa, Homo Sapiens
YAETIAHIL

SEQ ID NO: 152987 - protein, 9 aa, Homo Sapiens
YAETLFDIL

SEQ ID NO: 152988 - protein, 9 aa, Homo Sapiens
YAFGGGCEL

SEQ ID NO: 152989 - protein, 9 aa, Homo Sapiens
YAFKDNSNL

SEQ ID NO: 152990 - protein, 9 aa, Homo Sapiens
YAFLLDKAL

SEQ ID NO: 152991 - protein, 9 aa, Homo Sapiens
YAFPKAVSV

SEQ ID NO: 152992 - protein, 9 aa, Homo Sapiens
YAFPKSITV

SEQ ID NO: 152993 - protein, 9 aa, Homo Sapiens
YAFPLAHSL

SEQ ID NO: 152994 - protein, 9 aa, Homo Sapiens
YAFQDDRYL

SEQ ID NO: 152995 - protein, 9 aa, Homo Sapiens
YAFQDENHL

SEQ ID NO: 152996 - protein, 9 aa, Homo Sapiens
YAFSGVEEL

SEQ ID NO: 152997 - protein, 9 aa, Homo Sapiens
YAIESQLQL

SEQ ID NO: 152998 - protein, 9 aa, Homo Sapiens
YAIEVDPVL

SEQ ID NO: 152999 - protein, 9 aa, Homo Sapiens
YAIGRSDTV

SEQ ID NO: 153000 - protein, 9 aa, Homo Sapiens
YAIGVSHPL

SEQ ID NO: 153001 - protein, 9 aa, Homo Sapiens
YAIHGVLEV

SEQ ID NO: 153002 - protein, 9 aa, Homo Sapiens
YAINQPDVL

SEQ ID NO: 153003 - protein, 9 aa, Homo Sapiens
YAIQATETL

SEQ ID NO: 153004 - protein, 9 aa, Homo Sapiens
YAIREEIVL

SEQ ID NO: 153005 - protein, 9 aa, Homo Sapiens
YAISKPDIL

SEQ ID NO: 153006 - protein, 9 aa, Homo Sapiens
YAISKPEVL

SEQ ID NO: 153007 - protein, 9 aa, Homo Sapiens
YAISPGLDI

SEQ ID NO: 153008 - protein, 9 aa, Homo Sapiens
YAITTLHNL

SEQ ID NO: 153009 - protein, 9 aa, Homo Sapiens
YALDLIDKL

SEQ ID NO: 153010 - protein, 9 aa, Homo Sapiens
YALDLSTFL

SEQ ID NO: 153011 - protein, 9 aa, Homo Sapiens
YALGKDFCL

SEQ ID NO: 153012 - protein, 9 aa, Homo Sapiens
YALNHTLSV

SEQ ID NO: 153013 - protein, 9 aa, Homo Sapiens
YALPAGLSA

SEQ ID NO: 153014 - protein, 9 aa, Homo Sapiens
YALYVRDTL

SEQ ID NO: 153015 - protein, 9 aa, Homo Sapiens
YAMDELRSL

SEQ ID NO: 153016 - protein, 9 aa, Homo Sapiens
YANEVGEAF

SEQ ID NO: 153017 - protein, 9 aa, Homo Sapiens
YAQTQLDKL

SEQ ID NO: 153018 - protein, 9 aa, Homo Sapiens
YASDYFDQL

SEQ ID NO: 153019 - protein, 9 aa, Homo Sapiens
YASNITSVL

SEQ ID NO: 153020 - protein, 9 aa, Homo Sapiens
YASPDLSKL

SEQ ID NO: 153021 - protein, 9 aa, Homo Sapiens
YASSPGMSL

SEQ ID NO: 153022 - protein, 9 aa, Homo Sapiens
YATDLVVCV

SEQ ID NO: 153023 - protein, 9 aa, Homo Sapiens
YATIILSKM

SEQ ID NO: 153024 - protein, 9 aa, Homo Sapiens
YATTGKCEL

SEQ ID NO: 153025 - protein, 9 aa, Homo Sapiens
YAVELFEGL

SEQ ID NO: 153026 - protein, 9 aa, Homo Sapiens
YAVRDTIAL

SEQ ID NO: 153027 - protein, 9 aa, Homo Sapiens
YAYDGKDYI

SEQ ID NO: 153028 - protein, 9 aa, Homo Sapiens
YAYEKPHVV

SEQ ID NO: 153029 - protein, 9 aa, Homo Sapiens
YAYETKDAL

SEQ ID NO: 153030 - protein, 9 aa, Homo Sapiens
YAYNDKAIL

SEQ ID NO: 153031 - protein, 9 aa, Homo Sapiens
YAYRDAVFL

SEQ ID NO: 153032 - protein, 9 aa, Homo Sapiens
YAYTGRLEL

SEQ ID NO: 153033 - protein, 9 aa, Homo Sapiens
YGAEALERM

SEQ ID NO: 153034 - protein, 9 aa, Homo Sapiens
YGDEIAIEL

SEQ ID NO: 153035 - protein, 9 aa, Homo Sapiens
YGDHTKLIL

SEQ ID NO: 153036 - protein, 9 aa, Homo Sapiens
YGDPHSPVI

SEQ ID NO: 153037 - protein, 9 aa, Homo Sapiens
YGLEPAHPL

SEQ ID NO: 153038 - protein, 9 aa, Homo Sapiens
YGVTVFKAL

SEQ ID NO: 153039 - protein, 9 aa, Homo Sapiens
YGYEHILTL

SEQ ID NO: 153040 - protein, 9 aa, Homo Sapiens
YIDDVFHAL

SEQ ID NO: 153041 - protein, 9 aa, Homo Sapiens
YIDEGRLVL

SEQ ID NO: 153042 - protein, 9 aa, Homo Sapiens
YIFDNCHEL

SEQ ID NO: 153043 - protein, 9 aa, Homo Sapiens
YIIKDKHIL

SEQ ID NO: 153044 - protein, 9 aa, Homo Sapiens
YILDLQVVL

SEQ ID NO: 153045 - protein, 9 aa, Homo Sapiens
YILGKFFAL

SEQ ID NO: 153046 - protein, 9 aa, Homo Sapiens
YILPFSEVL

SEQ ID NO: 153047 - protein, 9 aa, Homo Sapiens
YITDLFQVL

SEQ ID NO: 153048 - protein, 9 aa, Homo Sapiens
YIVCDFHSL

SEQ ID NO: 153049 - protein, 9 aa, Homo Sapiens
YKDGTELEL

SEQ ID NO: 153050 - protein, 9 aa, Homo Sapiens
YLADIFTKL

SEQ ID NO: 153051 - protein, 9 aa, Homo Sapiens
YLFPGHPPT

SEQ ID NO: 153052 - protein, 9 aa, Homo Sapiens
YLIEPDVEL

SEQ ID NO: 153053 - protein, 9 aa, Homo Sapiens
YLLDLHSYL

SEQ ID NO: 153054 - protein, 9 aa, Homo Sapiens
YLTAEILEL

SEQ ID NO: 153055 - protein, 9 aa, Homo Sapiens
YLTAEVLEL

SEQ ID NO: 153056 - protein, 9 aa, Homo Sapiens
YQTEIGQTL

SEQ ID NO: 153057 - protein, 9 aa, Homo Sapiens
YQYLLVTAL

SEQ ID NO: 153058 - protein, 9 aa, Homo Sapiens
YQYPRPLLI

SEQ ID NO: 153059 - protein, 9 aa, Homo Sapiens
YSAEPLPEL

SEQ ID NO: 153060 - protein, 9 aa, Homo Sapiens
YSAPVIHVL

SEQ ID NO: 153061 - protein, 9 aa, Homo Sapiens
YSCDHNTSL

SEQ ID NO: 153062 - protein, 9 aa, Homo Sapiens
YSDDIPHAL

SEQ ID NO: 153063 - protein, 9 aa, Homo Sapiens
YSDFVVHEI

SEQ ID NO: 153064 - protein, 9 aa, Homo Sapiens
YSDGPGEAL

SEQ ID NO: 153065 - protein, 9 aa, Homo Sapiens
YSDPVTLET

SEQ ID NO: 153066 - protein, 9 aa, Homo Sapiens
YSDSFPMEL

SEQ ID NO: 153067 - protein, 9 aa, Homo Sapiens
YSFHKFHYL

SEQ ID NO: 153068 - protein, 9 aa, Homo Sapiens
YSFYLPIAA

SEQ ID NO: 153069 - protein, 9 aa, Homo Sapiens
YSFYNQQTL

SEQ ID NO: 153070 - protein, 9 aa, Homo Sapiens
YSHFLQFAL

SEQ ID NO: 153071 - protein, 9 aa, Homo Sapiens
YSHVDLVVM

SEQ ID NO: 153072 - protein, 9 aa, Homo Sapiens
YSLDHISSL

SEQ ID NO: 153073 - protein, 9 aa, Homo Sapiens
YSLFDNSKL

SEQ ID NO: 153074 - protein, 9 aa, Homo Sapiens
YSLRDEFPL

SEQ ID NO: 153075 - protein, 9 aa, Homo Sapiens
YSLYPDREL

SEQ ID NO: 153076 - protein, 9 aa, Homo Sapiens
YSMPVHAAV

SEQ ID NO: 153077 - protein, 9 aa, Homo Sapiens
YSNLHEQTL

SEQ ID NO: 153078 - protein, 9 aa, Homo Sapiens
YSVNDGAQL

SEQ ID NO: 153079 - protein, 9 aa, Homo Sapiens
YSYFEKETL

SEQ ID NO: 153080 - protein, 9 aa, Homo Sapiens
YTADGKEVL

SEQ ID NO: 153081 - protein, 9 aa, Homo Sapiens
YTCPVITNL

SEQ ID NO: 153082 - protein, 9 aa, Homo Sapiens
YTDATPLRV

SEQ ID NO: 153083 - protein, 9 aa, Homo Sapiens
YTDHQFTEL

SEQ ID NO: 153084 - protein, 9 aa, Homo Sapiens
YTDPSAEEL

SEQ ID NO: 153085 - protein, 9 aa, Homo Sapiens
YTHVDDCSL

SEQ ID NO: 153086 - protein, 9 aa, Homo Sapiens
YTIYDSETL

SEQ ID NO: 153087 - protein, 9 aa, Homo Sapiens
YTSEVQAIL

SEQ ID NO: 153088 - protein, 9 aa, Homo Sapiens
YTSPVIPAL

SEQ ID NO: 153089 - protein, 9 aa, Homo Sapiens
YTSPVNPAV

SEQ ID NO: 153090 - protein, 9 aa, Homo Sapiens
YVADLGDIL

SEQ ID NO: 153091 - protein, 9 aa, Homo Sapiens
YVAQAGLEL

SEQ ID NO: 153092 - protein, 9 aa, Homo Sapiens
YVDDGLISL

SEQ ID NO: 153093 - protein, 9 aa, Homo Sapiens
YVDDTQFVQ

SEQ ID NO: 153094 - protein, 9 aa, Homo Sapiens
YVDGRVLVV

SEQ ID NO: 153095 - protein, 9 aa, Homo Sapiens
YVIELQHVV

SEQ ID NO: 153096 - protein, 9 aa, Homo Sapiens
YVINDLTAV

SEQ ID NO: 153097 - protein, 9 aa, Homo Sapiens
YVNLPTIAL

SEQ ID NO: 153098 - protein, 9 aa, Homo Sapiens
YVQDYEDFM

SEQ ID NO: 153099 - protein, 9 aa, Homo Sapiens
YVSDLELSA

SEQ ID NO: 153100 - protein, 9 aa, Homo Sapiens
YVVDDAAVL

SEQ ID NO: 153101 - protein, 9 aa, Homo Sapiens
YVYSGVETL

SEQ ID NO: 153102 - protein, 10 aa, Homo Sapiens
AAAAAAKVPA

SEQ ID NO: 153103 - protein, 10 aa, Homo Sapiens
AAAEIYEEFL

SEQ ID NO: 153104 - protein, 10 aa, Homo Sapiens
AAAEVLGLIL

SEQ ID NO: 153105 - protein, 10 aa, Homo Sapiens
AADPGLHETL

SEQ ID NO: 153106 - protein, 10 aa, Homo Sapiens
AADTSEARPF

SEQ ID NO: 153107 - protein, 10 aa, Homo Sapiens
AAFLGHLEVL

SEQ ID NO: 153108 - protein, 10 aa, Homo Sapiens
AAIEPDGNGL

SEQ ID NO: 153109 - protein, 10 aa, Homo Sapiens
AAINPELLQL

SEQ ID NO: 153110 - protein, 10 aa, Homo Sapiens
AAVSFAKDFL

SEQ ID NO: 153111 - protein, 10 aa, Homo Sapiens
AAYNGHCEAL

SEQ ID NO: 153112 - protein, 10 aa, Homo Sapiens
APQETRGIPS

SEQ ID NO: 153113 - protein, 10 aa, Homo Sapiens
APRGTGIVSA

SEQ ID NO: 153114 - protein, 10 aa, Homo Sapiens
APYFKGTAVV

SEQ ID NO: 153115 - protein, 10 aa, Homo Sapiens
CALEGRDPEL

SEQ ID NO: 153116 - protein, 10 aa, Homo Sapiens
FAATADPAAL

SEQ ID NO: 153117 - protein, 10 aa, Homo Sapiens
FADDNRFDFL

SEQ ID NO: 153118 - protein, 10 aa, Homo Sapiens
FADDTYPRWV

SEQ ID NO: 153119 - protein, 10 aa, Homo Sapiens
FADPNMLDTL

SEQ ID NO: 153120 - protein, 10 aa, Homo Sapiens
FAEPGSEVYL

SEQ ID NO: 153121 - protein, 10 aa, Homo Sapiens
FAFESDLHSL

SEQ ID NO: 153122 - protein, 10 aa, Homo Sapiens
FAHDDSVMYL

SEQ ID NO: 153123 - protein, 10 aa, Homo Sapiens
FALEPIDITV

SEQ ID NO: 153124 - protein, 10 aa, Homo Sapiens
FALFEKKGAL

SEQ ID NO: 153125 - protein, 10 aa, Homo Sapiens
FALPSPQHIL

SEQ ID NO: 153126 - protein, 10 aa, Homo Sapiens
FAQDGQHQVL

SEQ ID NO: 153127 - protein, 10 aa, Homo Sapiens
FASFEAQGAL

SEQ ID NO: 153128 - protein, 10 aa, Homo Sapiens
FAVEPQGPAL

SEQ ID NO: 153129 - protein, 10 aa, Homo Sapiens
FAVGYKTDEF

SEQ ID NO: 153130 - protein, 10 aa, Homo Sapiens
FAYDGKDYIA

SEQ ID NO: 153131 - protein, 10 aa, Homo Sapiens
FAYKQENEML

SEQ ID NO: 153132 - protein, 10 aa, Homo Sapiens
FAYPNRPDVL

SEQ ID NO: 153133 - protein, 10 aa, Homo Sapiens
FIMEGGAMVL

SEQ ID NO: 153134 - protein, 10 aa, Homo Sapiens
FPKPYPNSEA

SEQ ID NO: 153135 - protein, 10 aa, Homo Sapiens
FSDPAVSQSL

SEQ ID NO: 153136 - protein, 10 aa, Homo Sapiens
FSLDPDIDTL

SEQ ID NO: 153137 - protein, 10 aa, Homo Sapiens
FSYYNSHDSL

SEQ ID NO: 153138 - protein, 10 aa, Homo Sapiens
FVAPPGNISL

SEQ ID NO: 153139 - protein, 10 aa, Homo Sapiens
FVDPNGKISL

SEQ ID NO: 153140 - protein, 10 aa, Homo Sapiens
FVDPSQDHAL

SEQ ID NO: 153141 - protein, 10 aa, Homo Sapiens
FVEDTECRTL

SEQ ID NO: 153142 - protein, 10 aa, Homo Sapiens
FVIQEQNVAL

SEQ ID NO: 153143 - protein, 10 aa, Homo Sapiens
GFGGGGFGSR

SEQ ID NO: 153144 - protein, 10 aa, Homo Sapiens
GPWVGTGLAA

SEQ ID NO: 153145 - protein, 10 aa, Homo Sapiens
HAAEYGAEAL

SEQ ID NO: 153146 - protein, 10 aa, Homo Sapiens
HLHNMPPSAL

SEQ ID NO: 153147 - protein, 10 aa, Homo Sapiens
HPTEDLVVSA

SEQ ID NO: 153148 - protein, 10 aa, Homo Sapiens
HPWETVTTAA

SEQ ID NO: 153149 - protein, 10 aa, Homo Sapiens
IADPKTDHRL

SEQ ID NO: 153150 - protein, 10 aa, Homo Sapiens
IAGPVVEISH

SEQ ID NO: 153151 - protein, 10 aa, Homo Sapiens
IASTFDHPEL

SEQ ID NO: 153152 - protein, 10 aa, Homo Sapiens
IAVEPGNQWF

SEQ ID NO: 153153 - protein, 10 aa, Homo Sapiens
IAVSPESQEM

SEQ ID NO: 153154 - protein, 10 aa, Homo Sapiens
IAYYVSNEEL

SEQ ID NO: 153155 - protein, 10 aa, Homo Sapiens
IESIGCSIQL

SEQ ID NO: 153156 - protein, 10 aa, Homo Sapiens
IPKHINPVAA

SEQ ID NO: 153157 - protein, 10 aa, Homo Sapiens
IPLYLKGGVA

SEQ ID NO: 153158 - protein, 10 aa, Homo Sapiens
KADPCVAHAL

SEQ ID NO: 153159 - protein, 10 aa, Homo Sapiens
KADPHCLNFL

SEQ ID NO: 153160 - protein, 10 aa, Homo Sapiens
KAIDLFTDAI

SEQ ID NO: 153161 - protein, 10 aa, Homo Sapiens
KAIGNAFAVL

SEQ ID NO: 153162 - protein, 10 aa, Homo Sapiens
KAVDPSSVAL

SEQ ID NO: 153163 - protein, 10 aa, Homo Sapiens
KAVDPTSGQL

SEQ ID NO: 153164 - protein, 10 aa, Homo Sapiens
KAVTEQGAEL

SEQ ID NO: 153165 - protein, 10 aa, Homo Sapiens
KPKEVTTVKV

SEQ ID NO: 153166 - protein, 10 aa, Homo Sapiens
KVCGKPFHSL

SEQ ID NO: 153167 - protein, 10 aa, Homo Sapiens
KVDEVGGEAL

SEQ ID NO: 153168 - protein, 10 aa, Homo Sapiens
LADCSHPQEL

SEQ ID NO: 153169 - protein, 10 aa, Homo Sapiens
LADTSDSRAL

SEQ ID NO: 153170 - protein, 10 aa, Homo Sapiens
LAFLGNGDVL

SEQ ID NO: 153171 - protein, 10 aa, Homo Sapiens
LAQDPENQAL

SEQ ID NO: 153172 - protein, 10 aa, Homo Sapiens
LAVDPAILLI

SEQ ID NO: 153173 - protein, 10 aa, Homo Sapiens
LAVEHDNISL

SEQ ID NO: 153174 - protein, 10 aa, Homo Sapiens
LAVHPSGVAL

SEQ ID NO: 153175 - protein, 10 aa, Homo Sapiens
LAYSGKLEEL

SEQ ID NO: 153176 - protein, 10 aa, Homo Sapiens
LDNLECGDIL

SEQ ID NO: 153177 - protein, 10 aa, Homo Sapiens
LPHSAGRYAA

SEQ ID NO: 153178 - protein, 10 aa, Homo Sapiens
LPSGCYGRVA

SEQ ID NO: 153179 - protein, 10 aa, Homo Sapiens
LSDPQVHTVL

SEQ ID NO: 153180 - protein, 10 aa, Homo Sapiens
MALVPRNDSL

SEQ ID NO: 153181 - protein, 10 aa, Homo Sapiens
MAMEPDRKAA

SEQ ID NO: 153182 - protein, 10 aa, Homo Sapiens
MPNGDHIVSA

SEQ ID NO: 153183 - protein, 10 aa, Homo Sapiens
MPNGTPHPTA

SEQ ID NO: 153184 - protein, 10 aa, Homo Sapiens
NAAVPDSVAL

SEQ ID NO: 153185 - protein, 10 aa, Homo Sapiens
NAVPGDVLVL

SEQ ID NO: 153186 - protein, 10 aa, Homo Sapiens
NAVRIEQEFL

SEQ ID NO: 153187 - protein, 10 aa, Homo Sapiens
NPKVQASLAA

SEQ ID NO: 153188 - protein, 10 aa, Homo Sapiens
NPYNGGGRVA

SEQ ID NO: 153189 - protein, 10 aa, Homo Sapiens
PSSAAPPLFN

SEQ ID NO: 153190 - protein, 10 aa, Homo Sapiens
QAINPKLLQL

SEQ ID NO: 153191 - protein, 10 aa, Homo Sapiens
QALPPDVVSL

SEQ ID NO: 153192 - protein, 10 aa, Homo Sapiens
RAEEPPTPAL

SEQ ID NO: 153193 - protein, 10 aa, Homo Sapiens
RAIDNQYTPL

SEQ ID NO: 153194 - protein, 10 aa, Homo Sapiens
RALDHEEEAL

SEQ ID NO: 153195 - protein, 10 aa, Homo Sapiens
RAMEGELGEL

SEQ ID NO: 153196 - protein, 10 aa, Homo Sapiens
RAMVASGSEL

SEQ ID NO: 153197 - protein, 10 aa, Homo Sapiens
RPAAAPPAGA

SEQ ID NO: 153198 - protein, 10 aa, Homo Sapiens
RPAPHFERTA

SEQ ID NO: 153199 - protein, 10 aa, Homo Sapiens
RPAPLPAAVV

SEQ ID NO: 153200 - protein, 10 aa, Homo Sapiens
RPFEGFQRKA

SEQ ID NO: 153201 - protein, 10 aa, Homo Sapiens
RPIPNQPPTA

SEQ ID NO: 153202 - protein, 10 aa, Homo Sapiens
RPKPPNVRTA

SEQ ID NO: 153203 - protein, 10 aa, Homo Sapiens
RPKPPSATSI

SEQ ID NO: 153204 - protein, 10 aa, Homo Sapiens
RPRTEVSLSA

SEQ ID NO: 153205 - protein, 10 aa, Homo Sapiens
RPYGCVLRAA

SEQ ID NO: 153206 - protein, 10 aa, Homo Sapiens
SACPDKGIVL

SEQ ID NO: 153207 - protein, 10 aa, Homo Sapiens
SAFSPSSDSL

SEQ ID NO: 153208 - protein, 10 aa, Homo Sapiens
SAIDVLGETL

SEQ ID NO: 153209 - protein, 10 aa, Homo Sapiens
SAMDLPDVTL

SEQ ID NO: 153210 - protein, 10 aa, Homo Sapiens
SAYDSTMETM

SEQ ID NO: 153211 - protein, 10 aa, Homo Sapiens
SIADADGLFM

SEQ ID NO: 153212 - protein, 10 aa, Homo Sapiens
SIVDPQNQTM

SEQ ID NO: 153213 - protein, 10 aa, Homo Sapiens
SMDNNRSLDL

SEQ ID NO: 153214 - protein, 10 aa, Homo Sapiens
SPHAHISEQA

SEQ ID NO: 153215 - protein, 10 aa, Homo Sapiens
SPHPPSEVTA

SEQ ID NO: 153216 - protein, 10 aa, Homo Sapiens
SPIENIQRVA

SEQ ID NO: 153217 - protein, 10 aa, Homo Sapiens
SPITGEKIPA

SEQ ID NO: 153218 - protein, 10 aa, Homo Sapiens
SPVPSHWMVA

SEQ ID NO: 153219 - protein, 10 aa, Homo Sapiens
STPSEPHPVL

SEQ ID NO: 153220 - protein, 10 aa, Homo Sapiens
SVGESSSKGP

SEQ ID NO: 153221 - protein, 10 aa, Homo Sapiens
TACAHTNVTL

SEQ ID NO: 153222 - protein, 10 aa, Homo Sapiens
TALGPELLAL

SEQ ID NO: 153223 - protein, 10 aa, Homo Sapiens
TAVEGDEVSL

SEQ ID NO: 153224 - protein, 10 aa, Homo Sapiens
TPFQGQGHGA

SEQ ID NO: 153225 - protein, 10 aa, Homo Sapiens
TVVEPYNATL

SEQ ID NO: 153226 - protein, 10 aa, Homo Sapiens
VADDQGQHPL

SEQ ID NO: 153227 - protein, 10 aa, Homo Sapiens
VADGIFKAEL

SEQ ID NO: 153228 - protein, 10 aa, Homo Sapiens
VAEEPAGTSL

SEQ ID NO: 153229 - protein, 10 aa, Homo Sapiens
VAHDGSATYL

SEQ ID NO: 153230 - protein, 10 aa, Homo Sapiens
VAPVGSGSAL

SEQ ID NO: 153231 - protein, 10 aa, Homo Sapiens
VATPPDGVSL

SEQ ID NO: 153232 - protein, 10 aa, Homo Sapiens
VAVDGGKDSL

SEQ ID NO: 153233 - protein, 10 aa, Homo Sapiens
VIADPRGNTL

SEQ ID NO: 153234 - protein, 10 aa, Homo Sapiens
VIDPATATSV

SEQ ID NO: 153235 - protein, 10 aa, Homo Sapiens
VPRQPTVTSV

SEQ ID NO: 153236 - protein, 10 aa, Homo Sapiens
VVIEDFESSL

SEQ ID NO: 153237 - protein, 10 aa, Homo Sapiens
YADPGAEVKI

SEQ ID NO: 153238 - protein, 10 aa, Homo Sapiens
YADPTKRLEL

SEQ ID NO: 153239 - protein, 10 aa, Homo Sapiens
YAHFGIHEEM

SEQ ID NO: 153240 - protein, 10 aa, Homo Sapiens
YAILEKKGAL

SEQ ID NO: 153241 - protein, 10 aa, Homo Sapiens
YALGKDFVTL

SEQ ID NO: 153242 - protein, 10 aa, Homo Sapiens
YAMRAFADAL

SEQ ID NO: 153243 - protein, 10 aa, Homo Sapiens
YASFIEDNEL

SEQ ID NO: 153244 - protein, 10 aa, Homo Sapiens
YAVDRAITHL

SEQ ID NO: 153245 - protein, 10 aa, Homo Sapiens
YAVEGRDLTL

SEQ ID NO: 153246 - protein, 10 aa, Homo Sapiens
YAVELVNDSL

SEQ ID NO: 153247 - protein, 10 aa, Homo Sapiens
YAYDGKDYIA

SEQ ID NO: 153248 - protein, 10 aa, Homo Sapiens
YIHFSEDLTL

SEQ ID NO: 153249 - protein, 10 aa, Homo Sapiens
YTGGSLIPLL

SEQ ID NO: 153250 - protein, 10 aa, Homo Sapiens
YVLDGSGHIL

SEQ ID NO: 153251 - protein, 10 aa, Homo Sapiens
YVPDQPHPEI

SEQ ID NO: 153252 - protein, 11 aa, Homo Sapiens
AAAESGAKEEL

SEQ ID NO: 153253 - protein, 11 aa, Homo Sapiens
AAAPPSPPFSF

SEQ ID NO: 153254 - protein, 11 aa, Homo Sapiens
AAAQPTEEQVL

SEQ ID NO: 153255 - protein, 11 aa, Homo Sapiens
AAAQSREIDCL

SEQ ID NO: 153256 - protein, 11 aa, Homo Sapiens
AACDPRHGRYL

SEQ ID NO: 153257 - protein, 11 aa, Homo Sapiens
AADVAQSTHVL

SEQ ID NO: 153258 - protein, 11 aa, Homo Sapiens
AAENPGKYNIL

SEQ ID NO: 153259 - protein, 11 aa, Homo Sapiens
AAFNSGKVDIV

SEQ ID NO: 153260 - protein, 11 aa, Homo Sapiens
AAFYEDKKGVL

SEQ ID NO: 153261 - protein, 11 aa, Homo Sapiens
AAIDARIFHEL

SEQ ID NO: 153262 - protein, 11 aa, Homo Sapiens
AAKTPSCKDIV

SEQ ID NO: 153263 - protein, 11 aa, Homo Sapiens
AALEEADKMFL

SEQ ID NO: 153264 - protein, 11 aa, Homo Sapiens
AALLDHDAFVL

SEQ ID NO: 153265 - protein, 11 aa, Homo Sapiens
AALPDASPGNL

SEQ ID NO: 153266 - protein, 11 aa, Homo Sapiens
AAVDATVNQVL

SEQ ID NO: 153267 - protein, 11 aa, Homo Sapiens
AIIDPGDSDII

SEQ ID NO: 153268 - protein, 11 aa, Homo Sapiens
AIIDPNHEIEF

SEQ ID NO: 153269 - protein, 11 aa, Homo Sapiens
ANITPREGDEL

SEQ ID NO: 153270 - protein, 11 aa, Homo Sapiens
APRAPRALAAA

SEQ ID NO: 153271 - protein, 11 aa, Homo Sapiens
APRPASGPIRP

SEQ ID NO: 153272 - protein, 11 aa, Homo Sapiens
ASVESSSGEAF

SEQ ID NO: 153273 - protein, 11 aa, Homo Sapiens
ATIDPDTISAL

SEQ ID NO: 153274 - protein, 11 aa, Homo Sapiens
EADRTLIYITL

SEQ ID NO: 153275 - protein, 11 aa, Homo Sapiens
FAAEVVHPGDL

SEQ ID NO: 153276 - protein, 11 aa, Homo Sapiens
FADDGVKYLEL

SEQ ID NO: 153277 - protein, 11 aa, Homo Sapiens
FADGSIRTSEL

SEQ ID NO: 153278 - protein, 11 aa, Homo Sapiens
FAEDITTGQVL

SEQ ID NO: 153279 - protein, 11 aa, Homo Sapiens
FAEDVGSNKGA

SEQ ID NO: 153280 - protein, 11 aa, Homo Sapiens
FAFEGIGDEDL

SEQ ID NO: 153281 - protein, 11 aa, Homo Sapiens
FAHFPGLASEL

SEQ ID NO: 153282 - protein, 11 aa, Homo Sapiens
FAVESEHDQAM

SEQ ID NO: 153283 - protein, 11 aa, Homo Sapiens
FAVPPALGSNL

SEQ ID NO: 153284 - protein, 11 aa, Homo Sapiens
FAYDGKDYIAL

SEQ ID NO: 153285 - protein, 11 aa, Homo Sapiens
FAYDGKDYLTL

SEQ ID NO: 153286 - protein, 11 aa, Homo Sapiens
FAYDPSNYEYL

SEQ ID NO: 153287 - protein, 11 aa, Homo Sapiens
FAYTGRTAQEL

SEQ ID NO: 153288 - protein, 11 aa, Homo Sapiens
FILDPNQENVL

SEQ ID NO: 153289 - protein, 11 aa, Homo Sapiens
FIYNPTTGEFL

SEQ ID NO: 153290 - protein, 11 aa, Homo Sapiens
FSDDPNVTKTL

SEQ ID NO: 153291 - protein, 11 aa, Homo Sapiens
GAYDPADYEHL

SEQ ID NO: 153292 - protein, 11 aa, Homo Sapiens
GGSFRGSYGSS

SEQ ID NO: 153293 - protein, 11 aa, Homo Sapiens
GIWEPKKGDVL

SEQ ID NO: 153294 - protein, 11 aa, Homo Sapiens
HADTVGIDAVL

SEQ ID NO: 153295 - protein, 11 aa, Homo Sapiens
HAFGGLGSHAL

SEQ ID NO: 153296 - protein, 11 aa, Homo Sapiens
HAISPSAADVL

SEQ ID NO: 153297 - protein, 11 aa, Homo Sapiens
HAWSGGLDHQL

SEQ ID NO: 153298 - protein, 11 aa, Homo Sapiens
HAYDGKDYISL

SEQ ID NO: 153299 - protein, 11 aa, Homo Sapiens
IADEVQQRFEL

SEQ ID NO: 153300 - protein, 11 aa, Homo Sapiens
IAITSGEWEVL

SEQ ID NO: 153301 - protein, 11 aa, Homo Sapiens
IAPDVDTYKEI

SEQ ID NO: 153302 - protein, 11 aa, Homo Sapiens
IIHDPGRGAPL

SEQ ID NO: 153303 - protein, 11 aa, Homo Sapiens
IIMEPTECSEL

SEQ ID NO: 153304 - protein, 11 aa, Homo Sapiens
IIQDIDDTHVF

SEQ ID NO: 153305 - protein, 11 aa, Homo Sapiens
IIYEDPQHHPL

SEQ ID NO: 153306 - protein, 11 aa, Homo Sapiens
IQDPSFLHEAL

SEQ ID NO: 153307 - protein, 11 aa, Homo Sapiens
ISPANYEPVHW

SEQ ID NO: 153308 - protein, 11 aa, Homo Sapiens
KADPAAASHPL

SEQ ID NO: 153309 - protein, 11 aa, Homo Sapiens
KALEEPKYSSL

SEQ ID NO: 153310 - protein, 11 aa, Homo Sapiens
KAVTPSPEQVF

SEQ ID NO: 153311 - protein, 11 aa, Homo Sapiens
KAYTAVEGDEV

SEQ ID NO: 153312 - protein, 11 aa, Homo Sapiens
KSVDPENNPTL

SEQ ID NO: 153313 - protein, 11 aa, Homo Sapiens
KTDNSLLDQAL

SEQ ID NO: 153314 - protein, 11 aa, Homo Sapiens
LAADPGLHETL

SEQ ID NO: 153315 - protein, 11 aa, Homo Sapiens
LADETLLKVDL

SEQ ID NO: 153316 - protein, 11 aa, Homo Sapiens
LADMHSTEISL

SEQ ID NO: 153317 - protein, 11 aa, Homo Sapiens
LALDASQHSSL

SEQ ID NO: 153318 - protein, 11 aa, Homo Sapiens
LALDPSLVPTF

SEQ ID NO: 153319 - protein, 11 aa, Homo Sapiens
LAVDPNRAVPL

SEQ ID NO: 153320 - protein, 11 aa, Homo Sapiens
LILEPDKQEAL

SEQ ID NO: 153321 - protein, 11 aa, Homo Sapiens
LILTPTSKDVL

SEQ ID NO: 153322 - protein, 11 aa, Homo Sapiens
MAADRSESPSL

SEQ ID NO: 153323 - protein, 11 aa, Homo Sapiens
MAPSETQFSHL

SEQ ID NO: 153324 - protein, 11 aa, Homo Sapiens
NADPLKVYPPL

SEQ ID NO: 153325 - protein, 11 aa, Homo Sapiens
NAFEDSFSSIL

SEQ ID NO: 153326 - protein, 11 aa, Homo Sapiens
NALDGNRDTPL

SEQ ID NO: 153327 - protein, 11 aa, Homo Sapiens
NAVDDHGKSAL

SEQ ID NO: 153328 - protein, 11 aa, Homo Sapiens
NAVMVDIHDQL

SEQ ID NO: 153329 - protein, 11 aa, Homo Sapiens
NQFAYDGKDYI

SEQ ID NO: 153330 - protein, 11 aa, Homo Sapiens
NVKFPDEDEIL

SEQ ID NO: 153331 - protein, 11 aa, Homo Sapiens
NVYETTEFDQL

SEQ ID NO: 153332 - protein, 11 aa, Homo Sapiens
NVYNPSHSDSL

SEQ ID NO: 153333 - protein, 11 aa, Homo Sapiens
QAISGMIVPPM

SEQ ID NO: 153334 - protein, 11 aa, Homo Sapiens
RAAPAAAGAAL

SEQ ID NO: 153335 - protein, 11 aa, Homo Sapiens
RAAPLDSIHSL

SEQ ID NO: 153336 - protein, 11 aa, Homo Sapiens
RADDTFEALCI

SEQ ID NO: 153337 - protein, 11 aa, Homo Sapiens
RAFLDEDDMSL

SEQ ID NO: 153338 - protein, 11 aa, Homo Sapiens
RAIEALHGHEL

SEQ ID NO: 153339 - protein, 11 aa, Homo Sapiens
RALDAEEEACL

SEQ ID NO: 153340 - protein, 11 aa, Homo Sapiens
RALDEATKYAL

SEQ ID NO: 153341 - protein, 11 aa, Homo Sapiens
RAYYESEINSL

SEQ ID NO: 153342 - protein, 11 aa, Homo Sapiens
RPAGALVALVV

SEQ ID NO: 153343 - protein, 11 aa, Homo Sapiens
RPKPSSSPVIF

SEQ ID NO: 153344 - protein, 11 aa, Homo Sapiens
RPKSAFKVQNA

SEQ ID NO: 153345 - protein, 11 aa, Homo Sapiens
RSIPVNEKDTL

SEQ ID NO: 153346 - protein, 11 aa, Homo Sapiens
SAADPEFCHPL

SEQ ID NO: 153347 - protein, 11 aa, Homo Sapiens
SADTILIGHSL

SEQ ID NO: 153348 - protein, 11 aa, Homo Sapiens
SAFLPDGCDHL

SEQ ID NO: 153349 - protein, 11 aa, Homo Sapiens
SAIAAGVCGAL

SEQ ID NO: 153350 - protein, 11 aa, Homo Sapiens
SAVCSGLAHAL

SEQ ID NO: 153351 - protein, 11 aa, Homo Sapiens
SAVPVNHTQVM

SEQ ID NO: 153352 - protein, 11 aa, Homo Sapiens
SAYHASKCEFL

SEQ ID NO: 153353 - protein, 11 aa, Homo Sapiens
SFGAGGGFGSR

SEQ ID NO: 153354 - protein, 11 aa, Homo Sapiens
SPIENIQRVAA

SEQ ID NO: 153355 - protein, 11 aa, Homo Sapiens
TADDFLNRIAL

SEQ ID NO: 153356 - protein, 11 aa, Homo Sapiens
TADENPDKSTL

SEQ ID NO: 153357 - protein, 11 aa, Homo Sapiens
TAFSPDSRHVL

SEQ ID NO: 153358 - protein, 11 aa, Homo Sapiens
TAFTPAPEDSL

SEQ ID NO: 153359 - protein, 11 aa, Homo Sapiens
VAAPPTAVGSL

SEQ ID NO: 153360 - protein, 11 aa, Homo Sapiens
VACGVDHMVTL

SEQ ID NO: 153361 - protein, 11 aa, Homo Sapiens
VAFEVYDDFLH

SEQ ID NO: 153362 - protein, 11 aa, Homo Sapiens
VAFSPDQQQVL

SEQ ID NO: 153363 - protein, 11 aa, Homo Sapiens
VAIGTHDLDTL

SEQ ID NO: 153364 - protein, 11 aa, Homo Sapiens
VAIHPTSSEEL

SEQ ID NO: 153365 - protein, 11 aa, Homo Sapiens
VAKDPQDDDDL

SEQ ID NO: 153366 - protein, 11 aa, Homo Sapiens
VALSPKTNQTL

SEQ ID NO: 153367 - protein, 11 aa, Homo Sapiens
VAVGSAVGHTL

SEQ ID NO: 153368 - protein, 11 aa, Homo Sapiens
VAVHPSTVNPL

SEQ ID NO: 153369 - protein, 11 aa, Homo Sapiens
VAVSPDDRFIL

SEQ ID NO: 153370 - protein, 11 aa, Homo Sapiens
VIVDPETGKEM

SEQ ID NO: 153371 - protein, 11 aa, Homo Sapiens
VPKPIGGVVVF

SEQ ID NO: 153372 - protein, 11 aa, Homo Sapiens
VSVDASTKDSL

SEQ ID NO: 153373 - protein, 11 aa, Homo Sapiens
VTVKPSQSQVL

SEQ ID NO: 153374 - protein, 11 aa, Homo Sapiens
YACVPLVEQTL

SEQ ID NO: 153375 - protein, 11 aa, Homo Sapiens
YADPNFVRTFL

SEQ ID NO: 153376 - protein, 11 aa, Homo Sapiens
YAFGQETNVPL

SEQ ID NO: 153377 - protein, 11 aa, Homo Sapiens
YAFNSGNVERF

SEQ ID NO: 153378 - protein, 11 aa, Homo Sapiens
YALEEHENQRL

SEQ ID NO: 153379 - protein, 11 aa, Homo Sapiens
YAMPTKTIEVL

SEQ ID NO: 153380 - protein, 11 aa, Homo Sapiens
YAQDFGLVEEA

SEQ ID NO: 153381 - protein, 11 aa, Homo Sapiens
YAVDAYFREAL

SEQ ID NO: 153382 - protein, 11 aa, Homo Sapiens
YAYDGKDYIAL

SEQ ID NO: 153383 - protein, 11 aa, Homo Sapiens
YIMEPSIFNTL

SEQ ID NO: 153384 - protein, 11 aa, Homo Sapiens
YIWDPHNGDIL

SEQ ID NO: 153385 - protein, 11 aa, Homo Sapiens
YSDPGLAGVSL

SEQ ID NO: 153386 - protein, 11 aa, Homo Sapiens
YTFEPRTPDEL

SEQ ID NO: 153387 - protein, 11 aa, Homo Sapiens
YTHEFDGDEEF

SEQ ID NO: 153388 - protein, 11 aa, Homo Sapiens
YVIDSTDEERL

SEQ ID NO: 153389 - protein, 8 aa, Homo Sapiens
AADAGTFL

SEQ ID NO: 153390 - protein, 8 aa, Homo Sapiens
AADAVREL

SEQ ID NO: 153391 - protein, 8 aa, Homo Sapiens
AADGGPKL

SEQ ID NO: 153392 - protein, 8 aa, Homo Sapiens
AADGPQKL

SEQ ID NO: 153393 - protein, 8 aa, Homo Sapiens
AADGSVKL

SEQ ID NO: 153394 - protein, 8 aa, Homo Sapiens
AADISIIV

SEQ ID NO: 153395 - protein, 8 aa, Homo Sapiens
AADITSSL

SEQ ID NO: 153396 - protein, 8 aa, Homo Sapiens
AADQAKQL

SEQ ID NO: 153397 - protein, 8 aa, Homo Sapiens
AADSAVRL

SEQ ID NO: 153398 - protein, 8 aa, Homo Sapiens
AADVGISL

SEQ ID NO: 153399 - protein, 8 aa, Homo Sapiens
ADDKTVRL

SEQ ID NO: 153400 - protein, 8 aa, Homo Sapiens
AFDKHMNL

SEQ ID NO: 153401 - protein, 8 aa, Homo Sapiens
AGDEGRVL

SEQ ID NO: 153402 - protein, 8 aa, Homo Sapiens
AGDVSMFL

SEQ ID NO: 153403 - protein, 8 aa, Homo Sapiens
ALDDGSAL

SEQ ID NO: 153404 - protein, 8 aa, Homo Sapiens
ALDKATVL

SEQ ID NO: 153405 - protein, 8 aa, Homo Sapiens
ALDLNSVL

SEQ ID NO: 153406 - protein, 8 aa, Homo Sapiens
ALDTGFSL

SEQ ID NO: 153407 - protein, 8 aa, Homo Sapiens
ALDVNVAL

SEQ ID NO: 153408 - protein, 8 aa, Homo Sapiens
AQDEAFAL

SEQ ID NO: 153409 - protein, 8 aa, Homo Sapiens
AQDEIPAL

SEQ ID NO: 153410 - protein, 8 aa, Homo Sapiens
AQDPQAVL

SEQ ID NO: 153411 - protein, 8 aa, Homo Sapiens
AQDPSEVL

SEQ ID NO: 153412 - protein, 8 aa, Homo Sapiens
AQDQHYAL

SEQ ID NO: 153413 - protein, 8 aa, Homo Sapiens
AQDVELYL

SEQ ID NO: 153414 - protein, 8 aa, Homo Sapiens
ASDGTVRL

SEQ ID NO: 153415 - protein, 8 aa, Homo Sapiens
ASDIATSV

SEQ ID NO: 153416 - protein, 8 aa, Homo Sapiens
ASDPASSL

SEQ ID NO: 153417 - protein, 8 aa, Homo Sapiens
ASDVAQHL

SEQ ID NO: 153418 - protein, 8 aa, Homo Sapiens
ASDVHGNF

SEQ ID NO: 153419 - protein, 8 aa, Homo Sapiens
ATDIALLL

SEQ ID NO: 153420 - protein, 8 aa, Homo Sapiens
ATDITSSL

SEQ ID NO: 153421 - protein, 8 aa, Homo Sapiens
AVDAGMAM

SEQ ID NO: 153422 - protein, 8 aa, Homo Sapiens
AVDENNKL

SEQ ID NO: 153423 - protein, 8 aa, Homo Sapiens
AVDEPQML

SEQ ID NO: 153424 - protein, 8 aa, Homo Sapiens
AVDICAEL

SEQ ID NO: 153425 - protein, 8 aa, Homo Sapiens
AVDLPVTL

SEQ ID NO: 153426 - protein, 8 aa, Homo Sapiens
AVDPNRAV

SEQ ID NO: 153427 - protein, 8 aa, Homo Sapiens
AVDRTTEL

SEQ ID NO: 153428 - protein, 8 aa, Homo Sapiens
AVDTNLTL

SEQ ID NO: 153429 - protein, 8 aa, Homo Sapiens
AVDTSSEI

SEQ ID NO: 153430 - protein, 8 aa, Homo Sapiens
AVDVNNML

SEQ ID NO: 153431 - protein, 8 aa, Homo Sapiens
CSDRPTVI

SEQ ID NO: 153432 - protein, 8 aa, Homo Sapiens
DEASKKEI

SEQ ID NO: 153433 - protein, 8 aa, Homo Sapiens
DFDLHSEL

SEQ ID NO: 153434 - protein, 8 aa, Homo Sapiens
DQIFQALF

SEQ ID NO: 153435 - protein, 8 aa, Homo Sapiens
DVDVNHHL

SEQ ID NO: 153436 - protein, 8 aa, Homo Sapiens
EADVNIKL

SEQ ID NO: 153437 - protein, 8 aa, Homo Sapiens
EADVSSDL

SEQ ID NO: 153438 - protein, 8 aa, Homo Sapiens
EAPLAKWS

SEQ ID NO: 153439 - protein, 8 aa, Homo Sapiens
EVDINTTL

SEQ ID NO: 153440 - protein, 8 aa, Homo Sapiens
FADAHSNL

SEQ ID NO: 153441 - protein, 8 aa, Homo Sapiens
FADAITEL

SEQ ID NO: 153442 - protein, 8 aa, Homo Sapiens
FADAMEVI

SEQ ID NO: 153443 - protein, 8 aa, Homo Sapiens
FADATVEL

SEQ ID NO: 153444 - protein, 8 aa, Homo Sapiens
FADAVQEL

SEQ ID NO: 153445 - protein, 8 aa, Homo Sapiens
FADDMQEF

SEQ ID NO: 153446 - protein, 8 aa, Homo Sapiens
FADDMYSL

SEQ ID NO: 153447 - protein, 8 aa, Homo Sapiens
FADDVLNL

SEQ ID NO: 153448 - protein, 8 aa, Homo Sapiens
FADENFKL

SEQ ID NO: 153449 - protein, 8 aa, Homo Sapiens
FADFGSAL

SEQ ID NO: 153450 - protein, 8 aa, Homo Sapiens
FADGVILL

SEQ ID NO: 153451 - protein, 8 aa, Homo Sapiens
FADIGNTV

SEQ ID NO: 153452 - protein, 8 aa, Homo Sapiens
FADIIHSL

SEQ ID NO: 153453 - protein, 8 aa, Homo Sapiens
FADISNLL

SEQ ID NO: 153454 - protein, 8 aa, Homo Sapiens
FADKETLI

SEQ ID NO: 153455 - protein, 8 aa, Homo Sapiens
FADKHIQV

SEQ ID NO: 153456 - protein, 8 aa, Homo Sapiens
FADNVSGL

SEQ ID NO: 153457 - protein, 8 aa, Homo Sapiens
FADSSYLL

SEQ ID NO: 153458 - protein, 8 aa, Homo Sapiens
FADVSVKF

SEQ ID NO: 153459 - protein, 8 aa, Homo Sapiens
FADYVSTM

SEQ ID NO: 153460 - protein, 8 aa, Homo Sapiens
FAEENGLL

SEQ ID NO: 153461 - protein, 8 aa, Homo Sapiens
FAERVTSL

SEQ ID NO: 153462 - protein, 8 aa, Homo Sapiens
FFDGAKDV

SEQ ID NO: 153463 - protein, 8 aa, Homo Sapiens
FFDSSVEL

SEQ ID NO: 153464 - protein, 8 aa, Homo Sapiens
FGDISERL

SEQ ID NO: 153465 - protein, 8 aa, Homo Sapiens
FGDKDSKL

SEQ ID NO: 153466 - protein, 8 aa, Homo Sapiens
FGDSEPEL

SEQ ID NO: 153467 - protein, 8 aa, Homo Sapiens
FGDSPLAL

SEQ ID NO: 153468 - protein, 8 aa, Homo Sapiens
FGDVSSRL

SEQ ID NO: 153469 - protein, 8 aa, Homo Sapiens
FGDYNKEV

SEQ ID NO: 153470 - protein, 8 aa, Homo Sapiens
FIDEQQIL

SEQ ID NO: 153471 - protein, 8 aa, Homo Sapiens
FIDFGLDL

SEQ ID NO: 153472 - protein, 8 aa, Homo Sapiens
FIDGGGSV

SEQ ID NO: 153473 - protein, 8 aa, Homo Sapiens
FIDGPLAL

SEQ ID NO: 153474 - protein, 8 aa, Homo Sapiens
FIDKNNDL

SEQ ID NO: 153475 - protein, 8 aa, Homo Sapiens
FIDKNTQL

SEQ ID NO: 153476 - protein, 8 aa, Homo Sapiens
FIDKPVCF

SEQ ID NO: 153477 - protein, 8 aa, Homo Sapiens
FIDKQLEL

SEQ ID NO: 153478 - protein, 8 aa, Homo Sapiens
FIDKQTNL

SEQ ID NO: 153479 - protein, 8 aa, Homo Sapiens
FIDPSSGL

SEQ ID NO: 153480 - protein, 8 aa, Homo Sapiens
FIDQSQSL

SEQ ID NO: 153481 - protein, 8 aa, Homo Sapiens
FITDPVVL

SEQ ID NO: 153482 - protein, 8 aa, Homo Sapiens
FLDDITQL

SEQ ID NO: 153483 - protein, 8 aa, Homo Sapiens
FLDEEVKL

SEQ ID NO: 153484 - protein, 8 aa, Homo Sapiens
FLDGMTEL

SEQ ID NO: 153485 - protein, 8 aa, Homo Sapiens
FLDGQAVL

SEQ ID NO: 153486 - protein, 8 aa, Homo Sapiens
FLDKALEL

SEQ ID NO: 153487 - protein, 8 aa, Homo Sapiens
FLDLARNI

SEQ ID NO: 153488 - protein, 8 aa, Homo Sapiens
FLDNPGIL

SEQ ID NO: 153489 - protein, 8 aa, Homo Sapiens
FLDSMATL

SEQ ID NO: 153490 - protein, 8 aa, Homo Sapiens
FLDVENEL

SEQ ID NO: 153491 - protein, 8 aa, Homo Sapiens
FLDVVSKL

SEQ ID NO: 153492 - protein, 8 aa, Homo Sapiens
FLDYGENL

SEQ ID NO: 153493 - protein, 8 aa, Homo Sapiens
FLEDPSVL

SEQ ID NO: 153494 - protein, 8 aa, Homo Sapiens
FMDPASAL

SEQ ID NO: 153495 - protein, 8 aa, Homo Sapiens
FQDKASEL

SEQ ID NO: 153496 - protein, 8 aa, Homo Sapiens
FQDLIREL

SEQ ID NO: 153497 - protein, 8 aa, Homo Sapiens
FSDGAVSL

SEQ ID NO: 153498 - protein, 8 aa, Homo Sapiens
FSDGDAKL

SEQ ID NO: 153499 - protein, 8 aa, Homo Sapiens
FSDGITSV

SEQ ID NO: 153500 - protein, 8 aa, Homo Sapiens
FSDISEKL

SEQ ID NO: 153501 - protein, 8 aa, Homo Sapiens
FSDLTSQL

SEQ ID NO: 153502 - protein, 8 aa, Homo Sapiens
FSDNPLGL

SEQ ID NO: 153503 - protein, 8 aa, Homo Sapiens
FSDQRSEL

SEQ ID NO: 153504 - protein, 8 aa, Homo Sapiens
FSDQSPTL

SEQ ID NO: 153505 - protein, 8 aa, Homo Sapiens
FSDSHNAL

SEQ ID NO: 153506 - protein, 8 aa, Homo Sapiens
FSDVLPVL

SEQ ID NO: 153507 - protein, 8 aa, Homo Sapiens
FSDVSIDF

SEQ ID NO: 153508 - protein, 8 aa, Homo Sapiens
FSEVADFL

SEQ ID NO: 153509 - protein, 8 aa, Homo Sapiens
FSPVGSVL

SEQ ID NO: 153510 - protein, 8 aa, Homo Sapiens
FSSNPISL

SEQ ID NO: 153511 - protein, 8 aa, Homo Sapiens
FTDGSVTL

SEQ ID NO: 153512 - protein, 8 aa, Homo Sapiens
FTDLSSRF

SEQ ID NO: 153513 - protein, 8 aa, Homo Sapiens
FTDNSKAV

SEQ ID NO: 153514 - protein, 8 aa, Homo Sapiens
FTDTPLQI

SEQ ID NO: 153515 - protein, 8 aa, Homo Sapiens
FTDVSIVM

SEQ ID NO: 153516 - protein, 8 aa, Homo Sapiens
FVDAGNAF

SEQ ID NO: 153517 - protein, 8 aa, Homo Sapiens
FVDAITEL

SEQ ID NO: 153518 - protein, 8 aa, Homo Sapiens
FVDDETKL

SEQ ID NO: 153519 - protein, 8 aa, Homo Sapiens
FVDDGIDL

SEQ ID NO: 153520 - protein, 8 aa, Homo Sapiens
FVDGVSTV

SEQ ID NO: 153521 - protein, 8 aa, Homo Sapiens
FVDPNRSP

SEQ ID NO: 153522 - protein, 8 aa, Homo Sapiens
FVDQFVEL

SEQ ID NO: 153523 - protein, 8 aa, Homo Sapiens
FVDSVGVM

SEQ ID NO: 153524 - protein, 8 aa, Homo Sapiens
FVDTVVAL

SEQ ID NO: 153525 - protein, 8 aa, Homo Sapiens
FWDPSPQL

SEQ ID NO: 153526 - protein, 8 aa, Homo Sapiens
GDDAPRAV

SEQ ID NO: 153527 - protein, 8 aa, Homo Sapiens
GFDRSTSL

SEQ ID NO: 153528 - protein, 8 aa, Homo Sapiens
GIDRPAEL

SEQ ID NO: 153529 - protein, 8 aa, Homo Sapiens
GQDFSLDL

SEQ ID NO: 153530 - protein, 8 aa, Homo Sapiens
GSDTGASL

SEQ ID NO: 153531 - protein, 8 aa, Homo Sapiens
HADSVTGL

SEQ ID NO: 153532 - protein, 8 aa, Homo Sapiens
HADVAQLL

SEQ ID NO: 153533 - protein, 8 aa, Homo Sapiens
HADVGKEL

SEQ ID NO: 153534 - protein, 8 aa, Homo Sapiens
HGDSAMHL

SEQ ID NO: 153535 - protein, 8 aa, Homo Sapiens
HGDTALHV

SEQ ID NO: 153536 - protein, 8 aa, Homo Sapiens
HIDPSGKL

SEQ ID NO: 153537 - protein, 8 aa, Homo Sapiens
HIDSHEAL

SEQ ID NO: 153538 - protein, 8 aa, Homo Sapiens
HLDATTVL

SEQ ID NO: 153539 - protein, 8 aa, Homo Sapiens
HLDTHSGL

SEQ ID NO: 153540 - protein, 8 aa, Homo Sapiens
HPDYNNEL

SEQ ID NO: 153541 - protein, 8 aa, Homo Sapiens
HQDEAVVL

SEQ ID NO: 153542 - protein, 8 aa, Homo Sapiens
HSDGNLCV

SEQ ID NO: 153543 - protein, 8 aa, Homo Sapiens
HSDGSVSL

SEQ ID NO: 153544 - protein, 8 aa, Homo Sapiens
HSDNPSQL

SEQ ID NO: 153545 - protein, 8 aa, Homo Sapiens
HVDAHATL

SEQ ID NO: 153546 - protein, 8 aa, Homo Sapiens
HWDTTQSL

SEQ ID NO: 153547 - protein, 8 aa, Homo Sapiens
IADFFTEL

SEQ ID NO: 153548 - protein, 8 aa, Homo Sapiens
IADFGLAL

SEQ ID NO: 153549 - protein, 8 aa, Homo Sapiens
IADFGWSV

SEQ ID NO: 153550 - protein, 8 aa, Homo Sapiens
IADFQDVL

SEQ ID NO: 153551 - protein, 8 aa, Homo Sapiens
IADLAHLL

SEQ ID NO: 153552 - protein, 8 aa, Homo Sapiens
IADLALQM

SEQ ID NO: 153553 - protein, 8 aa, Homo Sapiens
IADLQQKL

SEQ ID NO: 153554 - protein, 8 aa, Homo Sapiens
IADLVVAV

SEQ ID NO: 153555 - protein, 8 aa, Homo Sapiens
IADQITLL

SEQ ID NO: 153556 - protein, 8 aa, Homo Sapiens
IADRHGGL

SEQ ID NO: 153557 - protein, 8 aa, Homo Sapiens
IADRPLYL

SEQ ID NO: 153558 - protein, 8 aa, Homo Sapiens
IADRSQVL

SEQ ID NO: 153559 - protein, 8 aa, Homo Sapiens
IADSFQVI

SEQ ID NO: 153560 - protein, 8 aa, Homo Sapiens
IADSHQNF

SEQ ID NO: 153561 - protein, 8 aa, Homo Sapiens
IADTGANV

SEQ ID NO: 153562 - protein, 8 aa, Homo Sapiens
IADTSNML

SEQ ID NO: 153563 - protein, 8 aa, Homo Sapiens
IADVSTGL

SEQ ID NO: 153564 - protein, 8 aa, Homo Sapiens
IADVSVQM

SEQ ID NO: 153565 - protein, 8 aa, Homo Sapiens
IDDRNREL

SEQ ID NO: 153566 - protein, 8 aa, Homo Sapiens
IFDEAEKL

SEQ ID NO: 153567 - protein, 8 aa, Homo Sapiens
IFDEGHML

SEQ ID NO: 153568 - protein, 8 aa, Homo Sapiens
IFDIATEL

SEQ ID NO: 153569 - protein, 8 aa, Homo Sapiens
IFDLSEVL

SEQ ID NO: 153570 - protein, 8 aa, Homo Sapiens
IFSEHSCL

SEQ ID NO: 153571 - protein, 8 aa, Homo Sapiens
IGDPNLEF

SEQ ID NO: 153572 - protein, 8 aa, Homo Sapiens
IGDTSGHF

SEQ ID NO: 153573 - protein, 8 aa, Homo Sapiens
IIDESHFL

SEQ ID NO: 153574 - protein, 8 aa, Homo Sapiens
IIDGTSEM

SEQ ID NO: 153575 - protein, 8 aa, Homo Sapiens
IIDKEVSL

SEQ ID NO: 153576 - protein, 8 aa, Homo Sapiens
IIDNHITL

SEQ ID NO: 153577 - protein, 8 aa, Homo Sapiens
IIDPGSTV

SEQ ID NO: 153578 - protein, 8 aa, Homo Sapiens
IIDSGPQL

SEQ ID NO: 153579 - protein, 8 aa, Homo Sapiens
IIDTPGIL

SEQ ID NO: 153580 - protein, 8 aa, Homo Sapiens
ILDEAVEL

SEQ ID NO: 153581 - protein, 8 aa, Homo Sapiens
ILDEGHAI

SEQ ID NO: 153582 - protein, 8 aa, Homo Sapiens
ILDESHSI

SEQ ID NO: 153583 - protein, 8 aa, Homo Sapiens
ILDFETAL

SEQ ID NO: 153584 - protein, 8 aa, Homo Sapiens
ILDNADVL

SEQ ID NO: 153585 - protein, 8 aa, Homo Sapiens
ILDVAQDL

SEQ ID NO: 153586 - protein, 8 aa, Homo Sapiens
IMDPAQYV

SEQ ID NO: 153587 - protein, 8 aa, Homo Sapiens
IQDGSLDL

SEQ ID NO: 153588 - protein, 8 aa, Homo Sapiens
IQDKSEEL

SEQ ID NO: 153589 - protein, 8 aa, Homo Sapiens
ISDKDLEL

SEQ ID NO: 153590 - protein, 8 aa, Homo Sapiens
ISDKDQQL

SEQ ID NO: 153591 - protein, 8 aa, Homo Sapiens
ISDLNELL

SEQ ID NO: 153592 - protein, 8 aa, Homo Sapiens
ISDSNPFL

SEQ ID NO: 153593 - protein, 8 aa, Homo Sapiens
ISDVHFSV

SEQ ID NO: 153594 - protein, 8 aa, Homo Sapiens
ISDYAVKI

SEQ ID NO: 153595 - protein, 8 aa, Homo Sapiens
ITDFDMTL

SEQ ID NO: 153596 - protein, 8 aa, Homo Sapiens
ITDGMRSV

SEQ ID NO: 153597 - protein, 8 aa, Homo Sapiens
ITDIISAL

SEQ ID NO: 153598 - protein, 8 aa, Homo Sapiens
ITDLISEL

SEQ ID NO: 153599 - protein, 8 aa, Homo Sapiens
ITDLPIKL

SEQ ID NO: 153600 - protein, 8 aa, Homo Sapiens
ITDLQNQL

SEQ ID NO: 153601 - protein, 8 aa, Homo Sapiens
ITDMLTEL

SEQ ID NO: 153602 - protein, 8 aa, Homo Sapiens
ITDSPVVV

SEQ ID NO: 153603 - protein, 8 aa, Homo Sapiens
ITDVSWRL

SEQ ID NO: 153604 - protein, 8 aa, Homo Sapiens
ITIDTSYL

SEQ ID NO: 153605 - protein, 8 aa, Homo Sapiens
IVDANLSV

SEQ ID NO: 153606 - protein, 8 aa, Homo Sapiens
IVDEALGL

SEQ ID NO: 153607 - protein, 8 aa, Homo Sapiens
IVDEASQI

SEQ ID NO: 153608 - protein, 8 aa, Homo Sapiens
IVDEGALL

SEQ ID NO: 153609 - protein, 8 aa, Homo Sapiens
IVDGNHRL

SEQ ID NO: 153610 - protein, 8 aa, Homo Sapiens
IVDGNLKL

SEQ ID NO: 153611 - protein, 8 aa, Homo Sapiens
IVDPAREL

SEQ ID NO: 153612 - protein, 8 aa, Homo Sapiens
IVDPSNTL

SEQ ID NO: 153613 - protein, 8 aa, Homo Sapiens
IVDRPVTL

SEQ ID NO: 153614 - protein, 8 aa, Homo Sapiens
IVDTGIGM

SEQ ID NO: 153615 - protein, 8 aa, Homo Sapiens
IWDGSEVL

SEQ ID NO: 153616 - protein, 8 aa, Homo Sapiens
KADCTITM

SEQ ID NO: 153617 - protein, 8 aa, Homo Sapiens
KADEGISF

SEQ ID NO: 153618 - protein, 8 aa, Homo Sapiens
KADGETIL

SEQ ID NO: 153619 - protein, 8 aa, Homo Sapiens
KADIGVAM

SEQ ID NO: 153620 - protein, 8 aa, Homo Sapiens
KADKVTML

SEQ ID NO: 153621 - protein, 8 aa, Homo Sapiens
KADNVVNI

SEQ ID NO: 153622 - protein, 8 aa, Homo Sapiens
KCQPPRGL

SEQ ID NO: 153623 - protein, 8 aa, Homo Sapiens
KGDRAGVL

SEQ ID NO: 153624 - protein, 8 aa, Homo Sapiens
KMDESTLL

SEQ ID NO: 153625 - protein, 8 aa, Homo Sapiens
KQDQSPSL

SEQ ID NO: 153626 - protein, 8 aa, Homo Sapiens
KSDIYLNL

SEQ ID NO: 153627 - protein, 8 aa, Homo Sapiens
KSDLHPTL

SEQ ID NO: 153628 - protein, 8 aa, Homo Sapiens
KSDQSYVI

SEQ ID NO: 153629 - protein, 8 aa, Homo Sapiens
LADAVTWL

SEQ ID NO: 153630 - protein, 8 aa, Homo Sapiens
LADAVVKI

SEQ ID NO: 153631 - protein, 8 aa, Homo Sapiens
LADDHDVL

SEQ ID NO: 153632 - protein, 8 aa, Homo Sapiens
LADFAELI

SEQ ID NO: 153633 - protein, 8 aa, Homo Sapiens
LADGSSRL

SEQ ID NO: 153634 - protein, 8 aa, Homo Sapiens
LADIAQKL

SEQ ID NO: 153635 - protein, 8 aa, Homo Sapiens
LADKGAKL

SEQ ID NO: 153636 - protein, 8 aa, Homo Sapiens
LADLPQQL

SEQ ID NO: 153637 - protein, 8 aa, Homo Sapiens
LADPGAVA

SEQ ID NO: 153638 - protein, 8 aa, Homo Sapiens
LADQCTGL

SEQ ID NO: 153639 - protein, 8 aa, Homo Sapiens
LADQEVRL

SEQ ID NO: 153640 - protein, 8 aa, Homo Sapiens
LADVGSFL

SEQ ID NO: 153641 - protein, 8 aa, Homo Sapiens
LADVHIEV

SEQ ID NO: 153642 - protein, 8 aa, Homo Sapiens
LADVTNAL

SEQ ID NO: 153643 - protein, 8 aa, Homo Sapiens
LDVPTAAV

SEQ ID NO: 153644 - protein, 8 aa, Homo Sapiens
LFDAVSSL

SEQ ID NO: 153645 - protein, 8 aa, Homo Sapiens
LFDQANKL

SEQ ID NO: 153646 - protein, 8 aa, Homo Sapiens
LFDSLSTL

SEQ ID NO: 153647 - protein, 8 aa, Homo Sapiens
LFDTAISL

SEQ ID NO: 153648 - protein, 8 aa, Homo Sapiens
LGDKHATL

SEQ ID NO: 153649 - protein, 8 aa, Homo Sapiens
LGDPASAL

SEQ ID NO: 153650 - protein, 8 aa, Homo Sapiens
LIDMGSSL

SEQ ID NO: 153651 - protein, 8 aa, Homo Sapiens
LIDSSRVL

SEQ ID NO: 153652 - protein, 8 aa, Homo Sapiens
LLDLHSYL

SEQ ID NO: 153653 - protein, 8 aa, Homo Sapiens
LLDPNTTL

SEQ ID NO: 153654 - protein, 8 aa, Homo Sapiens
LLDSCTKL

SEQ ID NO: 153655 - protein, 8 aa, Homo Sapiens
LPDGGSCL

SEQ ID NO: 153656 - protein, 8 aa, Homo Sapiens
LQDLATQL

SEQ ID NO: 153657 - protein, 8 aa, Homo Sapiens
LQDVNREL

SEQ ID NO: 153658 - protein, 8 aa, Homo Sapiens
LSDGIQEL

SEQ ID NO: 153659 - protein, 8 aa, Homo Sapiens
LSDGNPSL

SEQ ID NO: 153660 - protein, 8 aa, Homo Sapiens
LSDGVAVL

SEQ ID NO: 153661 - protein, 8 aa, Homo Sapiens
LSDLENIL

SEQ ID NO: 153662 - protein, 8 aa, Homo Sapiens
LSDLSTKL

SEQ ID NO: 153663 - protein, 8 aa, Homo Sapiens
LSDPSLDM

SEQ ID NO: 153664 - protein, 8 aa, Homo Sapiens
LSDPSQDL

SEQ ID NO: 153665 - protein, 8 aa, Homo Sapiens
LSDPSSRL

SEQ ID NO: 153666 - protein, 8 aa, Homo Sapiens
LSDVAEKL

SEQ ID NO: 153667 - protein, 8 aa, Homo Sapiens
LSDYGYHL

SEQ ID NO: 153668 - protein, 8 aa, Homo Sapiens
LTDEFREL

SEQ ID NO: 153669 - protein, 8 aa, Homo Sapiens
LTDEQVAL

SEQ ID NO: 153670 - protein, 8 aa, Homo Sapiens
LTDHHESL

SEQ ID NO: 153671 - protein, 8 aa, Homo Sapiens
LTDICTQL

SEQ ID NO: 153672 - protein, 8 aa, Homo Sapiens
LTDPSQRL

SEQ ID NO: 153673 - protein, 8 aa, Homo Sapiens
LTDPSTQL

SEQ ID NO: 153674 - protein, 8 aa, Homo Sapiens
LTDTDAAI

SEQ ID NO: 153675 - protein, 8 aa, Homo Sapiens
LTNTNRAL

SEQ ID NO: 153676 - protein, 8 aa, Homo Sapiens
LTVTDLEI

SEQ ID NO: 153677 - protein, 8 aa, Homo Sapiens
LVDCSVAL

SEQ ID NO: 153678 - protein, 8 aa, Homo Sapiens
LVDIGETL

SEQ ID NO: 153679 - protein, 8 aa, Homo Sapiens
LVDQSAAL

SEQ ID NO: 153680 - protein, 8 aa, Homo Sapiens
LVDTTVEL

SEQ ID NO: 153681 - protein, 8 aa, Homo Sapiens
MADSGESL

SEQ ID NO: 153682 - protein, 8 aa, Homo Sapiens
MFDFSEKL

SEQ ID NO: 153683 - protein, 8 aa, Homo Sapiens
MLDVAEEL

SEQ ID NO: 153684 - protein, 8 aa, Homo Sapiens
MPDSAAAL

SEQ ID NO: 153685 - protein, 8 aa, Homo Sapiens
MSDLPVKV

SEQ ID NO: 153686 - protein, 8 aa, Homo Sapiens
MTDPNVAL

SEQ ID NO: 153687 - protein, 8 aa, Homo Sapiens
MVDLNDYL

SEQ ID NO: 153688 - protein, 8 aa, Homo Sapiens
MVDVGSLL

SEQ ID NO: 153689 - protein, 8 aa, Homo Sapiens
NADCVVVL

SEQ ID NO: 153690 - protein, 8 aa, Homo Sapiens
NADEARSL

SEQ ID NO: 153691 - protein, 8 aa, Homo Sapiens
NADIGLRL

SEQ ID NO: 153692 - protein, 8 aa, Homo Sapiens
NADISQSL

SEQ ID NO: 153693 - protein, 8 aa, Homo Sapiens
NADIVTLL

SEQ ID NO: 153694 - protein, 8 aa, Homo Sapiens
NADKVLEL

SEQ ID NO: 153695 - protein, 8 aa, Homo Sapiens
NADLSITL

SEQ ID NO: 153696 - protein, 8 aa, Homo Sapiens
NADQPLRV

SEQ ID NO: 153697 - protein, 8 aa, Homo Sapiens
NADSGVHL

SEQ ID NO: 153698 - protein, 8 aa, Homo Sapiens
NADTGTKL

SEQ ID NO: 153699 - protein, 8 aa, Homo Sapiens
NADTTRNL

SEQ ID NO: 153700 - protein, 8 aa, Homo Sapiens
NADVHASL

SEQ ID NO: 153701 - protein, 8 aa, Homo Sapiens
NADVQERL

SEQ ID NO: 153702 - protein, 8 aa, Homo Sapiens
NADVVNVL

SEQ ID NO: 153703 - protein, 8 aa, Homo Sapiens
NADWPAGL

SEQ ID NO: 153704 - protein, 8 aa, Homo Sapiens
NAESNAEL

SEQ ID NO: 153705 - protein, 8 aa, Homo Sapiens
NFDGSSTL

SEQ ID NO: 153706 - protein, 8 aa, Homo Sapiens
NFDNSPVL

SEQ ID NO: 153707 - protein, 8 aa, Homo Sapiens
NIDTSSDL

SEQ ID NO: 153708 - protein, 8 aa, Homo Sapiens
NQDPANIL

SEQ ID NO: 153709 - protein, 8 aa, Homo Sapiens
NSDLSEKL

SEQ ID NO: 153710 - protein, 8 aa, Homo Sapiens
NSDPTNVL

SEQ ID NO: 153711 - protein, 8 aa, Homo Sapiens
NSDRSIPM

SEQ ID NO: 153712 - protein, 8 aa, Homo Sapiens
NSDVSGSF

SEQ ID NO: 153713 - protein, 8 aa, Homo Sapiens
NTDEMVEL

SEQ ID NO: 153714 - protein, 8 aa, Homo Sapiens
NTDPSIVM

SEQ ID NO: 153715 - protein, 8 aa, Homo Sapiens
NTDVPLVL

SEQ ID NO: 153716 - protein, 8 aa, Homo Sapiens
NWDIAHMI

SEQ ID NO: 153717 - protein, 8 aa, Homo Sapiens
PINGNGKQ

SEQ ID NO: 153718 - protein, 8 aa, Homo Sapiens
PVDISTAM

SEQ ID NO: 153719 - protein, 8 aa, Homo Sapiens
QADCAVLI

SEQ ID NO: 153720 - protein, 8 aa, Homo Sapiens
QADLAYQL

SEQ ID NO: 153721 - protein, 8 aa, Homo Sapiens
QEDPNAVL

SEQ ID NO: 153722 - protein, 8 aa, Homo Sapiens
QFDVATHL

SEQ ID NO: 153723 - protein, 8 aa, Homo Sapiens
QSEPSGHI

SEQ ID NO: 153724 - protein, 8 aa, Homo Sapiens
RADEHIAL

SEQ ID NO: 153725 - protein, 8 aa, Homo Sapiens
RADRPSSL

SEQ ID NO: 153726 - protein, 8 aa, Homo Sapiens
REVVNTEL

SEQ ID NO: 153727 - protein, 8 aa, Homo Sapiens
RIDEFEAL

SEQ ID NO: 153728 - protein, 8 aa, Homo Sapiens
RSDSYVEL

SEQ ID NO: 153729 - protein, 8 aa, Homo Sapiens
RSDTPAML

SEQ ID NO: 153730 - protein, 8 aa, Homo Sapiens
RTDLNPIL

SEQ ID NO: 153731 - protein, 8 aa, Homo Sapiens
RVDSPVTV

SEQ ID NO: 153732 - protein, 8 aa, Homo Sapiens
SADATRCL

SEQ ID NO: 153733 - protein, 8 aa, Homo Sapiens
SADEANVL

SEQ ID NO: 153734 - protein, 8 aa, Homo Sapiens
SADEPMTT

SEQ ID NO: 153735 - protein, 8 aa, Homo Sapiens
SADFHVDL

SEQ ID NO: 153736 - protein, 8 aa, Homo Sapiens
SADFKTEL

SEQ ID NO: 153737 - protein, 8 aa, Homo Sapiens
SADFSSML

SEQ ID NO: 153738 - protein, 8 aa, Homo Sapiens
SADGHSIL

SEQ ID NO: 153739 - protein, 8 aa, Homo Sapiens
SADGHTML

SEQ ID NO: 153740 - protein, 8 aa, Homo Sapiens
SADGIVRI

SEQ ID NO: 153741 - protein, 8 aa, Homo Sapiens
SADGSPAL

SEQ ID NO: 153742 - protein, 8 aa, Homo Sapiens
SADGTVRI

SEQ ID NO: 153743 - protein, 8 aa, Homo Sapiens
SADHCVQL

SEQ ID NO: 153744 - protein, 8 aa, Homo Sapiens
SADKFQVL

SEQ ID NO: 153745 - protein, 8 aa, Homo Sapiens
SADKGGFL

SEQ ID NO: 153746 - protein, 8 aa, Homo Sapiens
SADKNFYL

SEQ ID NO: 153747 - protein, 8 aa, Homo Sapiens
SADKTVKL

SEQ ID NO: 153748 - protein, 8 aa, Homo Sapiens
SADLEATL

SEQ ID NO: 153749 - protein, 8 aa, Homo Sapiens
SADLVAQL

SEQ ID NO: 153750 - protein, 8 aa, Homo Sapiens
SADNAFHL

SEQ ID NO: 153751 - protein, 8 aa, Homo Sapiens
SADNSCRL

SEQ ID NO: 153752 - protein, 8 aa, Homo Sapiens
SADTAATL

SEQ ID NO: 153753 - protein, 8 aa, Homo Sapiens
SADTDILL

SEQ ID NO: 153754 - protein, 8 aa, Homo Sapiens
SDDIPHAL

SEQ ID NO: 153755 - protein, 8 aa, Homo Sapiens
SDFGGRSL

SEQ ID NO: 153756 - protein, 8 aa, Homo Sapiens
SDHAPHTL

SEQ ID NO: 153757 - protein, 8 aa, Homo Sapiens
SFDESLAL

SEQ ID NO: 153758 - protein, 8 aa, Homo Sapiens
SGDEMTSL

SEQ ID NO: 153759 - protein, 8 aa, Homo Sapiens
SGDINTSI

SEQ ID NO: 153760 - protein, 8 aa, Homo Sapiens
SGDPGPAL

SEQ ID NO: 153761 - protein, 8 aa, Homo Sapiens
SGDVSGKL

SEQ ID NO: 153762 - protein, 8 aa, Homo Sapiens
SIDAVEPL

SEQ ID NO: 153763 - protein, 8 aa, Homo Sapiens
SIDLNWDL

SEQ ID NO: 153764 - protein, 8 aa, Homo Sapiens
SLDEVVLL

SEQ ID NO: 153765 - protein, 8 aa, Homo Sapiens
SLDFGGHL

SEQ ID NO: 153766 - protein, 8 aa, Homo Sapiens
SLDQHTSL

SEQ ID NO: 153767 - protein, 8 aa, Homo Sapiens
SLDSPVLL

SEQ ID NO: 153768 - protein, 8 aa, Homo Sapiens
SNDVATLL

SEQ ID NO: 153769 - protein, 8 aa, Homo Sapiens
SQDFSSYL

SEQ ID NO: 153770 - protein, 8 aa, Homo Sapiens
SQDINSHL

SEQ ID NO: 153771 - protein, 8 aa, Homo Sapiens
SQDVHVVL

SEQ ID NO: 153772 - protein, 8 aa, Homo Sapiens
SSDDANVL

SEQ ID NO: 153773 - protein, 8 aa, Homo Sapiens
SSDEAVIL

SEQ ID NO: 153774 - protein, 8 aa, Homo Sapiens
SSDLPQVL

SEQ ID NO: 153775 - protein, 8 aa, Homo Sapiens
SSDLPVAL

SEQ ID NO: 153776 - protein, 8 aa, Homo Sapiens
SSDQPLTV

SEQ ID NO: 153777 - protein, 8 aa, Homo Sapiens
SSDSPTTL

SEQ ID NO: 153778 - protein, 8 aa, Homo Sapiens
SSDVNLEL

SEQ ID NO: 153779 - protein, 8 aa, Homo Sapiens
SSDVSERL

SEQ ID NO: 153780 - protein, 8 aa, Homo Sapiens
STDENLIL

SEQ ID NO: 153781 - protein, 8 aa, Homo Sapiens
STDISAVL

SEQ ID NO: 153782 - protein, 8 aa, Homo Sapiens
STDPNSVF

SEQ ID NO: 153783 - protein, 8 aa, Homo Sapiens
STDTCYVL

SEQ ID NO: 153784 - protein, 8 aa, Homo Sapiens
STDYGNFL

SEQ ID NO: 153785 - protein, 8 aa, Homo Sapiens
SVDANTKL

SEQ ID NO: 153786 - protein, 8 aa, Homo Sapiens
SVDEQNAL

SEQ ID NO: 153787 - protein, 8 aa, Homo Sapiens
SVDISHTL

SEQ ID NO: 153788 - protein, 8 aa, Homo Sapiens
SVDKGECL

SEQ ID NO: 153789 - protein, 8 aa, Homo Sapiens
SVDKVLEL

SEQ ID NO: 153790 - protein, 8 aa, Homo Sapiens
SVDLGPTL

SEQ ID NO: 153791 - protein, 8 aa, Homo Sapiens
SVDQPLKI

SEQ ID NO: 153792 - protein, 8 aa, Homo Sapiens
SVDTARTL

SEQ ID NO: 153793 - protein, 8 aa, Homo Sapiens
SWDESLSL

SEQ ID NO: 153794 - protein, 8 aa, Homo Sapiens
TADAHHYL

SEQ ID NO: 153795 - protein, 8 aa, Homo Sapiens
TADEIVKL

SEQ ID NO: 153796 - protein, 8 aa, Homo Sapiens
TADICQML

SEQ ID NO: 153797 - protein, 8 aa, Homo Sapiens
TADIGCVL

SEQ ID NO: 153798 - protein, 8 aa, Homo Sapiens
TADISSHF

SEQ ID NO: 153799 - protein, 8 aa, Homo Sapiens
TADITHAL

SEQ ID NO: 153800 - protein, 8 aa, Homo Sapiens
TADSSHYL

SEQ ID NO: 153801 - protein, 8 aa, Homo Sapiens
TADVNSGF

SEQ ID NO: 153802 - protein, 8 aa, Homo Sapiens
TDHNLHEL

SEQ ID NO: 153803 - protein, 8 aa, Homo Sapiens
TFDVHLDL

SEQ ID NO: 153804 - protein, 8 aa, Homo Sapiens
TGDFGGNL

SEQ ID NO: 153805 - protein, 8 aa, Homo Sapiens
TIDEIQKL

SEQ ID NO: 153806 - protein, 8 aa, Homo Sapiens
TIDGPLCL

SEQ ID NO: 153807 - protein, 8 aa, Homo Sapiens
TIDGPSKV

SEQ ID NO: 153808 - protein, 8 aa, Homo Sapiens
TIDKNTKI

SEQ ID NO: 153809 - protein, 8 aa, Homo Sapiens
TIDKVSVL

SEQ ID NO: 153810 - protein, 8 aa, Homo Sapiens
TIDPSHPM

SEQ ID NO: 153811 - protein, 8 aa, Homo Sapiens
TIDPSNPM

SEQ ID NO: 153812 - protein, 8 aa, Homo Sapiens
TIDTDTLL

SEQ ID NO: 153813 - protein, 8 aa, Homo Sapiens
TIDVTDFL

SEQ ID NO: 153814 - protein, 8 aa, Homo Sapiens
TNDAATIL

SEQ ID NO: 153815 - protein, 8 aa, Homo Sapiens
TNDISHYL

SEQ ID NO: 153816 - protein, 8 aa, Homo Sapiens
TQDLGNDL

SEQ ID NO: 153817 - protein, 8 aa, Homo Sapiens
TSDFNTFL

SEQ ID NO: 153818 - protein, 8 aa, Homo Sapiens
TSDLHFQV

SEQ ID NO: 153819 - protein, 8 aa, Homo Sapiens
TSDPAEVL

SEQ ID NO: 153820 - protein, 8 aa, Homo Sapiens
TSDPAQHL

SEQ ID NO: 153821 - protein, 8 aa, Homo Sapiens
TSDQPILL

SEQ ID NO: 153822 - protein, 8 aa, Homo Sapiens
TSDVGATL

SEQ ID NO: 153823 - protein, 8 aa, Homo Sapiens
TSDWPTVL

SEQ ID NO: 153824 - protein, 8 aa, Homo Sapiens
TTDAAQTL

SEQ ID NO: 153825 - protein, 8 aa, Homo Sapiens
TTDISIDL

SEQ ID NO: 153826 - protein, 8 aa, Homo Sapiens
TTDLGRSL

SEQ ID NO: 153827 - protein, 8 aa, Homo Sapiens
TVDLSSHL

SEQ ID NO: 153828 - protein, 8 aa, Homo Sapiens
TVDMNIAL

SEQ ID NO: 153829 - protein, 8 aa, Homo Sapiens
VADAGAFL

SEQ ID NO: 153830 - protein, 8 aa, Homo Sapiens
VADDPIVM

SEQ ID NO: 153831 - protein, 8 aa, Homo Sapiens
VADFADKL

SEQ ID NO: 153832 - protein, 8 aa, Homo Sapiens
VADHGLTL

SEQ ID NO: 153833 - protein, 8 aa, Homo Sapiens
VADKDTVL

SEQ ID NO: 153834 - protein, 8 aa, Homo Sapiens
VADKFTEL

SEQ ID NO: 153835 - protein, 8 aa, Homo Sapiens
VADKHELL

SEQ ID NO: 153836 - protein, 8 aa, Homo Sapiens
VADLAESI

SEQ ID NO: 153837 - protein, 8 aa, Homo Sapiens
VADLAHVL

SEQ ID NO: 153838 - protein, 8 aa, Homo Sapiens
VADLHLYL

SEQ ID NO: 153839 - protein, 8 aa, Homo Sapiens
VADLQTRL

SEQ ID NO: 153840 - protein, 8 aa, Homo Sapiens
VADLSRSL

SEQ ID NO: 153841 - protein, 8 aa, Homo Sapiens
VADPDNPL

SEQ ID NO: 153842 - protein, 8 aa, Homo Sapiens
VADPGGSL

SEQ ID NO: 153843 - protein, 8 aa, Homo Sapiens
VADPGVTV

SEQ ID NO: 153844 - protein, 8 aa, Homo Sapiens
VADRFSEL

SEQ ID NO: 153845 - protein, 8 aa, Homo Sapiens
VADSGLTL

SEQ ID NO: 153846 - protein, 8 aa, Homo Sapiens
VADSKTLL

SEQ ID NO: 153847 - protein, 8 aa, Homo Sapiens
VADVEALL

SEQ ID NO: 153848 - protein, 8 aa, Homo Sapiens
VADYMRYL

SEQ ID NO: 153849 - protein, 8 aa, Homo Sapiens
VAEFHTEL

SEQ ID NO: 153850 - protein, 8 aa, Homo Sapiens
VDKSGRTL

SEQ ID NO: 153851 - protein, 8 aa, Homo Sapiens
VFDLAQTL

SEQ ID NO: 153852 - protein, 8 aa, Homo Sapiens
VFDLVRTL

SEQ ID NO: 153853 - protein, 8 aa, Homo Sapiens
VFDPHGTL

SEQ ID NO: 153854 - protein, 8 aa, Homo Sapiens
VFDSHPVL

SEQ ID NO: 153855 - protein, 8 aa, Homo Sapiens
VFDVGGLL

SEQ ID NO: 153856 - protein, 8 aa, Homo Sapiens
VGDEASEL

SEQ ID NO: 153857 - protein, 8 aa, Homo Sapiens
VGDLSPEI

SEQ ID NO: 153858 - protein, 8 aa, Homo Sapiens
VGDRSSNL

SEQ ID NO: 153859 - protein, 8 aa, Homo Sapiens
VGDVGQTV

SEQ ID NO: 153860 - protein, 8 aa, Homo Sapiens
VGDVNLFL

SEQ ID NO: 153861 - protein, 8 aa, Homo Sapiens
VGDVSLQL

SEQ ID NO: 153862 - protein, 8 aa, Homo Sapiens
VHDPAGAL

SEQ ID NO: 153863 - protein, 8 aa, Homo Sapiens
VIDAAVLL

SEQ ID NO: 153864 - protein, 8 aa, Homo Sapiens
VIDDAFAL

SEQ ID NO: 153865 - protein, 8 aa, Homo Sapiens
VIDECVEM

SEQ ID NO: 153866 - protein, 8 aa, Homo Sapiens
VIDEIISL

SEQ ID NO: 153867 - protein, 8 aa, Homo Sapiens
VIDEPVRL

SEQ ID NO: 153868 - protein, 8 aa, Homo Sapiens
VIDGVTVL

SEQ ID NO: 153869 - protein, 8 aa, Homo Sapiens
VIDICMKL

SEQ ID NO: 153870 - protein, 8 aa, Homo Sapiens
VIDLGEAF

SEQ ID NO: 153871 - protein, 8 aa, Homo Sapiens
VIDQNRAL

SEQ ID NO: 153872 - protein, 8 aa, Homo Sapiens
VIDSPGIL

SEQ ID NO: 153873 - protein, 8 aa, Homo Sapiens
VIDVAPEL

SEQ ID NO: 153874 - protein, 8 aa, Homo Sapiens
VIDVGSEW

SEQ ID NO: 153875 - protein, 8 aa, Homo Sapiens
VIDYSNAF

SEQ ID NO: 153876 - protein, 8 aa, Homo Sapiens
VLDAGPVL

SEQ ID NO: 153877 - protein, 8 aa, Homo Sapiens
VLDEADKL

SEQ ID NO: 153878 - protein, 8 aa, Homo Sapiens
VLDELSLL

SEQ ID NO: 153879 - protein, 8 aa, Homo Sapiens
VLDELVRP

SEQ ID NO: 153880 - protein, 8 aa, Homo Sapiens
VLDHFSEL

SEQ ID NO: 153881 - protein, 8 aa, Homo Sapiens
VLDIARQL

SEQ ID NO: 153882 - protein, 8 aa, Homo Sapiens
VLDNSGEW

SEQ ID NO: 153883 - protein, 8 aa, Homo Sapiens
VLDPNMDL

SEQ ID NO: 153884 - protein, 8 aa, Homo Sapiens
VLDSFGEL

SEQ ID NO: 153885 - protein, 8 aa, Homo Sapiens
VLDTNIQL

SEQ ID NO: 153886 - protein, 8 aa, Homo Sapiens
VLDTSDAL

SEQ ID NO: 153887 - protein, 8 aa, Homo Sapiens
VLDVSNSF

SEQ ID NO: 153888 - protein, 8 aa, Homo Sapiens
VMDEADRI

SEQ ID NO: 153889 - protein, 8 aa, Homo Sapiens
VMDVNTAL

SEQ ID NO: 153890 - protein, 8 aa, Homo Sapiens
VNDLTTAL

SEQ ID NO: 153891 - protein, 8 aa, Homo Sapiens
VQDLAKAV

SEQ ID NO: 153892 - protein, 8 aa, Homo Sapiens
VSDDPQVL

SEQ ID NO: 153893 - protein, 8 aa, Homo Sapiens
VSDEHSLF

SEQ ID NO: 153894 - protein, 8 aa, Homo Sapiens
VSDEYEQL

SEQ ID NO: 153895 - protein, 8 aa, Homo Sapiens
VSDIGKEL

SEQ ID NO: 153896 - protein, 8 aa, Homo Sapiens
VSDINFTL

SEQ ID NO: 153897 - protein, 8 aa, Homo Sapiens
VSDKDTGL

SEQ ID NO: 153898 - protein, 8 aa, Homo Sapiens
VSDLISVL

SEQ ID NO: 153899 - protein, 8 aa, Homo Sapiens
VSDMIMEL

SEQ ID NO: 153900 - protein, 8 aa, Homo Sapiens
VSDPGRCL

SEQ ID NO: 153901 - protein, 8 aa, Homo Sapiens
VSDPMNAL

SEQ ID NO: 153902 - protein, 8 aa, Homo Sapiens
VSDYEMKL

SEQ ID NO: 153903 - protein, 8 aa, Homo Sapiens
VSEESNVL

SEQ ID NO: 153904 - protein, 8 aa, Homo Sapiens
VTDAIVLL

SEQ ID NO: 153905 - protein, 8 aa, Homo Sapiens
VTDDGMAV

SEQ ID NO: 153906 - protein, 8 aa, Homo Sapiens
VTDDLVCL

SEQ ID NO: 153907 - protein, 8 aa, Homo Sapiens
VTDDPTQV

SEQ ID NO: 153908 - protein, 8 aa, Homo Sapiens
VTDRNITL

SEQ ID NO: 153909 - protein, 8 aa, Homo Sapiens
VTDVSLEL

SEQ ID NO: 153910 - protein, 8 aa, Homo Sapiens
VVDDTLEL

SEQ ID NO: 153911 - protein, 8 aa, Homo Sapiens
VVDESDKL

SEQ ID NO: 153912 - protein, 8 aa, Homo Sapiens
VVDHQTEL

SEQ ID NO: 153913 - protein, 8 aa, Homo Sapiens
VVDIVQEL

SEQ ID NO: 153914 - protein, 8 aa, Homo Sapiens
VVDQPLKL

SEQ ID NO: 153915 - protein, 8 aa, Homo Sapiens
WADEAEKA

SEQ ID NO: 153916 - protein, 8 aa, Homo Sapiens
WADVQSQL

SEQ ID NO: 153917 - protein, 8 aa, Homo Sapiens
WMDEAQAL

SEQ ID NO: 153918 - protein, 8 aa, Homo Sapiens
YADDNSLL

SEQ ID NO: 153919 - protein, 8 aa, Homo Sapiens
YADGESFL

SEQ ID NO: 153920 - protein, 8 aa, Homo Sapiens
YADGTWEL

SEQ ID NO: 153921 - protein, 8 aa, Homo Sapiens
YADIVDVL

SEQ ID NO: 153922 - protein, 8 aa, Homo Sapiens
YADIVQLL

SEQ ID NO: 153923 - protein, 8 aa, Homo Sapiens
YADLQDAL

SEQ ID NO: 153924 - protein, 8 aa, Homo Sapiens
YADLVKAL

SEQ ID NO: 153925 - protein, 8 aa, Homo Sapiens
YADRVKEL

SEQ ID NO: 153926 - protein, 8 aa, Homo Sapiens
YADTELLL

SEQ ID NO: 153927 - protein, 8 aa, Homo Sapiens
YADVQAVL

SEQ ID NO: 153928 - protein, 8 aa, Homo Sapiens
YAEGVRVL

SEQ ID NO: 153929 - protein, 8 aa, Homo Sapiens
YFDEPVEL

SEQ ID NO: 153930 - protein, 8 aa, Homo Sapiens
YGDKHITL

SEQ ID NO: 153931 - protein, 8 aa, Homo Sapiens
YGENSNSL

SEQ ID NO: 153932 - protein, 8 aa, Homo Sapiens
YIDKSTQL

SEQ ID NO: 153933 - protein, 8 aa, Homo Sapiens
YIDSSWEL

SEQ ID NO: 153934 - protein, 8 aa, Homo Sapiens
YIDVAVKL

SEQ ID NO: 153935 - protein, 8 aa, Homo Sapiens
YIDVQSII

SEQ ID NO: 153936 - protein, 8 aa, Homo Sapiens
YLDDWTVL

SEQ ID NO: 153937 - protein, 8 aa, Homo Sapiens
YLDEGFLL

SEQ ID NO: 153938 - protein, 8 aa, Homo Sapiens
YLDESNAL

SEQ ID NO: 153939 - protein, 8 aa, Homo Sapiens
YLDGEVEL

SEQ ID NO: 153940 - protein, 8 aa, Homo Sapiens
YLDINTVL

SEQ ID NO: 153941 - protein, 8 aa, Homo Sapiens
YLDKISEL

SEQ ID NO: 153942 - protein, 8 aa, Homo Sapiens
YLDLEATL

SEQ ID NO: 153943 - protein, 8 aa, Homo Sapiens
YLDPALEL

SEQ ID NO: 153944 - protein, 8 aa, Homo Sapiens
YLDSEQRL

SEQ ID NO: 153945 - protein, 8 aa, Homo Sapiens
YSDAIVWL

SEQ ID NO: 153946 - protein, 8 aa, Homo Sapiens
YSDDKVQL

SEQ ID NO: 153947 - protein, 8 aa, Homo Sapiens
YSDIVTTL

SEQ ID NO: 153948 - protein, 8 aa, Homo Sapiens
YSDLAEFL

SEQ ID NO: 153949 - protein, 8 aa, Homo Sapiens
YSDRISEL

SEQ ID NO: 153950 - protein, 8 aa, Homo Sapiens
YSDSTAKL

SEQ ID NO: 153951 - protein, 8 aa, Homo Sapiens
YSDVSGLL

SEQ ID NO: 153952 - protein, 8 aa, Homo Sapiens
YTDEAVVI

SEQ ID NO: 153953 - protein, 8 aa, Homo Sapiens
YTDELVEL

SEQ ID NO: 153954 - protein, 8 aa, Homo Sapiens
YTDFVMEL

SEQ ID NO: 153955 - protein, 8 aa, Homo Sapiens
YTDPQSKL

SEQ ID NO: 153956 - protein, 8 aa, Homo Sapiens
YVDDSIAL

SEQ ID NO: 153957 - protein, 8 aa, Homo Sapiens
YVDKNLEL

SEQ ID NO: 153958 - protein, 8 aa, Homo Sapiens
YYDNADKL

SEQ ID NO: 153959 - protein, 9 aa, Homo Sapiens
AAAAPRAVA

SEQ ID NO: 153960 - protein, 9 aa, Homo Sapiens
AAADASPSL

SEQ ID NO: 153961 - protein, 9 aa, Homo Sapiens
AAAGSPLSL

SEQ ID NO: 153962 - protein, 9 aa, Homo Sapiens
AAAGSPVFL

SEQ ID NO: 153963 - protein, 9 aa, Homo Sapiens
AACGGHVEL

SEQ ID NO: 153964 - protein, 9 aa, Homo Sapiens
AADAALRVL

SEQ ID NO: 153965 - protein, 9 aa, Homo Sapiens
AADAEPLEI

SEQ ID NO: 153966 - protein, 9 aa, Homo Sapiens
AADAKPESL

SEQ ID NO: 153967 - protein, 9 aa, Homo Sapiens
AADDDVKCL

SEQ ID NO: 153968 - protein, 9 aa, Homo Sapiens
AADDFLEDL

SEQ ID NO: 153969 - protein, 9 aa, Homo Sapiens
AADDHQALI

SEQ ID NO: 153970 - protein, 9 aa, Homo Sapiens
AADDHTVKL

SEQ ID NO: 153971 - protein, 9 aa, Homo Sapiens
AADDIHRSL

SEQ ID NO: 153972 - protein, 9 aa, Homo Sapiens
AADDLYSML

SEQ ID NO: 153973 - protein, 9 aa, Homo Sapiens
AADDSKLVL

SEQ ID NO: 153974 - protein, 9 aa, Homo Sapiens
AADDSSVKL

SEQ ID NO: 153975 - protein, 9 aa, Homo Sapiens
AADEITHCI

SEQ ID NO: 153976 - protein, 9 aa, Homo Sapiens
AADEPVTVL

SEQ ID NO: 153977 - protein, 9 aa, Homo Sapiens
AADEVLAVL

SEQ ID NO: 153978 - protein, 9 aa, Homo Sapiens
AADEVREKL

SEQ ID NO: 153979 - protein, 9 aa, Homo Sapiens
AADFAQMEL

SEQ ID NO: 153980 - protein, 9 aa, Homo Sapiens
AADFEIGHF

SEQ ID NO: 153981 - protein, 9 aa, Homo Sapiens
AADFVKAFI

SEQ ID NO: 153982 - protein, 9 aa, Homo Sapiens
AADGKGVVV

SEQ ID NO: 153983 - protein, 9 aa, Homo Sapiens
AADGKLLKL

SEQ ID NO: 153984 - protein, 9 aa, Homo Sapiens
AADGKVQVL

SEQ ID NO: 153985 - protein, 9 aa, Homo Sapiens
AADGPMPFL

SEQ ID NO: 153986 - protein, 9 aa, Homo Sapiens
AADGPQKLL

SEQ ID NO: 153987 - protein, 9 aa, Homo Sapiens
AADIENRVL

SEQ ID NO: 153988 - protein, 9 aa, Homo Sapiens
AADIPQTAV

SEQ ID NO: 153989 - protein, 9 aa, Homo Sapiens
AADKIHSSF

SEQ ID NO: 153990 - protein, 9 aa, Homo Sapiens
AADKRLTVL

SEQ ID NO: 153991 - protein, 9 aa, Homo Sapiens
AADLAHITA

SEQ ID NO: 153992 - protein, 9 aa, Homo Sapiens
AADLGSPSL

SEQ ID NO: 153993 - protein, 9 aa, Homo Sapiens
AADLKQFCL

SEQ ID NO: 153994 - protein, 9 aa, Homo Sapiens
AADLLVVHL

SEQ ID NO: 153995 - protein, 9 aa, Homo Sapiens
AADLPARGF

SEQ ID NO: 153996 - protein, 9 aa, Homo Sapiens
AADLPTKPT

SEQ ID NO: 153997 - protein, 9 aa, Homo Sapiens
AADLSEIEI

SEQ ID NO: 153998 - protein, 9 aa, Homo Sapiens
AADLSLHSF

SEQ ID NO: 153999 - protein, 9 aa, Homo Sapiens
AADLSMLVL

SEQ ID NO: 154000 - protein, 9 aa, Homo Sapiens
AADLVEKSF

SEQ ID NO: 154001 - protein, 9 aa, Homo Sapiens
AADMLGLSL

SEQ ID NO: 154002 - protein, 9 aa, Homo Sapiens
AADMNECCL

SEQ ID NO: 154003 - protein, 9 aa, Homo Sapiens
AADNCLREL

SEQ ID NO: 154004 - protein, 9 aa, Homo Sapiens
AADPSVVNL

SEQ ID NO: 154005 - protein, 9 aa, Homo Sapiens
AADPSWNSL

SEQ ID NO: 154006 - protein, 9 aa, Homo Sapiens
AADPVSPLL

SEQ ID NO: 154007 - protein, 9 aa, Homo Sapiens
AADQAKQLL

SEQ ID NO: 154008 - protein, 9 aa, Homo Sapiens
AADRCGAAL

SEQ ID NO: 154009 - protein, 9 aa, Homo Sapiens
AADRPGVSL

SEQ ID NO: 154010 - protein, 9 aa, Homo Sapiens
AADSAVRLW

SEQ ID NO: 154011 - protein, 9 aa, Homo Sapiens
AADSKSLVL

SEQ ID NO: 154012 - protein, 9 aa, Homo Sapiens
AADSPGSGL

SEQ ID NO: 154013 - protein, 9 aa, Homo Sapiens
AADSPSQNL

SEQ ID NO: 154014 - protein, 9 aa, Homo Sapiens
AADSWYLAL

SEQ ID NO: 154015 - protein, 9 aa, Homo Sapiens
AADSYFSLL

SEQ ID NO: 154016 - protein, 9 aa, Homo Sapiens
AADVILKTL

SEQ ID NO: 154017 - protein, 9 aa, Homo Sapiens
AADWHNLIL

SEQ ID NO: 154018 - protein, 9 aa, Homo Sapiens
AADYSQLEL

SEQ ID NO: 154019 - protein, 9 aa, Homo Sapiens
AAEAAEVIL

SEQ ID NO: 154020 - protein, 9 aa, Homo Sapiens
AAEAEPRAL

SEQ ID NO: 154021 - protein, 9 aa, Homo Sapiens
AAEAGAMTL

SEQ ID NO: 154022 - protein, 9 aa, Homo Sapiens
AAEATPVAL

SEQ ID NO: 154023 - protein, 9 aa, Homo Sapiens
AAEEAMKAL

SEQ ID NO: 154024 - protein, 9 aa, Homo Sapiens
AAEEANAVL

SEQ ID NO: 154025 - protein, 9 aa, Homo Sapiens
AAEEESRVL

SEQ ID NO: 154026 - protein, 9 aa, Homo Sapiens
AAEEFKVPA

SEQ ID NO: 154027 - protein, 9 aa, Homo Sapiens
AAEEPLSLL

SEQ ID NO: 154028 - protein, 9 aa, Homo Sapiens
AAEEPNAAV

SEQ ID NO: 154029 - protein, 9 aa, Homo Sapiens
AAEEPVSEV

SEQ ID NO: 154030 - protein, 9 aa, Homo Sapiens
AAEFGGESF

SEQ ID NO: 154031 - protein, 9 aa, Homo Sapiens
AAEFLTSKL

SEQ ID NO: 154032 - protein, 9 aa, Homo Sapiens
AAEFVPSFL

SEQ ID NO: 154033 - protein, 9 aa, Homo Sapiens
AAEKSITIL

SEQ ID NO: 154034 - protein, 9 aa, Homo Sapiens
AAELPGSSA

SEQ ID NO: 154035 - protein, 9 aa, Homo Sapiens
AAENIGSEL

SEQ ID NO: 154036 - protein, 9 aa, Homo Sapiens
AAEPTPTQV

SEQ ID NO: 154037 - protein, 9 aa, Homo Sapiens
AAERPGEAA

SEQ ID NO: 154038 - protein, 9 aa, Homo Sapiens
AAESMPLLL

SEQ ID NO: 154039 - protein, 9 aa, Homo Sapiens
AAETPALEL

SEQ ID NO: 154040 - protein, 9 aa, Homo Sapiens
AAETQSPSL

SEQ ID NO: 154041 - protein, 9 aa, Homo Sapiens
AAEVAATEI

SEQ ID NO: 154042 - protein, 9 aa, Homo Sapiens
AAEYGLVVL

SEQ ID NO: 154043 - protein, 9 aa, Homo Sapiens
AAGEPGTSM

SEQ ID NO: 154044 - protein, 9 aa, Homo Sapiens
AAVDAGMAM

SEQ ID NO: 154045 - protein, 9 aa, Homo Sapiens
AGDDAPRAV

SEQ ID NO: 154046 - protein, 9 aa, Homo Sapiens
AGDDCQAGL

SEQ ID NO: 154047 - protein, 9 aa, Homo Sapiens
AGDDPSVPL

SEQ ID NO: 154048 - protein, 9 aa, Homo Sapiens
AGDDRVLVM

SEQ ID NO: 154049 - protein, 9 aa, Homo Sapiens
AGDEGRVLL

SEQ ID NO: 154050 - protein, 9 aa, Homo Sapiens
AGDFSKTSL

SEQ ID NO: 154051 - protein, 9 aa, Homo Sapiens
AGDGGRVAL

SEQ ID NO: 154052 - protein, 9 aa, Homo Sapiens
AGDHVSLTL

SEQ ID NO: 154053 - protein, 9 aa, Homo Sapiens
AGDLPGLAA

SEQ ID NO: 154054 - protein, 9 aa, Homo Sapiens
AGDMGELAL

SEQ ID NO: 154055 - protein, 9 aa, Homo Sapiens
AGDNKNSVL

SEQ ID NO: 154056 - protein, 9 aa, Homo Sapiens
AGDSGFVSL

SEQ ID NO: 154057 - protein, 9 aa, Homo Sapiens
AGDSHTAAL

SEQ ID NO: 154058 - protein, 9 aa, Homo Sapiens
AGDSPGSQF

SEQ ID NO: 154059 - protein, 9 aa, Homo Sapiens
AGDTTNFHF

SEQ ID NO: 154060 - protein, 9 aa, Homo Sapiens
AIDDVDIDL

SEQ ID NO: 154061 - protein, 9 aa, Homo Sapiens
AIDEALAAL

SEQ ID NO: 154062 - protein, 9 aa, Homo Sapiens
AIDEDLTAL

SEQ ID NO: 154063 - protein, 9 aa, Homo Sapiens
AIDENKNAL

SEQ ID NO: 154064 - protein, 9 aa, Homo Sapiens
AIDFGEQAL

SEQ ID NO: 154065 - protein, 9 aa, Homo Sapiens
AIDIHNKTL

SEQ ID NO: 154066 - protein, 9 aa, Homo Sapiens
AIDIPHIWL

SEQ ID NO: 154067 - protein, 9 aa, Homo Sapiens
AIDIQNAYL

SEQ ID NO: 154068 - protein, 9 aa, Homo Sapiens
AIDQRNQQL

SEQ ID NO: 154069 - protein, 9 aa, Homo Sapiens
AIDRAGAEV

SEQ ID NO: 154070 - protein, 9 aa, Homo Sapiens
AIDSPVSFL

SEQ ID NO: 154071 - protein, 9 aa, Homo Sapiens
AKDEPDTNL

SEQ ID NO: 154072 - protein, 9 aa, Homo Sapiens
ALDDMISTL

SEQ ID NO: 154073 - protein, 9 aa, Homo Sapiens
ALDEAAAAL

SEQ ID NO: 154074 - protein, 9 aa, Homo Sapiens
ALDEPTTNL

SEQ ID NO: 154075 - protein, 9 aa, Homo Sapiens
ALDGDQMEL

SEQ ID NO: 154076 - protein, 9 aa, Homo Sapiens
ALDGGPRAL

SEQ ID NO: 154077 - protein, 9 aa, Homo Sapiens
ALDKATVLL

SEQ ID NO: 154078 - protein, 9 aa, Homo Sapiens
ALDKSSSTL

SEQ ID NO: 154079 - protein, 9 aa, Homo Sapiens
ALDLAPSSL

SEQ ID NO: 154080 - protein, 9 aa, Homo Sapiens
ALDLESLSL

SEQ ID NO: 154081 - protein, 9 aa, Homo Sapiens
ALDPPGPTL

SEQ ID NO: 154082 - protein, 9 aa, Homo Sapiens
ALDSEGRAL

SEQ ID NO: 154083 - protein, 9 aa, Homo Sapiens
ALDSGVSTM

SEQ ID NO: 154084 - protein, 9 aa, Homo Sapiens
ALDTGWNEL

SEQ ID NO: 154085 - protein, 9 aa, Homo Sapiens
ALDVPHAEL

SEQ ID NO: 154086 - protein, 9 aa, Homo Sapiens
ALDVPNTAF

SEQ ID NO: 154087 - protein, 9 aa, Homo Sapiens
ALDVPNTML

SEQ ID NO: 154088 - protein, 9 aa, Homo Sapiens
ALDVQEHSL

SEQ ID NO: 154089 - protein, 9 aa, Homo Sapiens
ALEDMFDAL

SEQ ID NO: 154090 - protein, 9 aa, Homo Sapiens
AMDLIISTL

SEQ ID NO: 154091 - protein, 9 aa, Homo Sapiens
AMDLPDVTL

SEQ ID NO: 154092 - protein, 9 aa, Homo Sapiens
AMDLVKNHL

SEQ ID NO: 154093 - protein, 9 aa, Homo Sapiens
ANDDPNGIF

SEQ ID NO: 154094 - protein, 9 aa, Homo Sapiens
ANDEATVSV

SEQ ID NO: 154095 - protein, 9 aa, Homo Sapiens
ANDVSFATI

SEQ ID NO: 154096 - protein, 9 aa, Homo Sapiens
AQDDPDSCL

SEQ ID NO: 154097 - protein, 9 aa, Homo Sapiens
AQDEHLITF

SEQ ID NO: 154098 - protein, 9 aa, Homo Sapiens
AQDELGRTL

SEQ ID NO: 154099 - protein, 9 aa, Homo Sapiens
AQDEPAESL

SEQ ID NO: 154100 - protein, 9 aa, Homo Sapiens
AQDLGVVNL

SEQ ID NO: 154101 - protein, 9 aa, Homo Sapiens
AQDLIRTIL

SEQ ID NO: 154102 - protein, 9 aa, Homo Sapiens
AQDLITRLL

SEQ ID NO: 154103 - protein, 9 aa, Homo Sapiens
AQDLQKERL

SEQ ID NO: 154104 - protein, 9 aa, Homo Sapiens
AQDLSREQL

SEQ ID NO: 154105 - protein, 9 aa, Homo Sapiens
AQDPEIASL

SEQ ID NO: 154106 - protein, 9 aa, Homo Sapiens
AQDPENQAL

SEQ ID NO: 154107 - protein, 9 aa, Homo Sapiens
AQDQLHNAL

SEQ ID NO: 154108 - protein, 9 aa, Homo Sapiens
AQDWPATSL

SEQ ID NO: 154109 - protein, 9 aa, Homo Sapiens
AQDYLQCVL

SEQ ID NO: 154110 - protein, 9 aa, Homo Sapiens
ASDCSPKEL

SEQ ID NO: 154111 - protein, 9 aa, Homo Sapiens
ASDDGTVRI

SEQ ID NO: 154112 - protein, 9 aa, Homo Sapiens
ASDDHTICL

SEQ ID NO: 154113 - protein, 9 aa, Homo Sapiens
ASDDHTVCL

SEQ ID NO: 154114 - protein, 9 aa, Homo Sapiens
ASDEPDRAL

SEQ ID NO: 154115 - protein, 9 aa, Homo Sapiens
ASDFGQVGL

SEQ ID NO: 154116 - protein, 9 aa, Homo Sapiens
ASDFPHISA

SEQ ID NO: 154117 - protein, 9 aa, Homo Sapiens
ASDGVVAAI

SEQ ID NO: 154118 - protein, 9 aa, Homo Sapiens
ASDHAPHTL

SEQ ID NO: 154119 - protein, 9 aa, Homo Sapiens
ASDIAMTEL

SEQ ID NO: 154120 - protein, 9 aa, Homo Sapiens
ASDIPGLHL

SEQ ID NO: 154121 - protein, 9 aa, Homo Sapiens
ASDITSASM

SEQ ID NO: 154122 - protein, 9 aa, Homo Sapiens
ASDKETYEL

SEQ ID NO: 154123 - protein, 9 aa, Homo Sapiens
ASDLESKQL

SEQ ID NO: 154124 - protein, 9 aa, Homo Sapiens
ASDLGSAAV

SEQ ID NO: 154125 - protein, 9 aa, Homo Sapiens
ASDLQRHSI

SEQ ID NO: 154126 - protein, 9 aa, Homo Sapiens
ASDLTRIHF

SEQ ID NO: 154127 - protein, 9 aa, Homo Sapiens
ASDLVTTVF

SEQ ID NO: 154128 - protein, 9 aa, Homo Sapiens
ASDQKVKAL

SEQ ID NO: 154129 - protein, 9 aa, Homo Sapiens
ASDQPSHSL

SEQ ID NO: 154130 - protein, 9 aa, Homo Sapiens
ASDQPWSGL

SEQ ID NO: 154131 - protein, 9 aa, Homo Sapiens
ASDSGAVEL

SEQ ID NO: 154132 - protein, 9 aa, Homo Sapiens
ASDVGSITL

SEQ ID NO: 154133 - protein, 9 aa, Homo Sapiens
ASDVVFATM

SEQ ID NO: 154134 - protein, 9 aa, Homo Sapiens
ASDVVLEVL

SEQ ID NO: 154135 - protein, 9 aa, Homo Sapiens
ASEEPWTVL

SEQ ID NO: 154136 - protein, 9 aa, Homo Sapiens
ATDAVGIVL

SEQ ID NO: 154137 - protein, 9 aa, Homo Sapiens
ATDDSLHQL

SEQ ID NO: 154138 - protein, 9 aa, Homo Sapiens
ATDFAENEL

SEQ ID NO: 154139 - protein, 9 aa, Homo Sapiens
ATDIQVLAL

SEQ ID NO: 154140 - protein, 9 aa, Homo Sapiens
ATDISTHSL

SEQ ID NO: 154141 - protein, 9 aa, Homo Sapiens
ATDLLSVAL

SEQ ID NO: 154142 - protein, 9 aa, Homo Sapiens
ATDPNILSL

SEQ ID NO: 154143 - protein, 9 aa, Homo Sapiens
ATDPSARTL

SEQ ID NO: 154144 - protein, 9 aa, Homo Sapiens
ATDRHPQAL

SEQ ID NO: 154145 - protein, 9 aa, Homo Sapiens
ATDTKNVQF

SEQ ID NO: 154146 - protein, 9 aa, Homo Sapiens
ATDYDNIEI

SEQ ID NO: 154147 - protein, 9 aa, Homo Sapiens
ATDYGGTSV

SEQ ID NO: 154148 - protein, 9 aa, Homo Sapiens
ATDYGMKSI

SEQ ID NO: 154149 - protein, 9 aa, Homo Sapiens
ATEEPGESF

SEQ ID NO: 154150 - protein, 9 aa, Homo Sapiens
ATEEPGPCL

SEQ ID NO: 154151 - protein, 9 aa, Homo Sapiens
AVDAVIAEL

SEQ ID NO: 154152 - protein, 9 aa, Homo Sapiens
AVDEAADAL

SEQ ID NO: 154153 - protein, 9 aa, Homo Sapiens
AVDELFTSL

SEQ ID NO: 154154 - protein, 9 aa, Homo Sapiens
AVDGISLHL

SEQ ID NO: 154155 - protein, 9 aa, Homo Sapiens
AVDGNTVEL

SEQ ID NO: 154156 - protein, 9 aa, Homo Sapiens
AVDIPHMDI

SEQ ID NO: 154157 - protein, 9 aa, Homo Sapiens
AVDKANLEI

SEQ ID NO: 154158 - protein, 9 aa, Homo Sapiens
AVDKAQAEL

SEQ ID NO: 154159 - protein, 9 aa, Homo Sapiens
AVDKSYCTL

SEQ ID NO: 154160 - protein, 9 aa, Homo Sapiens
AVDKTGRIL

SEQ ID NO: 154161 - protein, 9 aa, Homo Sapiens
AVDLCGAAL

SEQ ID NO: 154162 - protein, 9 aa, Homo Sapiens
AVDPNGAFL

SEQ ID NO: 154163 - protein, 9 aa, Homo Sapiens
AVDPQITSL

SEQ ID NO: 154164 - protein, 9 aa, Homo Sapiens
AVDPQPSVV

SEQ ID NO: 154165 - protein, 9 aa, Homo Sapiens
AVDPSSVAL

SEQ ID NO: 154166 - protein, 9 aa, Homo Sapiens
AVDPTSGQL

SEQ ID NO: 154167 - protein, 9 aa, Homo Sapiens
AVDRAITHL

SEQ ID NO: 154168 - protein, 9 aa, Homo Sapiens
AVDSTGTYM

SEQ ID NO: 154169 - protein, 9 aa, Homo Sapiens
AVDTKNNVL

SEQ ID NO: 154170 - protein, 9 aa, Homo Sapiens
AVDTNPLSL

SEQ ID NO: 154171 - protein, 9 aa, Homo Sapiens
AVDWDPTAL

SEQ ID NO: 154172 - protein, 9 aa, Homo Sapiens
CGDKPSISA

SEQ ID NO: 154173 - protein, 9 aa, Homo Sapiens
CQDIGAKSL

SEQ ID NO: 154174 - protein, 9 aa, Homo Sapiens
CSEKEGLSL

SEQ ID NO: 154175 - protein, 9 aa, Homo Sapiens
DADDAVYEL

SEQ ID NO: 154176 - protein, 9 aa, Homo Sapiens
DADQASNIL

SEQ ID NO: 154177 - protein, 9 aa, Homo Sapiens
DDSLPVLLE

SEQ ID NO: 154178 - protein, 9 aa, Homo Sapiens
DTNIVLGAL

SEQ ID NO: 154179 - protein, 9 aa, Homo Sapiens
EADFPKNPL

SEQ ID NO: 154180 - protein, 9 aa, Homo Sapiens
EADGAAWVL

SEQ ID NO: 154181 - protein, 9 aa, Homo Sapiens
EADGVHNTL

SEQ ID NO: 154182 - protein, 9 aa, Homo Sapiens
EADRAQQYF

SEQ ID NO: 154183 - protein, 9 aa, Homo Sapiens
EAEIPGANL

SEQ ID NO: 154184 - protein, 9 aa, Homo Sapiens
EESILDLVL

SEQ ID NO: 154185 - protein, 9 aa, Homo Sapiens
EGDLPNAVL

SEQ ID NO: 154186 - protein, 9 aa, Homo Sapiens
EIDLQKMPL

SEQ ID NO: 154187 - protein, 9 aa, Homo Sapiens
EIDVPSHEL

SEQ ID NO: 154188 - protein, 9 aa, Homo Sapiens
ESDDPNLAA

SEQ ID NO: 154189 - protein, 9 aa, Homo Sapiens
ESDYSKESL

SEQ ID NO: 154190 - protein, 9 aa, Homo Sapiens
EVDGKQVEL

SEQ ID NO: 154191 - protein, 9 aa, Homo Sapiens
EVDHPGPAL

SEQ ID NO: 154192 - protein, 9 aa, Homo Sapiens
EVDPGSAEL

SEQ ID NO: 154193 - protein, 9 aa, Homo Sapiens
FACEKNENL

SEQ ID NO: 154194 - protein, 9 aa, Homo Sapiens
FADAGLVCI

SEQ ID NO: 154195 - protein, 9 aa, Homo Sapiens
FADAHSNLA

SEQ ID NO: 154196 - protein, 9 aa, Homo Sapiens
FADAMEVIP

SEQ ID NO: 154197 - protein, 9 aa, Homo Sapiens
FADAVQELL

SEQ ID NO: 154198 - protein, 9 aa, Homo Sapiens
FADDGVKYL

SEQ ID NO: 154199 - protein, 9 aa, Homo Sapiens
FADDPCSSV

SEQ ID NO: 154200 - protein, 9 aa, Homo Sapiens
FADDYKIAI

SEQ ID NO: 154201 - protein, 9 aa, Homo Sapiens
FADEGSIFY

SEQ ID NO: 154202 - protein, 9 aa, Homo Sapiens
FADELSHLL

SEQ ID NO: 154203 - protein, 9 aa, Homo Sapiens
FADENNEKL

SEQ ID NO: 154204 - protein, 9 aa, Homo Sapiens
FADEVRLSF

SEQ ID NO: 154205 - protein, 9 aa, Homo Sapiens
FADFERHFL

SEQ ID NO: 154206 - protein, 9 aa, Homo Sapiens
FADFLQAHL

SEQ ID NO: 154207 - protein, 9 aa, Homo Sapiens
FADFLVYEF

SEQ ID NO: 154208 - protein, 9 aa, Homo Sapiens
FADFMVKDV

SEQ ID NO: 154209 - protein, 9 aa, Homo Sapiens
FADGFVKAL

SEQ ID NO: 154210 - protein, 9 aa, Homo Sapiens
FADGFVLVY

SEQ ID NO: 154211 - protein, 9 aa, Homo Sapiens
FADGHVLEL

SEQ ID NO: 154212 - protein, 9 aa, Homo Sapiens
FADGKVYAL

SEQ ID NO: 154213 - protein, 9 aa, Homo Sapiens
FADGLSLGL

SEQ ID NO: 154214 - protein, 9 aa, Homo Sapiens
FADGVILLL

SEQ ID NO: 154215 - protein, 9 aa, Homo Sapiens
FADGVYLVL

SEQ ID NO: 154216 - protein, 9 aa, Homo Sapiens
FADHVSSSL

SEQ ID NO: 154217 - protein, 9 aa, Homo Sapiens
FADHVVPLL

SEQ ID NO: 154218 - protein, 9 aa, Homo Sapiens
FADKHIQVL

SEQ ID NO: 154219 - protein, 9 aa, Homo Sapiens
FADLGYKQM

SEQ ID NO: 154220 - protein, 9 aa, Homo Sapiens
FADLLGTAF

SEQ ID NO: 154221 - protein, 9 aa, Homo Sapiens
FADLNLAEF

SEQ ID NO: 154222 - protein, 9 aa, Homo Sapiens
FADNDVSRF

SEQ ID NO: 154223 - protein, 9 aa, Homo Sapiens
FADNPGPMV

SEQ ID NO: 154224 - protein, 9 aa, Homo Sapiens
FADPIAANL

SEQ ID NO: 154225 - protein, 9 aa, Homo Sapiens
FADQAEILL

SEQ ID NO: 154226 - protein, 9 aa, Homo Sapiens
FADQENQVA

SEQ ID NO: 154227 - protein, 9 aa, Homo Sapiens
FADQEVRSL

SEQ ID NO: 154228 - protein, 9 aa, Homo Sapiens
FADQVEEIL

SEQ ID NO: 154229 - protein, 9 aa, Homo Sapiens
FADREVQLL

SEQ ID NO: 154230 - protein, 9 aa, Homo Sapiens
FADVAPLQL

SEQ ID NO: 154231 - protein, 9 aa, Homo Sapiens
FADVEGKNL

SEQ ID NO: 154232 - protein, 9 aa, Homo Sapiens
FADVNGWHL

SEQ ID NO: 154233 - protein, 9 aa, Homo Sapiens
FADWYLEQL

SEQ ID NO: 154234 - protein, 9 aa, Homo Sapiens
FADYNLLDL

SEQ ID NO: 154235 - protein, 9 aa, Homo Sapiens
FADYPCHTV

SEQ ID NO: 154236 - protein, 9 aa, Homo Sapiens
FADYRPTEV

SEQ ID NO: 154237 - protein, 9 aa, Homo Sapiens
FAEAGRSTL

SEQ ID NO: 154238 - protein, 9 aa, Homo Sapiens
FAEASGLEL

SEQ ID NO: 154239 - protein, 9 aa, Homo Sapiens
FAEAVGVQL

SEQ ID NO: 154240 - protein, 9 aa, Homo Sapiens
FAEDPPTSL

SEQ ID NO: 154241 - protein, 9 aa, Homo Sapiens
FAEEFAHSI

SEQ ID NO: 154242 - protein, 9 aa, Homo Sapiens
FAEEPGLVL

SEQ ID NO: 154243 - protein, 9 aa, Homo Sapiens
FAEEQTLVL

SEQ ID NO: 154244 - protein, 9 aa, Homo Sapiens
FAEERNQNL

SEQ ID NO: 154245 - protein, 9 aa, Homo Sapiens
FAEEVGAAL

SEQ ID NO: 154246 - protein, 9 aa, Homo Sapiens
FAEGFVKAL

SEQ ID NO: 154247 - protein, 9 aa, Homo Sapiens
FAEGFVRAL

SEQ ID NO: 154248 - protein, 9 aa, Homo Sapiens
FAEGKPLAL

SEQ ID NO: 154249 - protein, 9 aa, Homo Sapiens
FAEQPSVKL

SEQ ID NO: 154250 - protein, 9 aa, Homo Sapiens
FAERSVAKL

SEQ ID NO: 154251 - protein, 9 aa, Homo Sapiens
FAETIETVL

SEQ ID NO: 154252 - protein, 9 aa, Homo Sapiens
FAEWKVDML

SEQ ID NO: 154253 - protein, 9 aa, Homo Sapiens
FAGYSEEVL

SEQ ID NO: 154254 - protein, 9 aa, Homo Sapiens
FAIDPHLLL

SEQ ID NO: 154255 - protein, 9 aa, Homo Sapiens
FAIPLIEKL

SEQ ID NO: 154256 - protein, 9 aa, Homo Sapiens
FAMEIDPSL

SEQ ID NO: 154257 - protein, 9 aa, Homo Sapiens
FAMFDQSQI

SEQ ID NO: 154258 - protein, 9 aa, Homo Sapiens
FAQEALTVL

SEQ ID NO: 154259 - protein, 9 aa, Homo Sapiens
FASEVSNVL

SEQ ID NO: 154260 - protein, 9 aa, Homo Sapiens
FASFPHMVL

SEQ ID NO: 154261 - protein, 9 aa, Homo Sapiens
FASHVSPEV

SEQ ID NO: 154262 - protein, 9 aa, Homo Sapiens
FAYVEGESL

SEQ ID NO: 154263 - protein, 9 aa, Homo Sapiens
FDDEANHLL

SEQ ID NO: 154264 - protein, 9 aa, Homo Sapiens
FFDEESYSL

SEQ ID NO: 154265 - protein, 9 aa, Homo Sapiens
FFDEKLNSL

SEQ ID NO: 154266 - protein, 9 aa, Homo Sapiens
FFDNISSEL

SEQ ID NO: 154267 - protein, 9 aa, Homo Sapiens
FFDTNTSVL

SEQ ID NO: 154268 - protein, 9 aa, Homo Sapiens
FGDDIPSAL

SEQ ID NO: 154269 - protein, 9 aa, Homo Sapiens
FGDDWGSIL

SEQ ID NO: 154270 - protein, 9 aa, Homo Sapiens
FGDFSPTDV

SEQ ID NO: 154271 - protein, 9 aa, Homo Sapiens
FGDLGSAKL

SEQ ID NO: 154272 - protein, 9 aa, Homo Sapiens
FGDLHQTEL

SEQ ID NO: 154273 - protein, 9 aa, Homo Sapiens
FGDLTIKSL

SEQ ID NO: 154274 - protein, 9 aa, Homo Sapiens
FGDSACFTL

SEQ ID NO: 154275 - protein, 9 aa, Homo Sapiens
FGDTGGFHF

SEQ ID NO: 154276 - protein, 9 aa, Homo Sapiens
FGEIEAIEL

SEQ ID NO: 154277 - protein, 9 aa, Homo Sapiens
FGEIENIEL

SEQ ID NO: 154278 - protein, 9 aa, Homo Sapiens
FGEVESIEL

SEQ ID NO: 154279 - protein, 9 aa, Homo Sapiens
FIADHCPTL

SEQ ID NO: 154280 - protein, 9 aa, Homo Sapiens
FIAPTGHSL

SEQ ID NO: 154281 - protein, 9 aa, Homo Sapiens
FIDDANYSV

SEQ ID NO: 154282 - protein, 9 aa, Homo Sapiens
FIDDVVSAV

SEQ ID NO: 154283 - protein, 9 aa, Homo Sapiens
FIDEAGHCM

SEQ ID NO: 154284 - protein, 9 aa, Homo Sapiens
FIDEQNYIL

SEQ ID NO: 154285 - protein, 9 aa, Homo Sapiens
FIDEYVETV

SEQ ID NO: 154286 - protein, 9 aa, Homo Sapiens
FIDGGGSVL

SEQ ID NO: 154287 - protein, 9 aa, Homo Sapiens
FIDGHFVEM

SEQ ID NO: 154288 - protein, 9 aa, Homo Sapiens
FIDGNVESL

SEQ ID NO: 154289 - protein, 9 aa, Homo Sapiens
FIDTAQHML

SEQ ID NO: 154290 - protein, 9 aa, Homo Sapiens
FIDVGAGVI

SEQ ID NO: 154291 - protein, 9 aa, Homo Sapiens
FIESAHTEL

SEQ ID NO: 154292 - protein, 9 aa, Homo Sapiens
FIGDSGIPL

SEQ ID NO: 154293 - protein, 9 aa, Homo Sapiens
FLDASGAKL

SEQ ID NO: 154294 - protein, 9 aa, Homo Sapiens
FLDDLGTNL

SEQ ID NO: 154295 - protein, 9 aa, Homo Sapiens
FLDDLSQKL

SEQ ID NO: 154296 - protein, 9 aa, Homo Sapiens
FLDDNQIVT

SEQ ID NO: 154297 - protein, 9 aa, Homo Sapiens
FLDDVNLIL

SEQ ID NO: 154298 - protein, 9 aa, Homo Sapiens
FLDDVVHSL

SEQ ID NO: 154299 - protein, 9 aa, Homo Sapiens
FLDEDDMSL

SEQ ID NO: 154300 - protein, 9 aa, Homo Sapiens
FLDEKTHEL

SEQ ID NO: 154301 - protein, 9 aa, Homo Sapiens
FLDENVHFF

SEQ ID NO: 154302 - protein, 9 aa, Homo Sapiens
FLDEPTNHL

SEQ ID NO: 154303 - protein, 9 aa, Homo Sapiens
FLDGDQLTL

SEQ ID NO: 154304 - protein, 9 aa, Homo Sapiens
FLDGNELTL

SEQ ID NO: 154305 - protein, 9 aa, Homo Sapiens
FLDGNEMTL

SEQ ID NO: 154306 - protein, 9 aa, Homo Sapiens
FLDGRPLTL

SEQ ID NO: 154307 - protein, 9 aa, Homo Sapiens
FLDGYVSQL

SEQ ID NO: 154308 - protein, 9 aa, Homo Sapiens
FLDLTEQEF

SEQ ID NO: 154309 - protein, 9 aa, Homo Sapiens
FLDMNFQSL

SEQ ID NO: 154310 - protein, 9 aa, Homo Sapiens
FLDNLTEEL

SEQ ID NO: 154311 - protein, 9 aa, Homo Sapiens
FLDPIMSTL

SEQ ID NO: 154312 - protein, 9 aa, Homo Sapiens
FLDQHGHNL

SEQ ID NO: 154313 - protein, 9 aa, Homo Sapiens
FLDRPQQWL

SEQ ID NO: 154314 - protein, 9 aa, Homo Sapiens
FLDSEVSEL

SEQ ID NO: 154315 - protein, 9 aa, Homo Sapiens
FLDSPAKAL

SEQ ID NO: 154316 - protein, 9 aa, Homo Sapiens
FLDSQTATF

SEQ ID NO: 154317 - protein, 9 aa, Homo Sapiens
FLDSVTAEV

SEQ ID NO: 154318 - protein, 9 aa, Homo Sapiens
FLDTEEAEL

SEQ ID NO: 154319 - protein, 9 aa, Homo Sapiens
FLDVSGISL

SEQ ID NO: 154320 - protein, 9 aa, Homo Sapiens
FLEEANRVL

SEQ ID NO: 154321 - protein, 9 aa, Homo Sapiens
FLEEHGPAM

SEQ ID NO: 154322 - protein, 9 aa, Homo Sapiens
FLEKENTAL

SEQ ID NO: 154323 - protein, 9 aa, Homo Sapiens
FMDDTSRSI

SEQ ID NO: 154324 - protein, 9 aa, Homo Sapiens
FMDESTQCF

SEQ ID NO: 154325 - protein, 9 aa, Homo Sapiens
FNDDNAEKL

SEQ ID NO: 154326 - protein, 9 aa, Homo Sapiens
FNDGSSREL

SEQ ID NO: 154327 - protein, 9 aa, Homo Sapiens
FNDPNAKEM

SEQ ID NO: 154328 - protein, 9 aa, Homo Sapiens
FPDDATSPL

SEQ ID NO: 154329 - protein, 9 aa, Homo Sapiens
FQDFSHIFL

SEQ ID NO: 154330 - protein, 9 aa, Homo Sapiens
FQDIAIEVL

SEQ ID NO: 154331 - protein, 9 aa, Homo Sapiens
FQDKRNLYL

SEQ ID NO: 154332 - protein, 9 aa, Homo Sapiens
FQDLNQEVM

SEQ ID NO: 154333 - protein, 9 aa, Homo Sapiens
FQDLQVEAL

SEQ ID NO: 154334 - protein, 9 aa, Homo Sapiens
FQDLSSSIL

SEQ ID NO: 154335 - protein, 9 aa, Homo Sapiens
FQDPSVTQL

SEQ ID NO: 154336 - protein, 9 aa, Homo Sapiens
FQDPVPLTV

SEQ ID NO: 154337 - protein, 9 aa, Homo Sapiens
FQDSKNSDL

SEQ ID NO: 154338 - protein, 9 aa, Homo Sapiens
FQDTNARSL

SEQ ID NO: 154339 - protein, 9 aa, Homo Sapiens
FQEADSPTL

SEQ ID NO: 154340 - protein, 9 aa, Homo Sapiens
FSAGEPRVL

SEQ ID NO: 154341 - protein, 9 aa, Homo Sapiens
FSDDNARAV

SEQ ID NO: 154342 - protein, 9 aa, Homo Sapiens
FSDDNKITI

SEQ ID NO: 154343 - protein, 9 aa, Homo Sapiens
FSDDPNVTK

SEQ ID NO: 154344 - protein, 9 aa, Homo Sapiens
FSDDSDLQL

SEQ ID NO: 154345 - protein, 9 aa, Homo Sapiens
FSDEIRHNL

SEQ ID NO: 154346 - protein, 9 aa, Homo Sapiens
FSDENVRAI

SEQ ID NO: 154347 - protein, 9 aa, Homo Sapiens
FSDEQILTV

SEQ ID NO: 154348 - protein, 9 aa, Homo Sapiens
FSDEWVACL

SEQ ID NO: 154349 - protein, 9 aa, Homo Sapiens
FSDFEARQL

SEQ ID NO: 154350 - protein, 9 aa, Homo Sapiens
FSDFPQHDI

SEQ ID NO: 154351 - protein, 9 aa, Homo Sapiens
FSDIPSPYL

SEQ ID NO: 154352 - protein, 9 aa, Homo Sapiens
FSDLTEEML

SEQ ID NO: 154353 - protein, 9 aa, Homo Sapiens
FSDLTMHEL

SEQ ID NO: 154354 - protein, 9 aa, Homo Sapiens
FSDPESQTL

SEQ ID NO: 154355 - protein, 9 aa, Homo Sapiens
FSDPNFLAH

SEQ ID NO: 154356 - protein, 9 aa, Homo Sapiens
FSDPVYKEI

SEQ ID NO: 154357 - protein, 9 aa, Homo Sapiens
FSDRSSLTF

SEQ ID NO: 154358 - protein, 9 aa, Homo Sapiens
FSDSSGLTV

SEQ ID NO: 154359 - protein, 9 aa, Homo Sapiens
FSDTGNFGF

SEQ ID NO: 154360 - protein, 9 aa, Homo Sapiens
FSDTKIISL

SEQ ID NO: 154361 - protein, 9 aa, Homo Sapiens
FSDTLFSTL

SEQ ID NO: 154362 - protein, 9 aa, Homo Sapiens
FSDTLKTYF

SEQ ID NO: 154363 - protein, 9 aa, Homo Sapiens
FSDVHTMDL

SEQ ID NO: 154364 - protein, 9 aa, Homo Sapiens
FSEAEQRCV

SEQ ID NO: 154365 - protein, 9 aa, Homo Sapiens
FSEASSLSL

SEQ ID NO: 154366 - protein, 9 aa, Homo Sapiens
FSEDAGISL

SEQ ID NO: 154367 - protein, 9 aa, Homo Sapiens
FSEEHPVLL

SEQ ID NO: 154368 - protein, 9 aa, Homo Sapiens
FSEEIGNHL

SEQ ID NO: 154369 - protein, 9 aa, Homo Sapiens
FSEETPVVL

SEQ ID NO: 154370 - protein, 9 aa, Homo Sapiens
FSETINTEL

SEQ ID NO: 154371 - protein, 9 aa, Homo Sapiens
FSITPLSEL

SEQ ID NO: 154372 - protein, 9 aa, Homo Sapiens
FSPFHASVL

SEQ ID NO: 154373 - protein, 9 aa, Homo Sapiens
FSSDVTHEM

SEQ ID NO: 154374 - protein, 9 aa, Homo Sapiens
FSSEACREL

SEQ ID NO: 154375 - protein, 9 aa, Homo Sapiens
FSSEVTAAL

SEQ ID NO: 154376 - protein, 9 aa, Homo Sapiens
FSSPGGLSL

SEQ ID NO: 154377 - protein, 9 aa, Homo Sapiens
FTDASFLTL

SEQ ID NO: 154378 - protein, 9 aa, Homo Sapiens
FTDASSRSI

SEQ ID NO: 154379 - protein, 9 aa, Homo Sapiens
FTDDQLLVL

SEQ ID NO: 154380 - protein, 9 aa, Homo Sapiens
FTDEESRVF

SEQ ID NO: 154381 - protein, 9 aa, Homo Sapiens
FTDEEVDEL

SEQ ID NO: 154382 - protein, 9 aa, Homo Sapiens
FTDERIFML

SEQ ID NO: 154383 - protein, 9 aa, Homo Sapiens
FTDFDPHHF

SEQ ID NO: 154384 - protein, 9 aa, Homo Sapiens
FTDFQGGTL

SEQ ID NO: 154385 - protein, 9 aa, Homo Sapiens
FTDFTNVRM

SEQ ID NO: 154386 - protein, 9 aa, Homo Sapiens
FTDGGPRTL

SEQ ID NO: 154387 - protein, 9 aa, Homo Sapiens
FTDGITNKL

SEQ ID NO: 154388 - protein, 9 aa, Homo Sapiens
FTDIDIDTL

SEQ ID NO: 154389 - protein, 9 aa, Homo Sapiens
FTDIGKVDF

SEQ ID NO: 154390 - protein, 9 aa, Homo Sapiens
FTDISPEEL

SEQ ID NO: 154391 - protein, 9 aa, Homo Sapiens
FTDKANSGL

SEQ ID NO: 154392 - protein, 9 aa, Homo Sapiens
FTDLGNKDL

SEQ ID NO: 154393 - protein, 9 aa, Homo Sapiens
FTDQHNICL

SEQ ID NO: 154394 - protein, 9 aa, Homo Sapiens
FTDRPDLSL

SEQ ID NO: 154395 - protein, 9 aa, Homo Sapiens
FTDSGLSTL

SEQ ID NO: 154396 - protein, 9 aa, Homo Sapiens
FTDSGRQSV

SEQ ID NO: 154397 - protein, 9 aa, Homo Sapiens
FTDSLISNL

SEQ ID NO: 154398 - protein, 9 aa, Homo Sapiens
FTDTDELQL

SEQ ID NO: 154399 - protein, 9 aa, Homo Sapiens
FTDTVGNIL

SEQ ID NO: 154400 - protein, 9 aa, Homo Sapiens
FTDVAGPEL

SEQ ID NO: 154401 - protein, 9 aa, Homo Sapiens
FTDVIGHYI

SEQ ID NO: 154402 - protein, 9 aa, Homo Sapiens
FTDVNKIYL

SEQ ID NO: 154403 - protein, 9 aa, Homo Sapiens
FTDVPSIQI

SEQ ID NO: 154404 - protein, 9 aa, Homo Sapiens
FTDVVTTNL

SEQ ID NO: 154405 - protein, 9 aa, Homo Sapiens
FTDYDVIHL

SEQ ID NO: 154406 - protein, 9 aa, Homo Sapiens
FTETPSPVL

SEQ ID NO: 154407 - protein, 9 aa, Homo Sapiens
FTEWLHEVL

SEQ ID NO: 154408 - protein, 9 aa, Homo Sapiens
FVDADNLIL

SEQ ID NO: 154409 - protein, 9 aa, Homo Sapiens
FVDCPGHDI

SEQ ID NO: 154410 - protein, 9 aa, Homo Sapiens
FVDDQQTFF

SEQ ID NO: 154411 - protein, 9 aa, Homo Sapiens
FVDDSGRYL

SEQ ID NO: 154412 - protein, 9 aa, Homo Sapiens
FVDEFLTYL

SEQ ID NO: 154413 - protein, 9 aa, Homo Sapiens
FVDEGIKTL

SEQ ID NO: 154414 - protein, 9 aa, Homo Sapiens
FVDEGKATV

SEQ ID NO: 154415 - protein, 9 aa, Homo Sapiens
FVDEILTSL

SEQ ID NO: 154416 - protein, 9 aa, Homo Sapiens
FVDELRITL

SEQ ID NO: 154417 - protein, 9 aa, Homo Sapiens
FVDFEGISL

SEQ ID NO: 154418 - protein, 9 aa, Homo Sapiens
FVDGDHVIL

SEQ ID NO: 154419 - protein, 9 aa, Homo Sapiens
FVDGDWSVL

SEQ ID NO: 154420 - protein, 9 aa, Homo Sapiens
FVDGSAIQV

SEQ ID NO: 154421 - protein, 9 aa, Homo Sapiens
FVDGVSTVA

SEQ ID NO: 154422 - protein, 9 aa, Homo Sapiens
FVDIVKVLL

SEQ ID NO: 154423 - protein, 9 aa, Homo Sapiens
FVDKYSISL

SEQ ID NO: 154424 - protein, 9 aa, Homo Sapiens
FVDLEPTVI

SEQ ID NO: 154425 - protein, 9 aa, Homo Sapiens
FVDLGILDV

SEQ ID NO: 154426 - protein, 9 aa, Homo Sapiens
FVDLGSSEL

SEQ ID NO: 154427 - protein, 9 aa, Homo Sapiens
FVDLSGHNL

SEQ ID NO: 154428 - protein, 9 aa, Homo Sapiens
FVDPAQITM

SEQ ID NO: 154429 - protein, 9 aa, Homo Sapiens
FVDPVLNQL

SEQ ID NO: 154430 - protein, 9 aa, Homo Sapiens
FVDQCKTVL

SEQ ID NO: 154431 - protein, 9 aa, Homo Sapiens
FVDRGFYSV

SEQ ID NO: 154432 - protein, 9 aa, Homo Sapiens
FVDRSLLTL

SEQ ID NO: 154433 - protein, 9 aa, Homo Sapiens
FVDTQDRSL

SEQ ID NO: 154434 - protein, 9 aa, Homo Sapiens
FVDVQPSSL

SEQ ID NO: 154435 - protein, 9 aa, Homo Sapiens
FVDVSSVPL

SEQ ID NO: 154436 - protein, 9 aa, Homo Sapiens
FVEDSKVVL

SEQ ID NO: 154437 - protein, 9 aa, Homo Sapiens
FVEEEEHFL

SEQ ID NO: 154438 - protein, 9 aa, Homo Sapiens
FVEETVYLL

SEQ ID NO: 154439 - protein, 9 aa, Homo Sapiens
FYDEIKIEL

SEQ ID NO: 154440 - protein, 9 aa, Homo Sapiens
FYDVQFKEL

SEQ ID NO: 154441 - protein, 9 aa, Homo Sapiens
GADAGQLDL

SEQ ID NO: 154442 - protein, 9 aa, Homo Sapiens
GADELGEVI

SEQ ID NO: 154443 - protein, 9 aa, Homo Sapiens
GADERIFSL

SEQ ID NO: 154444 - protein, 9 aa, Homo Sapiens
GADFLVTEV

SEQ ID NO: 154445 - protein, 9 aa, Homo Sapiens
GADHVVKPL

SEQ ID NO: 154446 - protein, 9 aa, Homo Sapiens
GADIASKEF

SEQ ID NO: 154447 - protein, 9 aa, Homo Sapiens
GADIDALCV

SEQ ID NO: 154448 - protein, 9 aa, Homo Sapiens
GADIHSKEF

SEQ ID NO: 154449 - protein, 9 aa, Homo Sapiens
GADISKTVM

SEQ ID NO: 154450 - protein, 9 aa, Homo Sapiens
GADKSSNFL

SEQ ID NO: 154451 - protein, 9 aa, Homo Sapiens
GADLKNGAL

SEQ ID NO: 154452 - protein, 9 aa, Homo Sapiens
GADLPNLLF

SEQ ID NO: 154453 - protein, 9 aa, Homo Sapiens
GADLPNLTP

SEQ ID NO: 154454 - protein, 9 aa, Homo Sapiens
GADLPNYRW

SEQ ID NO: 154455 - protein, 9 aa, Homo Sapiens
GADLPSNHV

SEQ ID NO: 154456 - protein, 9 aa, Homo Sapiens
GADNGTMHL

SEQ ID NO: 154457 - protein, 9 aa, Homo Sapiens
GADPSTVEM

SEQ ID NO: 154458 - protein, 9 aa, Homo Sapiens
GADRLQTGM

SEQ ID NO: 154459 - protein, 9 aa, Homo Sapiens
GADVFLEAL

SEQ ID NO: 154460 - protein, 9 aa, Homo Sapiens
GADVVSKFL

SEQ ID NO: 154461 - protein, 9 aa, Homo Sapiens
GEPDHNEAL

SEQ ID NO: 154462 - protein, 9 aa, Homo Sapiens
GGDIANRVL

SEQ ID NO: 154463 - protein, 9 aa, Homo Sapiens
GGFDPHDVL

SEQ ID NO: 154464 - protein, 9 aa, Homo Sapiens
GIDSPSSSV

SEQ ID NO: 154465 - protein, 9 aa, Homo Sapiens
GIDSPVSEL

SEQ ID NO: 154466 - protein, 9 aa, Homo Sapiens
GIDVQGVEL

SEQ ID NO: 154467 - protein, 9 aa, Homo Sapiens
GIDVQQVSL

SEQ ID NO: 154468 - protein, 9 aa, Homo Sapiens
GLDVPSLCL

SEQ ID NO: 154469 - protein, 9 aa, Homo Sapiens
GNDLPSVEL

SEQ ID NO: 154470 - protein, 9 aa, Homo Sapiens
GQDLAKQAL

SEQ ID NO: 154471 - protein, 9 aa, Homo Sapiens
GQDTPGVSL

SEQ ID NO: 154472 - protein, 9 aa, Homo Sapiens
GSDDATCRL

SEQ ID NO: 154473 - protein, 9 aa, Homo Sapiens
GSDDIHNAL

SEQ ID NO: 154474 - protein, 9 aa, Homo Sapiens
GSDEPPVFL

SEQ ID NO: 154475 - protein, 9 aa, Homo Sapiens
GSDESYRPL

SEQ ID NO: 154476 - protein, 9 aa, Homo Sapiens
GSDGHSMAL

SEQ ID NO: 154477 - protein, 9 aa, Homo Sapiens
GSDIGNVVL

SEQ ID NO: 154478 - protein, 9 aa, Homo Sapiens
GSDPRVTQL

SEQ ID NO: 154479 - protein, 9 aa, Homo Sapiens
GVDEATRAV

SEQ ID NO: 154480 - protein, 9 aa, Homo Sapiens
GVDEPGWVL

SEQ ID NO: 154481 - protein, 9 aa, Homo Sapiens
GVDHPSHTL

SEQ ID NO: 154482 - protein, 9 aa, Homo Sapiens
GVDLPSVNL

SEQ ID NO: 154483 - protein, 9 aa, Homo Sapiens
GVDLSKIPL

SEQ ID NO: 154484 - protein, 9 aa, Homo Sapiens
GVDLVLNSL

SEQ ID NO: 154485 - protein, 9 aa, Homo Sapiens
HADDPERVV

SEQ ID NO: 154486 - protein, 9 aa, Homo Sapiens
HADDSFLVL

SEQ ID NO: 154487 - protein, 9 aa, Homo Sapiens
HADHSSLTL

SEQ ID NO: 154488 - protein, 9 aa, Homo Sapiens
HADILLINL

SEQ ID NO: 154489 - protein, 9 aa, Homo Sapiens
HADIPETCV

SEQ ID NO: 154490 - protein, 9 aa, Homo Sapiens
HADLAGVPL

SEQ ID NO: 154491 - protein, 9 aa, Homo Sapiens
HADPEPSVI

SEQ ID NO: 154492 - protein, 9 aa, Homo Sapiens
HADPTELAL

SEQ ID NO: 154493 - protein, 9 aa, Homo Sapiens
HADTVGIDA

SEQ ID NO: 154494 - protein, 9 aa, Homo Sapiens
HADVARAML

SEQ ID NO: 154495 - protein, 9 aa, Homo Sapiens
HADVGVALL

SEQ ID NO: 154496 - protein, 9 aa, Homo Sapiens
HAMQFPAEL

SEQ ID NO: 154497 - protein, 9 aa, Homo Sapiens
HCDVPGLHC

SEQ ID NO: 154498 - protein, 9 aa, Homo Sapiens
HFDASHVAL

SEQ ID NO: 154499 - protein, 9 aa, Homo Sapiens
HFDLSVIEL

SEQ ID NO: 154500 - protein, 9 aa, Homo Sapiens
HIDFGGTSV

SEQ ID NO: 154501 - protein, 9 aa, Homo Sapiens
HIDGDHLTL

SEQ ID NO: 154502 - protein, 9 aa, Homo Sapiens
HIDPNFASL

SEQ ID NO: 154503 - protein, 9 aa, Homo Sapiens
HIDSGKTAL

SEQ ID NO: 154504 - protein, 9 aa, Homo Sapiens
HIDSGKTTL

SEQ ID NO: 154505 - protein, 9 aa, Homo Sapiens
HIDTVINAL

SEQ ID NO: 154506 - protein, 9 aa, Homo Sapiens
HIDVITAEM

SEQ ID NO: 154507 - protein, 9 aa, Homo Sapiens
HIDVMYTTL

SEQ ID NO: 154508 - protein, 9 aa, Homo Sapiens
HLDDALRAL

SEQ ID NO: 154509 - protein, 9 aa, Homo Sapiens
HLDDQMTLL

SEQ ID NO: 154510 - protein, 9 aa, Homo Sapiens
HLDEAIHVL

SEQ ID NO: 154511 - protein, 9 aa, Homo Sapiens
HLDEARTLL

SEQ ID NO: 154512 - protein, 9 aa, Homo Sapiens
HLDEDQQEL

SEQ ID NO: 154513 - protein, 9 aa, Homo Sapiens
HLDEVFLEL

SEQ ID NO: 154514 - protein, 9 aa, Homo Sapiens
HLDFSGNAL

SEQ ID NO: 154515 - protein, 9 aa, Homo Sapiens
HLDLSFNSL

SEQ ID NO: 154516 - protein, 9 aa, Homo Sapiens
HLDSMNVSL

SEQ ID NO: 154517 - protein, 9 aa, Homo Sapiens
HLDTAQNAL

SEQ ID NO: 154518 - protein, 9 aa, Homo Sapiens
HLDVQPAAL

SEQ ID NO: 154519 - protein, 9 aa, Homo Sapiens
HMDHVSAVL

SEQ ID NO: 154520 - protein, 9 aa, Homo Sapiens
HQDFPSVVL

SEQ ID NO: 154521 - protein, 9 aa, Homo Sapiens
HQDSQVNAL

SEQ ID NO: 154522 - protein, 9 aa, Homo Sapiens
HSDAQALVL

SEQ ID NO: 154523 - protein, 9 aa, Homo Sapiens
HSDDEGTVL

SEQ ID NO: 154524 - protein, 9 aa, Homo Sapiens
HSDDGCLKL

SEQ ID NO: 154525 - protein, 9 aa, Homo Sapiens
HSDELTSLL

SEQ ID NO: 154526 - protein, 9 aa, Homo Sapiens
HSDIVVISL

SEQ ID NO: 154527 - protein, 9 aa, Homo Sapiens
HSDSEVASL

SEQ ID NO: 154528 - protein, 9 aa, Homo Sapiens
HSDSPAWSL

SEQ ID NO: 154529 - protein, 9 aa, Homo Sapiens
HSDWVNITF

SEQ ID NO: 154530 - protein, 9 aa, Homo Sapiens
HSETPNMEL

SEQ ID NO: 154531 - protein, 9 aa, Homo Sapiens
HTDDSALCM

SEQ ID NO: 154532 - protein, 9 aa, Homo Sapiens
HTDERGFSL

SEQ ID NO: 154533 - protein, 9 aa, Homo Sapiens
HTDLPVSVF

SEQ ID NO: 154534 - protein, 9 aa, Homo Sapiens
HTDNVIQWL

SEQ ID NO: 154535 - protein, 9 aa, Homo Sapiens
HTDSIGLVL

SEQ ID NO: 154536 - protein, 9 aa, Homo Sapiens
HTDVADVLL

SEQ ID NO: 154537 - protein, 9 aa, Homo Sapiens
HVDAGKSTI

SEQ ID NO: 154538 - protein, 9 aa, Homo Sapiens
HVDDVSSAL

SEQ ID NO: 154539 - protein, 9 aa, Homo Sapiens
HVDEIKEFL

SEQ ID NO: 154540 - protein, 9 aa, Homo Sapiens
HVDESGLSL

SEQ ID NO: 154541 - protein, 9 aa, Homo Sapiens
HVDGAAKSL

SEQ ID NO: 154542 - protein, 9 aa, Homo Sapiens
HVDGHLYEL

SEQ ID NO: 154543 - protein, 9 aa, Homo Sapiens
HVDGQTHML

SEQ ID NO: 154544 - protein, 9 aa, Homo Sapiens
HVDGVAVTL

SEQ ID NO: 154545 - protein, 9 aa, Homo Sapiens
HVDLQVSAL

SEQ ID NO: 154546 - protein, 9 aa, Homo Sapiens
HVDPSGTFL

SEQ ID NO: 154547 - protein, 9 aa, Homo Sapiens
HVDRENLVL

SEQ ID NO: 154548 - protein, 9 aa, Homo Sapiens
HVDVAGNVV

SEQ ID NO: 154549 - protein, 9 aa, Homo Sapiens
HVDVSSDSL

SEQ ID NO: 154550 - protein, 9 aa, Homo Sapiens
HVEKPPAAL

SEQ ID NO: 154551 - protein, 9 aa, Homo Sapiens
HWDPQEVTL

SEQ ID NO: 154552 - protein, 9 aa, Homo Sapiens
IADATVRSL

SEQ ID NO: 154553 - protein, 9 aa, Homo Sapiens
IADDFAAFV

SEQ ID NO: 154554 - protein, 9 aa, Homo Sapiens
IADDFIESV

SEQ ID NO: 154555 - protein, 9 aa, Homo Sapiens
IADEEQKAL

SEQ ID NO: 154556 - protein, 9 aa, Homo Sapiens
IADEGTWTL

SEQ ID NO: 154557 - protein, 9 aa, Homo Sapiens
IADEGTYTL

SEQ ID NO: 154558 - protein, 9 aa, Homo Sapiens
IADFGFSNL

SEQ ID NO: 154559 - protein, 9 aa, Homo Sapiens
IADFMTTNV

SEQ ID NO: 154560 - protein, 9 aa, Homo Sapiens
IADFPGLHL

SEQ ID NO: 154561 - protein, 9 aa, Homo Sapiens
IADGGFTEL

SEQ ID NO: 154562 - protein, 9 aa, Homo Sapiens
IADGGTPDI

SEQ ID NO: 154563 - protein, 9 aa, Homo Sapiens
IADGLPVAV

SEQ ID NO: 154564 - protein, 9 aa, Homo Sapiens
IADHYMQVL

SEQ ID NO: 154565 - protein, 9 aa, Homo Sapiens
IADIIRTCL

SEQ ID NO: 154566 - protein, 9 aa, Homo Sapiens
IADIVTSVF

SEQ ID NO: 154567 - protein, 9 aa, Homo Sapiens
IADKTENTL

SEQ ID NO: 154568 - protein, 9 aa, Homo Sapiens
IADLAHLLL

SEQ ID NO: 154569 - protein, 9 aa, Homo Sapiens
IADLDALDV

SEQ ID NO: 154570 - protein, 9 aa, Homo Sapiens
IADLGSTSI

SEQ ID NO: 154571 - protein, 9 aa, Homo Sapiens
IADLISSFL

SEQ ID NO: 154572 - protein, 9 aa, Homo Sapiens
IADLMEEKF

SEQ ID NO: 154573 - protein, 9 aa, Homo Sapiens
IADLPSTQL

SEQ ID NO: 154574 - protein, 9 aa, Homo Sapiens
IADLSHEAI

SEQ ID NO: 154575 - protein, 9 aa, Homo Sapiens
IADLVSKEL

SEQ ID NO: 154576 - protein, 9 aa, Homo Sapiens
IADLVTSVL

SEQ ID NO: 154577 - protein, 9 aa, Homo Sapiens
IADLVVAVF

SEQ ID NO: 154578 - protein, 9 aa, Homo Sapiens
IADMDFSAL

SEQ ID NO: 154579 - protein, 9 aa, Homo Sapiens
IADMGFARL

SEQ ID NO: 154580 - protein, 9 aa, Homo Sapiens
IADPDQPVL

SEQ ID NO: 154581 - protein, 9 aa, Homo Sapiens
IADPIVLAL

SEQ ID NO: 154582 - protein, 9 aa, Homo Sapiens
IADPNIAKL

SEQ ID NO: 154583 - protein, 9 aa, Homo Sapiens
IADPRGNTL

SEQ ID NO: 154584 - protein, 9 aa, Homo Sapiens
IADQRNFIF

SEQ ID NO: 154585 - protein, 9 aa, Homo Sapiens
IADRGAEYV

SEQ ID NO: 154586 - protein, 9 aa, Homo Sapiens
IADRLGLEL

SEQ ID NO: 154587 - protein, 9 aa, Homo Sapiens
IADRLNVEF

SEQ ID NO: 154588 - protein, 9 aa, Homo Sapiens
IADRPPPVI

SEQ ID NO: 154589 - protein, 9 aa, Homo Sapiens
IADSNPMVV

SEQ ID NO: 154590 - protein, 9 aa, Homo Sapiens
IADTGANVV

SEQ ID NO: 154591 - protein, 9 aa, Homo Sapiens
IADTVPKYL

SEQ ID NO: 154592 - protein, 9 aa, Homo Sapiens
IADVAPSAI

SEQ ID NO: 154593 - protein, 9 aa, Homo Sapiens
IADVNKPII

SEQ ID NO: 154594 - protein, 9 aa, Homo Sapiens
IAEAVRTTL

SEQ ID NO: 154595 - protein, 9 aa, Homo Sapiens
IAEDPKVFL

SEQ ID NO: 154596 - protein, 9 aa, Homo Sapiens
IAEGPETKI

SEQ ID NO: 154597 - protein, 9 aa, Homo Sapiens
IAEIGSLSL

SEQ ID NO: 154598 - protein, 9 aa, Homo Sapiens
IAEIYETEL

SEQ ID NO: 154599 - protein, 9 aa, Homo Sapiens
IAEQYHTVL

SEQ ID NO: 154600 - protein, 9 aa, Homo Sapiens
IAIEPGAAL

SEQ ID NO: 154601 - protein, 9 aa, Homo Sapiens
IANLEPVSL

SEQ ID NO: 154602 - protein, 9 aa, Homo Sapiens
IAPPPEECL

SEQ ID NO: 154603 - protein, 9 aa, Homo Sapiens
IFDRVLTEL

SEQ ID NO: 154604 - protein, 9 aa, Homo Sapiens
IGDEAATHL

SEQ ID NO: 154605 - protein, 9 aa, Homo Sapiens
IGDLVKSTL

SEQ ID NO: 154606 - protein, 9 aa, Homo Sapiens
IGDLVNIDL

SEQ ID NO: 154607 - protein, 9 aa, Homo Sapiens
IGDPEVLEI

SEQ ID NO: 154608 - protein, 9 aa, Homo Sapiens
IGDPITTCL

SEQ ID NO: 154609 - protein, 9 aa, Homo Sapiens
IGDPNLEFV

SEQ ID NO: 154610 - protein, 9 aa, Homo Sapiens
IGDSGVPAL

SEQ ID NO: 154611 - protein, 9 aa, Homo Sapiens
IGDSHCLAL

SEQ ID NO: 154612 - protein, 9 aa, Homo Sapiens
IGDVATQYF

SEQ ID NO: 154613 - protein, 9 aa, Homo Sapiens
IGPPLEKPV

SEQ ID NO: 154614 - protein, 9 aa, Homo Sapiens
IIDAPALAL

SEQ ID NO: 154615 - protein, 9 aa, Homo Sapiens
IIDDAEFEL

SEQ ID NO: 154616 - protein, 9 aa, Homo Sapiens
IIDDDVPSF

SEQ ID NO: 154617 - protein, 9 aa, Homo Sapiens
IIDDGDSNL

SEQ ID NO: 154618 - protein, 9 aa, Homo Sapiens
IIDDPNLVV

SEQ ID NO: 154619 - protein, 9 aa, Homo Sapiens
IIDDRNREL

SEQ ID NO: 154620 - protein, 9 aa, Homo Sapiens
IIDDSDSNL

SEQ ID NO: 154621 - protein, 9 aa, Homo Sapiens
IIDDVDSFL

SEQ ID NO: 154622 - protein, 9 aa, Homo Sapiens
IIDDVMKEL

SEQ ID NO: 154623 - protein, 9 aa, Homo Sapiens
IIDEFEQKL

SEQ ID NO: 154624 - protein, 9 aa, Homo Sapiens
IIDETMAQL

SEQ ID NO: 154625 - protein, 9 aa, Homo Sapiens
IIDGKIFCV

SEQ ID NO: 154626 - protein, 9 aa, Homo Sapiens
IIDKSGSTI

SEQ ID NO: 154627 - protein, 9 aa, Homo Sapiens
IIDKSGSTV

SEQ ID NO: 154628 - protein, 9 aa, Homo Sapiens
IIDLQANPL

SEQ ID NO: 154629 - protein, 9 aa, Homo Sapiens
IIDQEVQTL

SEQ ID NO: 154630 - protein, 9 aa, Homo Sapiens
IIDRAITSL

SEQ ID NO: 154631 - protein, 9 aa, Homo Sapiens
IIDRTNTTL

SEQ ID NO: 154632 - protein, 9 aa, Homo Sapiens
IIDSTNIIF

SEQ ID NO: 154633 - protein, 9 aa, Homo Sapiens
IIDTACEVL

SEQ ID NO: 154634 - protein, 9 aa, Homo Sapiens
IIDTPISEM

SEQ ID NO: 154635 - protein, 9 aa, Homo Sapiens
IIEEEFVSL

SEQ ID NO: 154636 - protein, 9 aa, Homo Sapiens
IIEPTSPCL

SEQ ID NO: 154637 - protein, 9 aa, Homo Sapiens
ILDAAGANL

SEQ ID NO: 154638 - protein, 9 aa, Homo Sapiens
ILDDATSAL

SEQ ID NO: 154639 - protein, 9 aa, Homo Sapiens
ILDDKSKEL

SEQ ID NO: 154640 - protein, 9 aa, Homo Sapiens
ILDDVAMVL

SEQ ID NO: 154641 - protein, 9 aa, Homo Sapiens
ILDEAERSL

SEQ ID NO: 154642 - protein, 9 aa, Homo Sapiens
ILDEATSAL

SEQ ID NO: 154643 - protein, 9 aa, Homo Sapiens
ILDELVKSL

SEQ ID NO: 154644 - protein, 9 aa, Homo Sapiens
ILDEPTNHL

SEQ ID NO: 154645 - protein, 9 aa, Homo Sapiens
ILDEPTNNL

SEQ ID NO: 154646 - protein, 9 aa, Homo Sapiens
ILDEVDAAL

SEQ ID NO: 154647 - protein, 9 aa, Homo Sapiens
ILDIAGYDL

SEQ ID NO: 154648 - protein, 9 aa, Homo Sapiens
ILDIPTHTI

SEQ ID NO: 154649 - protein, 9 aa, Homo Sapiens
ILDISEHTL

SEQ ID NO: 154650 - protein, 9 aa, Homo Sapiens
ILDNPVVQL

SEQ ID NO: 154651 - protein, 9 aa, Homo Sapiens
ILDPHVVLL

SEQ ID NO: 154652 - protein, 9 aa, Homo Sapiens
ILDQTKTEL

SEQ ID NO: 154653 - protein, 9 aa, Homo Sapiens
ILDSHAATL

SEQ ID NO: 154654 - protein, 9 aa, Homo Sapiens
ILDVSGNAI

SEQ ID NO: 154655 - protein, 9 aa, Homo Sapiens
ILEEPSKAL

SEQ ID NO: 154656 - protein, 9 aa, Homo Sapiens
IMDHVEESL

SEQ ID NO: 154657 - protein, 9 aa, Homo Sapiens
IQDDAVHTL

SEQ ID NO: 154658 - protein, 9 aa, Homo Sapiens
IQDEIRSVI

SEQ ID NO: 154659 - protein, 9 aa, Homo Sapiens
IQDEIVDFL

SEQ ID NO: 154660 - protein, 9 aa, Homo Sapiens
IQDFQASVL

SEQ ID NO: 154661 - protein, 9 aa, Homo Sapiens
IQDFQSVTL

SEQ ID NO: 154662 - protein, 9 aa, Homo Sapiens
IQDLGPKEL

SEQ ID NO: 154663 - protein, 9 aa, Homo Sapiens
IQDLTGLDV

SEQ ID NO: 154664 - protein, 9 aa, Homo Sapiens
IQDVQSEAL

SEQ ID NO: 154665 - protein, 9 aa, Homo Sapiens
IQDVSLESL

SEQ ID NO: 154666 - protein, 9 aa, Homo Sapiens
ISDADTKEV

SEQ ID NO: 154667 - protein, 9 aa, Homo Sapiens
ISDAGLLHL

SEQ ID NO: 154668 - protein, 9 aa, Homo Sapiens
ISDAPINEV

SEQ ID NO: 154669 - protein, 9 aa, Homo Sapiens
ISDAPVTGM

SEQ ID NO: 154670 - protein, 9 aa, Homo Sapiens
ISDEANSNF

SEQ ID NO: 154671 - protein, 9 aa, Homo Sapiens
ISDEECFVL

SEQ ID NO: 154672 - protein, 9 aa, Homo Sapiens
ISDEGIAYL

SEQ ID NO: 154673 - protein, 9 aa, Homo Sapiens
ISDEVEKEL

SEQ ID NO: 154674 - protein, 9 aa, Homo Sapiens
ISDHAIQEL

SEQ ID NO: 154675 - protein, 9 aa, Homo Sapiens
ISDIANDAL

SEQ ID NO: 154676 - protein, 9 aa, Homo Sapiens
ISDINPRSV

SEQ ID NO: 154677 - protein, 9 aa, Homo Sapiens
ISDIPTGIP

SEQ ID NO: 154678 - protein, 9 aa, Homo Sapiens
ISDKITSEL

SEQ ID NO: 154679 - protein, 9 aa, Homo Sapiens
ISDKQCAEL

SEQ ID NO: 154680 - protein, 9 aa, Homo Sapiens
ISDLAQHYL

SEQ ID NO: 154681 - protein, 9 aa, Homo Sapiens
ISDLGELSF

SEQ ID NO: 154682 - protein, 9 aa, Homo Sapiens
ISDLGQHTL

SEQ ID NO: 154683 - protein, 9 aa, Homo Sapiens
ISDLSEHVF

SEQ ID NO: 154684 - protein, 9 aa, Homo Sapiens
ISDLSINSL

SEQ ID NO: 154685 - protein, 9 aa, Homo Sapiens
ISDLSVNSL

SEQ ID NO: 154686 - protein, 9 aa, Homo Sapiens
ISDLVKVTL

SEQ ID NO: 154687 - protein, 9 aa, Homo Sapiens
ISDNAAKIL

SEQ ID NO: 154688 - protein, 9 aa, Homo Sapiens
ISDNAARVL

SEQ ID NO: 154689 - protein, 9 aa, Homo Sapiens
ISDPEKWEI

SEQ ID NO: 154690 - protein, 9 aa, Homo Sapiens
ISDPYNVNL

SEQ ID NO: 154691 - protein, 9 aa, Homo Sapiens
ISDQNIKDL

SEQ ID NO: 154692 - protein, 9 aa, Homo Sapiens
ISDRYYTAL

SEQ ID NO: 154693 - protein, 9 aa, Homo Sapiens
ISDSADCSL

SEQ ID NO: 154694 - protein, 9 aa, Homo Sapiens
ISDSNPMVV

SEQ ID NO: 154695 - protein, 9 aa, Homo Sapiens
ISDSVGVFL

SEQ ID NO: 154696 - protein, 9 aa, Homo Sapiens
ISDSVLVDI

SEQ ID NO: 154697 - protein, 9 aa, Homo Sapiens
ISDTGGQQL

SEQ ID NO: 154698 - protein, 9 aa, Homo Sapiens
ISDTGIMHL

SEQ ID NO: 154699 - protein, 9 aa, Homo Sapiens
ISDTMVAQL

SEQ ID NO: 154700 - protein, 9 aa, Homo Sapiens
ISDTQRISL

SEQ ID NO: 154701 - protein, 9 aa, Homo Sapiens
ISDVLQRDL

SEQ ID NO: 154702 - protein, 9 aa, Homo Sapiens
ISDVVKQPA

SEQ ID NO: 154703 - protein, 9 aa, Homo Sapiens
ISDYAVKIV

SEQ ID NO: 154704 - protein, 9 aa, Homo Sapiens
ISDYTVTEI

SEQ ID NO: 154705 - protein, 9 aa, Homo Sapiens
ISEQTGKEL

SEQ ID NO: 154706 - protein, 9 aa, Homo Sapiens
ISVLPMEVL

SEQ ID NO: 154707 - protein, 9 aa, Homo Sapiens
ITDAEGLGL

SEQ ID NO: 154708 - protein, 9 aa, Homo Sapiens
ITDDEIISL

SEQ ID NO: 154709 - protein, 9 aa, Homo Sapiens
ITDEQIQEM

SEQ ID NO: 154710 - protein, 9 aa, Homo Sapiens
ITDFQFKEL

SEQ ID NO: 154711 - protein, 9 aa, Homo Sapiens
ITDFSGIVL

SEQ ID NO: 154712 - protein, 9 aa, Homo Sapiens
ITDGNSEHL

SEQ ID NO: 154713 - protein, 9 aa, Homo Sapiens
ITDGVITDL

SEQ ID NO: 154714 - protein, 9 aa, Homo Sapiens
ITDKGIIAL

SEQ ID NO: 154715 - protein, 9 aa, Homo Sapiens
ITDLPSEVL

SEQ ID NO: 154716 - protein, 9 aa, Homo Sapiens
ITDNDIQSL

SEQ ID NO: 154717 - protein, 9 aa, Homo Sapiens
ITDPANEKL

SEQ ID NO: 154718 - protein, 9 aa, Homo Sapiens
ITDPSVIVM

SEQ ID NO: 154719 - protein, 9 aa, Homo Sapiens
ITDSKVSNL

SEQ ID NO: 154720 - protein, 9 aa, Homo Sapiens
ITDSTGTHL

SEQ ID NO: 154721 - protein, 9 aa, Homo Sapiens
ITDVHSNDL

SEQ ID NO: 154722 - protein, 9 aa, Homo Sapiens
ITDVSLHAL

SEQ ID NO: 154723 - protein, 9 aa, Homo Sapiens
IVDAALSAL

SEQ ID NO: 154724 - protein, 9 aa, Homo Sapiens
IVDAANAVI

SEQ ID NO: 154725 - protein, 9 aa, Homo Sapiens
IVDANLSVL

SEQ ID NO: 154726 - protein, 9 aa, Homo Sapiens
IVDAVGTML

SEQ ID NO: 154727 - protein, 9 aa, Homo Sapiens
IVDDCGGAF

SEQ ID NO: 154728 - protein, 9 aa, Homo Sapiens
IVDDFGTHL

SEQ ID NO: 154729 - protein, 9 aa, Homo Sapiens
IVDDPEGFF

SEQ ID NO: 154730 - protein, 9 aa, Homo Sapiens
IVDEGGDAL

SEQ ID NO: 154731 - protein, 9 aa, Homo Sapiens
IVDEVNGLI

SEQ ID NO: 154732 - protein, 9 aa, Homo Sapiens
IVDGERTVL

SEQ ID NO: 154733 - protein, 9 aa, Homo Sapiens
IVDIGPDSL

SEQ ID NO: 154734 - protein, 9 aa, Homo Sapiens
IVDIPGTSV

SEQ ID NO: 154735 - protein, 9 aa, Homo Sapiens
IVDKSGRTL

SEQ ID NO: 154736 - protein, 9 aa, Homo Sapiens
IVDLTCESL

SEQ ID NO: 154737 - protein, 9 aa, Homo Sapiens
IVDPQNQTM

SEQ ID NO: 154738 - protein, 9 aa, Homo Sapiens
IVDPVDSTL

SEQ ID NO: 154739 - protein, 9 aa, Homo Sapiens
IVDQVMVTL

SEQ ID NO: 154740 - protein, 9 aa, Homo Sapiens
IVDRGSTNL

SEQ ID NO: 154741 - protein, 9 aa, Homo Sapiens
IVDRPGQQT

SEQ ID NO: 154742 - protein, 9 aa, Homo Sapiens
IVDRPVTLV

SEQ ID NO: 154743 - protein, 9 aa, Homo Sapiens
IVDSARSIL

SEQ ID NO: 154744 - protein, 9 aa, Homo Sapiens
IWDVSVNSV

SEQ ID NO: 154745 - protein, 9 aa, Homo Sapiens
IYDLATQTL

SEQ ID NO: 154746 - protein, 9 aa, Homo Sapiens
KAAELEMEL

SEQ ID NO: 154747 - protein, 9 aa, Homo Sapiens
KAAIMETLR

SEQ ID NO: 154748 - protein, 9 aa, Homo Sapiens
KADDPYAHL

SEQ ID NO: 154749 - protein, 9 aa, Homo Sapiens
KADEGLASL

SEQ ID NO: 154750 - protein, 9 aa, Homo Sapiens
KADEVLEIL

SEQ ID NO: 154751 - protein, 9 aa, Homo Sapiens
KADFPTPSI

SEQ ID NO: 154752 - protein, 9 aa, Homo Sapiens
KADGKIMAL

SEQ ID NO: 154753 - protein, 9 aa, Homo Sapiens
KADGQQSSF

SEQ ID NO: 154754 - protein, 9 aa, Homo Sapiens
KADGVPVYL

SEQ ID NO: 154755 - protein, 9 aa, Homo Sapiens
KADIIVSEL

SEQ ID NO: 154756 - protein, 9 aa, Homo Sapiens
KADIPLVVL

SEQ ID NO: 154757 - protein, 9 aa, Homo Sapiens
KADIPSVAF

SEQ ID NO: 154758 - protein, 9 aa, Homo Sapiens
KADLESESF

SEQ ID NO: 154759 - protein, 9 aa, Homo Sapiens
KADLGKIVL

SEQ ID NO: 154760 - protein, 9 aa, Homo Sapiens
KADLGPISL

SEQ ID NO: 154761 - protein, 9 aa, Homo Sapiens
KADLTALFL

SEQ ID NO: 154762 - protein, 9 aa, Homo Sapiens
KADMTCRGF

SEQ ID NO: 154763 - protein, 9 aa, Homo Sapiens
KADNVGSAL

SEQ ID NO: 154764 - protein, 9 aa, Homo Sapiens
KADPQGPEL

SEQ ID NO: 154765 - protein, 9 aa, Homo Sapiens
KADPSHFEL

SEQ ID NO: 154766 - protein, 9 aa, Homo Sapiens
KADQKGVTI

SEQ ID NO: 154767 - protein, 9 aa, Homo Sapiens
KADQQLRSL

SEQ ID NO: 154768 - protein, 9 aa, Homo Sapiens
KADRETVAV

SEQ ID NO: 154769 - protein, 9 aa, Homo Sapiens
KADSINKPF

SEQ ID NO: 154770 - protein, 9 aa, Homo Sapiens
KADSRLKAL

SEQ ID NO: 154771 - protein, 9 aa, Homo Sapiens
KADSVVVLL

SEQ ID NO: 154772 - protein, 9 aa, Homo Sapiens
KADTEEEFL

SEQ ID NO: 154773 - protein, 9 aa, Homo Sapiens
KADVEEEFL

SEQ ID NO: 154774 - protein, 9 aa, Homo Sapiens
KADVEEESL

SEQ ID NO: 154775 - protein, 9 aa, Homo Sapiens
KADVEGELL

SEQ ID NO: 154776 - protein, 9 aa, Homo Sapiens
KADVEKVAL

SEQ ID NO: 154777 - protein, 9 aa, Homo Sapiens
KADVVISAF

SEQ ID NO: 154778 - protein, 9 aa, Homo Sapiens
KADVVPVTL

SEQ ID NO: 154779 - protein, 9 aa, Homo Sapiens
KAEEPPSQL

SEQ ID NO: 154780 - protein, 9 aa, Homo Sapiens
KAMEAASSL

SEQ ID NO: 154781 - protein, 9 aa, Homo Sapiens
KAPGSTSNL

SEQ ID NO: 154782 - protein, 9 aa, Homo Sapiens
KAVNPGRSL

SEQ ID NO: 154783 - protein, 9 aa, Homo Sapiens
KFDETEQAL

SEQ ID NO: 154784 - protein, 9 aa, Homo Sapiens
KGDEVTITL

SEQ ID NO: 154785 - protein, 9 aa, Homo Sapiens
KGDFSSNEV

SEQ ID NO: 154786 - protein, 9 aa, Homo Sapiens
KGDLENAFL

SEQ ID NO: 154787 - protein, 9 aa, Homo Sapiens
KGDSTIREL

SEQ ID NO: 154788 - protein, 9 aa, Homo Sapiens
KIDDFPNEL

SEQ ID NO: 154789 - protein, 9 aa, Homo Sapiens
KIDDILQTL

SEQ ID NO: 154790 - protein, 9 aa, Homo Sapiens
KIDDKPVKI

SEQ ID NO: 154791 - protein, 9 aa, Homo Sapiens
KIDDTIRYL

SEQ ID NO: 154792 - protein, 9 aa, Homo Sapiens
KIDEKTAEL

SEQ ID NO: 154793 - protein, 9 aa, Homo Sapiens
KIDKYTEVL

SEQ ID NO: 154794 - protein, 9 aa, Homo Sapiens
KIDLAGSSL

SEQ ID NO: 154795 - protein, 9 aa, Homo Sapiens
KIDLENRQV

SEQ ID NO: 154796 - protein, 9 aa, Homo Sapiens
KIDLETHSL

SEQ ID NO: 154797 - protein, 9 aa, Homo Sapiens
KLDDMLSEL

SEQ ID NO: 154798 - protein, 9 aa, Homo Sapiens
KLDETGNSL

SEQ ID NO: 154799 - protein, 9 aa, Homo Sapiens
KLDETGVAL

SEQ ID NO: 154800 - protein, 9 aa, Homo Sapiens
KLDLNGNTL

SEQ ID NO: 154801 - protein, 9 aa, Homo Sapiens
KLDVGNAEV

SEQ ID NO: 154802 - protein, 9 aa, Homo Sapiens
KMDDIVVVA

SEQ ID NO: 154803 - protein, 9 aa, Homo Sapiens
KMDDPNFIP

SEQ ID NO: 154804 - protein, 9 aa, Homo Sapiens
KMDLPGVSI

SEQ ID NO: 154805 - protein, 9 aa, Homo Sapiens
KMDRALLEL

SEQ ID NO: 154806 - protein, 9 aa, Homo Sapiens
KNAESNAEL

SEQ ID NO: 154807 - protein, 9 aa, Homo Sapiens
KNDDFMNAL

SEQ ID NO: 154808 - protein, 9 aa, Homo Sapiens
KNDIAINEL

SEQ ID NO: 154809 - protein, 9 aa, Homo Sapiens
KNDIPSSYM

SEQ ID NO: 154810 - protein, 9 aa, Homo Sapiens
KNDLAVVDV

SEQ ID NO: 154811 - protein, 9 aa, Homo Sapiens
KNDQANYSL

SEQ ID NO: 154812 - protein, 9 aa, Homo Sapiens
KNDVGYREL

SEQ ID NO: 154813 - protein, 9 aa, Homo Sapiens
KQDESVKAL

SEQ ID NO: 154814 - protein, 9 aa, Homo Sapiens
KQDETQTKI

SEQ ID NO: 154815 - protein, 9 aa, Homo Sapiens
KQDFSPEVL

SEQ ID NO: 154816 - protein, 9 aa, Homo Sapiens
KQDGTIQNL

SEQ ID NO: 154817 - protein, 9 aa, Homo Sapiens
KQDLGPVPM

SEQ ID NO: 154818 - protein, 9 aa, Homo Sapiens
KQDLVELYL

SEQ ID NO: 154819 - protein, 9 aa, Homo Sapiens
KQDQTLAEL

SEQ ID NO: 154820 - protein, 9 aa, Homo Sapiens
KQDSGHLDL

SEQ ID NO: 154821 - protein, 9 aa, Homo Sapiens
KQDVIITAL

SEQ ID NO: 154822 - protein, 9 aa, Homo Sapiens
KQWLMTEAL

SEQ ID NO: 154823 - protein, 9 aa, Homo Sapiens
KSDAACQTL

SEQ ID NO: 154824 - protein, 9 aa, Homo Sapiens
KSDAPDTLL

SEQ ID NO: 154825 - protein, 9 aa, Homo Sapiens
KSDEGGKVL

SEQ ID NO: 154826 - protein, 9 aa, Homo Sapiens
KSDEKTWNL

SEQ ID NO: 154827 - protein, 9 aa, Homo Sapiens
KSDERLTAF

SEQ ID NO: 154828 - protein, 9 aa, Homo Sapiens
KSDEVTQEI

SEQ ID NO: 154829 - protein, 9 aa, Homo Sapiens
KSDHVAACL

SEQ ID NO: 154830 - protein, 9 aa, Homo Sapiens
KSDIDEVAL

SEQ ID NO: 154831 - protein, 9 aa, Homo Sapiens
KSDIGEVIL

SEQ ID NO: 154832 - protein, 9 aa, Homo Sapiens
KSDIYLNLL

SEQ ID NO: 154833 - protein, 9 aa, Homo Sapiens
KSDLLKAAL

SEQ ID NO: 154834 - protein, 9 aa, Homo Sapiens
KSDLQMQKI

SEQ ID NO: 154835 - protein, 9 aa, Homo Sapiens
KSDPSIVRL

SEQ ID NO: 154836 - protein, 9 aa, Homo Sapiens
KSDSPAIQL

SEQ ID NO: 154837 - protein, 9 aa, Homo Sapiens
KSDVPIQLL

SEQ ID NO: 154838 - protein, 9 aa, Homo Sapiens
KSEGNHPAL

SEQ ID NO: 154839 - protein, 9 aa, Homo Sapiens
KTDEMHTAL

SEQ ID NO: 154840 - protein, 9 aa, Homo Sapiens
KTDESSPVL

SEQ ID NO: 154841 - protein, 9 aa, Homo Sapiens
KTDHRNVEL

SEQ ID NO: 154842 - protein, 9 aa, Homo Sapiens
KTDPSVRPM

SEQ ID NO: 154843 - protein, 9 aa, Homo Sapiens
KTDQLVSFL

SEQ ID NO: 154844 - protein, 9 aa, Homo Sapiens
KTDVCTVHL

SEQ ID NO: 154845 - protein, 9 aa, Homo Sapiens
KTDVVVNSV

SEQ ID NO: 154846 - protein, 9 aa, Homo Sapiens
KTTTPGPSL

SEQ ID NO: 154847 - protein, 9 aa, Homo Sapiens
KVDDCSEVL

SEQ ID NO: 154848 - protein, 9 aa, Homo Sapiens
KVDEAVAVL

SEQ ID NO: 154849 - protein, 9 aa, Homo Sapiens
KVDELTTEI

SEQ ID NO: 154850 - protein, 9 aa, Homo Sapiens
KVDLAKRTL

SEQ ID NO: 154851 - protein, 9 aa, Homo Sapiens
KVDPLFTEL

SEQ ID NO: 154852 - protein, 9 aa, Homo Sapiens
KVDPSGVSL

SEQ ID NO: 154853 - protein, 9 aa, Homo Sapiens
KVDSEENTL

SEQ ID NO: 154854 - protein, 9 aa, Homo Sapiens
KVEEPSQCL

SEQ ID NO: 154855 - protein, 9 aa, Homo Sapiens
LAAARLAAA

SEQ ID NO: 154856 - protein, 9 aa, Homo Sapiens
LADAINTEF

SEQ ID NO: 154857 - protein, 9 aa, Homo Sapiens
LADAQNPSL

SEQ ID NO: 154858 - protein, 9 aa, Homo Sapiens
LADAVAVTM

SEQ ID NO: 154859 - protein, 9 aa, Homo Sapiens
LADDDARLL

SEQ ID NO: 154860 - protein, 9 aa, Homo Sapiens
LADDDFLTV

SEQ ID NO: 154861 - protein, 9 aa, Homo Sapiens
LADDLNEKI

SEQ ID NO: 154862 - protein, 9 aa, Homo Sapiens
LADDSRVVT

SEQ ID NO: 154863 - protein, 9 aa, Homo Sapiens
LADDSVRSL

SEQ ID NO: 154864 - protein, 9 aa, Homo Sapiens
LADEAEVHL

SEQ ID NO: 154865 - protein, 9 aa, Homo Sapiens
LADEAFFSV

SEQ ID NO: 154866 - protein, 9 aa, Homo Sapiens
LADEFGVAV

SEQ ID NO: 154867 - protein, 9 aa, Homo Sapiens
LADEKVETV

SEQ ID NO: 154868 - protein, 9 aa, Homo Sapiens
LADELINAA

SEQ ID NO: 154869 - protein, 9 aa, Homo Sapiens
LADENREVL

SEQ ID NO: 154870 - protein, 9 aa, Homo Sapiens
LADERNELL

SEQ ID NO: 154871 - protein, 9 aa, Homo Sapiens
LADETLLKV

SEQ ID NO: 154872 - protein, 9 aa, Homo Sapiens
LADEVITVF

SEQ ID NO: 154873 - protein, 9 aa, Homo Sapiens
LADFEAGLL

SEQ ID NO: 154874 - protein, 9 aa, Homo Sapiens
LADFSPLTL

SEQ ID NO: 154875 - protein, 9 aa, Homo Sapiens
LADGADEHL

SEQ ID NO: 154876 - protein, 9 aa, Homo Sapiens
LADGLKVVL

SEQ ID NO: 154877 - protein, 9 aa, Homo Sapiens
LADGSIAVL

SEQ ID NO: 154878 - protein, 9 aa, Homo Sapiens
LADGVVSQA

SEQ ID NO: 154879 - protein, 9 aa, Homo Sapiens
LADGYDLEI

SEQ ID NO: 154880 - protein, 9 aa, Homo Sapiens
LADHPDAPM

SEQ ID NO: 154881 - protein, 9 aa, Homo Sapiens
LADHTVHVL

SEQ ID NO: 154882 - protein, 9 aa, Homo Sapiens
LADIAQSQL

SEQ ID NO: 154883 - protein, 9 aa, Homo Sapiens
LADILSESL

SEQ ID NO: 154884 - protein, 9 aa, Homo Sapiens
LADIQIEQL

SEQ ID NO: 154885 - protein, 9 aa, Homo Sapiens
LADKNVPNL

SEQ ID NO: 154886 - protein, 9 aa, Homo Sapiens
LADKSVLVC

SEQ ID NO: 154887 - protein, 9 aa, Homo Sapiens
LADLADFAL

SEQ ID NO: 154888 - protein, 9 aa, Homo Sapiens
LADLAKEEL

SEQ ID NO: 154889 - protein, 9 aa, Homo Sapiens
LADLENLAF

SEQ ID NO: 154890 - protein, 9 aa, Homo Sapiens
LADLGLDSL

SEQ ID NO: 154891 - protein, 9 aa, Homo Sapiens
LADLHPDVF

SEQ ID NO: 154892 - protein, 9 aa, Homo Sapiens
LADLIEKEL

SEQ ID NO: 154893 - protein, 9 aa, Homo Sapiens
LADLPQQLL

SEQ ID NO: 154894 - protein, 9 aa, Homo Sapiens
LADLQLEYL

SEQ ID NO: 154895 - protein, 9 aa, Homo Sapiens
LADLQNDEV

SEQ ID NO: 154896 - protein, 9 aa, Homo Sapiens
LADLSELQL

SEQ ID NO: 154897 - protein, 9 aa, Homo Sapiens
LADMHSTEI

SEQ ID NO: 154898 - protein, 9 aa, Homo Sapiens
LADPGIITI

SEQ ID NO: 154899 - protein, 9 aa, Homo Sapiens
LADPVFRTL

SEQ ID NO: 154900 - protein, 9 aa, Homo Sapiens
LADQMISRI

SEQ ID NO: 154901 - protein, 9 aa, Homo Sapiens
LADRNVTVL

SEQ ID NO: 154902 - protein, 9 aa, Homo Sapiens
LADSVGHHL

SEQ ID NO: 154903 - protein, 9 aa, Homo Sapiens
LADTQPAVL

SEQ ID NO: 154904 - protein, 9 aa, Homo Sapiens
LADTRATSV

SEQ ID NO: 154905 - protein, 9 aa, Homo Sapiens
LADVDPMQL

SEQ ID NO: 154906 - protein, 9 aa, Homo Sapiens
LADVIIHEI

SEQ ID NO: 154907 - protein, 9 aa, Homo Sapiens
LADVMSEQL

SEQ ID NO: 154908 - protein, 9 aa, Homo Sapiens
LADVPGEIL

SEQ ID NO: 154909 - protein, 9 aa, Homo Sapiens
LAEAESRVL

SEQ ID NO: 154910 - protein, 9 aa, Homo Sapiens
LAEDPKVTL

SEQ ID NO: 154911 - protein, 9 aa, Homo Sapiens
LAEDTRTEL

SEQ ID NO: 154912 - protein, 9 aa, Homo Sapiens
LAEEPEAVL

SEQ ID NO: 154913 - protein, 9 aa, Homo Sapiens
LAEESIVCL

SEQ ID NO: 154914 - protein, 9 aa, Homo Sapiens
LAEGSPRSL

SEQ ID NO: 154915 - protein, 9 aa, Homo Sapiens
LAEHPNVTL

SEQ ID NO: 154916 - protein, 9 aa, Homo Sapiens
LAEIAKAEL

SEQ ID NO: 154917 - protein, 9 aa, Homo Sapiens
LAEIAKVEL

SEQ ID NO: 154918 - protein, 9 aa, Homo Sapiens
LAEIGAVTL

SEQ ID NO: 154919 - protein, 9 aa, Homo Sapiens
LASEPQEVL

SEQ ID NO: 154920 - protein, 9 aa, Homo Sapiens
LFDEIDQAL

SEQ ID NO: 154921 - protein, 9 aa, Homo Sapiens
LGDDPTSSF

SEQ ID NO: 154922 - protein, 9 aa, Homo Sapiens
LGDLAITSL

SEQ ID NO: 154923 - protein, 9 aa, Homo Sapiens
LGDLSDSQL

SEQ ID NO: 154924 - protein, 9 aa, Homo Sapiens
LGDVGMAEL

SEQ ID NO: 154925 - protein, 9 aa, Homo Sapiens
LIDAGVDAL

SEQ ID NO: 154926 - protein, 9 aa, Homo Sapiens
LIDDLQHCL

SEQ ID NO: 154927 - protein, 9 aa, Homo Sapiens
LIDELNQAL

SEQ ID NO: 154928 - protein, 9 aa, Homo Sapiens
LIDEMVNTI

SEQ ID NO: 154929 - protein, 9 aa, Homo Sapiens
LIDEPSAYL

SEQ ID NO: 154930 - protein, 9 aa, Homo Sapiens
LIDEQILCV

SEQ ID NO: 154931 - protein, 9 aa, Homo Sapiens
LIDESVHAL

SEQ ID NO: 154932 - protein, 9 aa, Homo Sapiens
LIDFGSGAL

SEQ ID NO: 154933 - protein, 9 aa, Homo Sapiens
LIDIQPNTL

SEQ ID NO: 154934 - protein, 9 aa, Homo Sapiens
LIDKESASL

SEQ ID NO: 154935 - protein, 9 aa, Homo Sapiens
LIDKPNLQF

SEQ ID NO: 154936 - protein, 9 aa, Homo Sapiens
LIDKTTAAF

SEQ ID NO: 154937 - protein, 9 aa, Homo Sapiens
LIDLHNHDL

SEQ ID NO: 154938 - protein, 9 aa, Homo Sapiens
LIDLPGTEL

SEQ ID NO: 154939 - protein, 9 aa, Homo Sapiens
LIDLPTCEL

SEQ ID NO: 154940 - protein, 9 aa, Homo Sapiens
LIDMYSEVL

SEQ ID NO: 154941 - protein, 9 aa, Homo Sapiens
LIDNPNLVI

SEQ ID NO: 154942 - protein, 9 aa, Homo Sapiens
LIDQKVYEL

SEQ ID NO: 154943 - protein, 9 aa, Homo Sapiens
LIDVARTSL

SEQ ID NO: 154944 - protein, 9 aa, Homo Sapiens
LKDNPNQSL

SEQ ID NO: 154945 - protein, 9 aa, Homo Sapiens
LLDATQHTL

SEQ ID NO: 154946 - protein, 9 aa, Homo Sapiens
LLDDKAQAL

SEQ ID NO: 154947 - protein, 9 aa, Homo Sapiens
LLDEPTNML

SEQ ID NO: 154948 - protein, 9 aa, Homo Sapiens
LLDFPNIVI

SEQ ID NO: 154949 - protein, 9 aa, Homo Sapiens
LLDGSNVVF

SEQ ID NO: 154950 - protein, 9 aa, Homo Sapiens
LLDLGEVAL

SEQ ID NO: 154951 - protein, 9 aa, Homo Sapiens
LLDMPAAEL

SEQ ID NO: 154952 - protein, 9 aa, Homo Sapiens
LLDPDTAVL

SEQ ID NO: 154953 - protein, 9 aa, Homo Sapiens
LLDSPGKVL

SEQ ID NO: 154954 - protein, 9 aa, Homo Sapiens
LLDSRVMEL

SEQ ID NO: 154955 - protein, 9 aa, Homo Sapiens
LLDSSHSEL

SEQ ID NO: 154956 - protein, 9 aa, Homo Sapiens
LLDTVNNVF

SEQ ID NO: 154957 - protein, 9 aa, Homo Sapiens
LLDVAPLSL

SEQ ID NO: 154958 - protein, 9 aa, Homo Sapiens
LLDVPTAAV

SEQ ID NO: 154959 - protein, 9 aa, Homo Sapiens
LLDVTPLSL

SEQ ID NO: 154960 - protein, 9 aa, Homo Sapiens
LLDYPNNLL

SEQ ID NO: 154961 - protein, 9 aa, Homo Sapiens
LLDYPNNVL

SEQ ID NO: 154962 - protein, 9 aa, Homo Sapiens
LMDNPSLAF

SEQ ID NO: 154963 - protein, 9 aa, Homo Sapiens
LMDPPGTAL

SEQ ID NO: 154964 - protein, 9 aa, Homo Sapiens
LNDLQANSL

SEQ ID NO: 154965 - protein, 9 aa, Homo Sapiens
LNDPNKEAL

SEQ ID NO: 154966 - protein, 9 aa, Homo Sapiens
LNDVSNHTL

SEQ ID NO: 154967 - protein, 9 aa, Homo Sapiens
LPINGNGKQ

SEQ ID NO: 154968 - protein, 9 aa, Homo Sapiens
LQADYASQA

SEQ ID NO: 154969 - protein, 9 aa, Homo Sapiens
LQDFAQVTL

SEQ ID NO: 154970 - protein, 9 aa, Homo Sapiens
LQDFSQVTL

SEQ ID NO: 154971 - protein, 9 aa, Homo Sapiens
LQDLTFVHL

SEQ ID NO: 154972 - protein, 9 aa, Homo Sapiens
LQDQLRVAL

SEQ ID NO: 154973 - protein, 9 aa, Homo Sapiens
LSDDEIVSL

SEQ ID NO: 154974 - protein, 9 aa, Homo Sapiens
LSDDGKASL

SEQ ID NO: 154975 - protein, 9 aa, Homo Sapiens
LSDDHVLIL

SEQ ID NO: 154976 - protein, 9 aa, Homo Sapiens
LSDDIKESL

SEQ ID NO: 154977 - protein, 9 aa, Homo Sapiens
LSDDPTVSA

SEQ ID NO: 154978 - protein, 9 aa, Homo Sapiens
LSDEENLKL

SEQ ID NO: 154979 - protein, 9 aa, Homo Sapiens
LSDEHAGVI

SEQ ID NO: 154980 - protein, 9 aa, Homo Sapiens
LSDELRISL

SEQ ID NO: 154981 - protein, 9 aa, Homo Sapiens
LSDETLLEI

SEQ ID NO: 154982 - protein, 9 aa, Homo Sapiens
LSDGVVVQV

SEQ ID NO: 154983 - protein, 9 aa, Homo Sapiens
LSDHIQEEL

SEQ ID NO: 154984 - protein, 9 aa, Homo Sapiens
LSDIKGSVL

SEQ ID NO: 154985 - protein, 9 aa, Homo Sapiens
LSDISKIDL

SEQ ID NO: 154986 - protein, 9 aa, Homo Sapiens
LSDLAHFSL

SEQ ID NO: 154987 - protein, 9 aa, Homo Sapiens
LSDLALHFL

SEQ ID NO: 154988 - protein, 9 aa, Homo Sapiens
LSDLCGTVM

SEQ ID NO: 154989 - protein, 9 aa, Homo Sapiens
LSDLLEQTL

SEQ ID NO: 154990 - protein, 9 aa, Homo Sapiens
LSDLQVIKI

SEQ ID NO: 154991 - protein, 9 aa, Homo Sapiens
LSDLRVIDL

SEQ ID NO: 154992 - protein, 9 aa, Homo Sapiens
LSDLTGSLL

SEQ ID NO: 154993 - protein, 9 aa, Homo Sapiens
LSDPFYRTL

SEQ ID NO: 154994 - protein, 9 aa, Homo Sapiens
LSDPIVNTL

SEQ ID NO: 154995 - protein, 9 aa, Homo Sapiens
LSDPQVHTV

SEQ ID NO: 154996 - protein, 9 aa, Homo Sapiens
LSDPTYREL

SEQ ID NO: 154997 - protein, 9 aa, Homo Sapiens
LSDPVHLTV

SEQ ID NO: 154998 - protein, 9 aa, Homo Sapiens
LSDQSSVTL

SEQ ID NO: 154999 - protein, 9 aa, Homo Sapiens
LSDTGISAL

SEQ ID NO: 155000 - protein, 9 aa, Homo Sapiens
LSDTPNNHF

SEQ ID NO: 155001 - protein, 9 aa, Homo Sapiens
LSDTVRTVL

SEQ ID NO: 155002 - protein, 9 aa, Homo Sapiens
LSDVPTKCI

SEQ ID NO: 155003 - protein, 9 aa, Homo Sapiens
LSDYDILSL

SEQ ID NO: 155004 - protein, 9 aa, Homo Sapiens
LSDYGPPSL

SEQ ID NO: 155005 - protein, 9 aa, Homo Sapiens
LSEEQCREL

SEQ ID NO: 155006 - protein, 9 aa, Homo Sapiens
LSEHPNVTL

SEQ ID NO: 155007 - protein, 9 aa, Homo Sapiens
LSYLEKEAL

SEQ ID NO: 155008 - protein, 9 aa, Homo Sapiens
LTDDGNKWL

SEQ ID NO: 155009 - protein, 9 aa, Homo Sapiens
LTDDGRVFL

SEQ ID NO: 155010 - protein, 9 aa, Homo Sapiens
LTDDHVQFL

SEQ ID NO: 155011 - protein, 9 aa, Homo Sapiens
LTDEDTRNL

SEQ ID NO: 155012 - protein, 9 aa, Homo Sapiens
LTDEGVVAL

SEQ ID NO: 155013 - protein, 9 aa, Homo Sapiens
LTDEQIHHL

SEQ ID NO: 155014 - protein, 9 aa, Homo Sapiens
LTDEQRNEL

SEQ ID NO: 155015 - protein, 9 aa, Homo Sapiens
LTDESLSSL

SEQ ID NO: 155016 - protein, 9 aa, Homo Sapiens
LTDGHPLTL

SEQ ID NO: 155017 - protein, 9 aa, Homo Sapiens
LTDGPNERI

SEQ ID NO: 155018 - protein, 9 aa, Homo Sapiens
LTDIHGNVL

SEQ ID NO: 155019 - protein, 9 aa, Homo Sapiens
LTDKSCQSF

SEQ ID NO: 155020 - protein, 9 aa, Homo Sapiens
LTDRDLCEL

SEQ ID NO: 155021 - protein, 9 aa, Homo Sapiens
LTDSPKPAL

SEQ ID NO: 155022 - protein, 9 aa, Homo Sapiens
LTDTEIMTL

SEQ ID NO: 155023 - protein, 9 aa, Homo Sapiens
LTDTPDTTA

SEQ ID NO: 155024 - protein, 9 aa, Homo Sapiens
LTDVGFTTL

SEQ ID NO: 155025 - protein, 9 aa, Homo Sapiens
LTDVMLHAL

SEQ ID NO: 155026 - protein, 9 aa, Homo Sapiens
LTDVNVVAV

SEQ ID NO: 155027 - protein, 9 aa, Homo Sapiens
LTEDPHTVL

SEQ ID NO: 155028 - protein, 9 aa, Homo Sapiens
LVDAPCSDL

SEQ ID NO: 155029 - protein, 9 aa, Homo Sapiens
LVDDHFVEL

SEQ ID NO: 155030 - protein, 9 aa, Homo Sapiens
LVDDLVDSL

SEQ ID NO: 155031 - protein, 9 aa, Homo Sapiens
LVDEAKNYL

SEQ ID NO: 155032 - protein, 9 aa, Homo Sapiens
LVDENFTEL

SEQ ID NO: 155033 - protein, 9 aa, Homo Sapiens
LVDGPCTQV

SEQ ID NO: 155034 - protein, 9 aa, Homo Sapiens
LVDGQIFCL

SEQ ID NO: 155035 - protein, 9 aa, Homo Sapiens
LVDPDTAVL

SEQ ID NO: 155036 - protein, 9 aa, Homo Sapiens
LVDRSCTVL

SEQ ID NO: 155037 - protein, 9 aa, Homo Sapiens
LVDSSGHSV

SEQ ID NO: 155038 - protein, 9 aa, Homo Sapiens
LVDTPPSAL

SEQ ID NO: 155039 - protein, 9 aa, Homo Sapiens
LVDVVTGQL

SEQ ID NO: 155040 - protein, 9 aa, Homo Sapiens
LVEDLSESL

SEQ ID NO: 155041 - protein, 9 aa, Homo Sapiens
LVEPPPMSL

SEQ ID NO: 155042 - protein, 9 aa, Homo Sapiens
LWDEVLSHL

SEQ ID NO: 155043 - protein, 9 aa, Homo Sapiens
MADAGILRL

SEQ ID NO: 155044 - protein, 9 aa, Homo Sapiens
MADEAGLDL

SEQ ID NO: 155045 - protein, 9 aa, Homo Sapiens
MADGNQAQL

SEQ ID NO: 155046 - protein, 9 aa, Homo Sapiens
MADIGGHAI

SEQ ID NO: 155047 - protein, 9 aa, Homo Sapiens
MADIPGHVF

SEQ ID NO: 155048 - protein, 9 aa, Homo Sapiens
MADKCSPTL

SEQ ID NO: 155049 - protein, 9 aa, Homo Sapiens
MADLEGLHL

SEQ ID NO: 155050 - protein, 9 aa, Homo Sapiens
MADLEQKVL

SEQ ID NO: 155051 - protein, 9 aa, Homo Sapiens
MADPEVQQI

SEQ ID NO: 155052 - protein, 9 aa, Homo Sapiens
MADSDFLAL

SEQ ID NO: 155053 - protein, 9 aa, Homo Sapiens
MADTFLEHM

SEQ ID NO: 155054 - protein, 9 aa, Homo Sapiens
MAEERAESL

SEQ ID NO: 155055 - protein, 9 aa, Homo Sapiens
MAEIFGTEL

SEQ ID NO: 155056 - protein, 9 aa, Homo Sapiens
MAESPSRDV

SEQ ID NO: 155057 - protein, 9 aa, Homo Sapiens
MAETKGVAL

SEQ ID NO: 155058 - protein, 9 aa, Homo Sapiens
MGDDYILDL

SEQ ID NO: 155059 - protein, 9 aa, Homo Sapiens
MIDERQQEL

SEQ ID NO: 155060 - protein, 9 aa, Homo Sapiens
MIDETRNSL

SEQ ID NO: 155061 - protein, 9 aa, Homo Sapiens
MIDRDNSVF

SEQ ID NO: 155062 - protein, 9 aa, Homo Sapiens
MLDEPTNHL

SEQ ID NO: 155063 - protein, 9 aa, Homo Sapiens
MLDFENQTL

SEQ ID NO: 155064 - protein, 9 aa, Homo Sapiens
MLDFYSDKN

SEQ ID NO: 155065 - protein, 9 aa, Homo Sapiens
MLDLQGAAL

SEQ ID NO: 155066 - protein, 9 aa, Homo Sapiens
MNDDARTEL

SEQ ID NO: 155067 - protein, 9 aa, Homo Sapiens
MNDDITTSL

SEQ ID NO: 155068 - protein, 9 aa, Homo Sapiens
MNDGPHSAL

SEQ ID NO: 155069 - protein, 9 aa, Homo Sapiens
MNDMTAVAL

SEQ ID NO: 155070 - protein, 9 aa, Homo Sapiens
MPDSAAALL

SEQ ID NO: 155071 - protein, 9 aa, Homo Sapiens
MQDIVLNEV

SEQ ID NO: 155072 - protein, 9 aa, Homo Sapiens
MQDMVKDAL

SEQ ID NO: 155073 - protein, 9 aa, Homo Sapiens
MSDLPVKVI

SEQ ID NO: 155074 - protein, 9 aa, Homo Sapiens
MSDTTFKAL

SEQ ID NO: 155075 - protein, 9 aa, Homo Sapiens
MTDDKITEV

SEQ ID NO: 155076 - protein, 9 aa, Homo Sapiens
MTDGAQQAL

SEQ ID NO: 155077 - protein, 9 aa, Homo Sapiens
MTDPEMVEV

SEQ ID NO: 155078 - protein, 9 aa, Homo Sapiens
MVDDRLVTM

SEQ ID NO: 155079 - protein, 9 aa, Homo Sapiens
MVDENFSTL

SEQ ID NO: 155080 - protein, 9 aa, Homo Sapiens
MVDERTDYL

SEQ ID NO: 155081 - protein, 9 aa, Homo Sapiens
MVDGKPVNL

SEQ ID NO: 155082 - protein, 9 aa, Homo Sapiens
MVEEIGVEL

SEQ ID NO: 155083 - protein, 9 aa, Homo Sapiens
NADAIVVKL

SEQ ID NO: 155084 - protein, 9 aa, Homo Sapiens
NADETPICL

SEQ ID NO: 155085 - protein, 9 aa, Homo Sapiens
NADFAKLFL

SEQ ID NO: 155086 - protein, 9 aa, Homo Sapiens
NADGKIISL

SEQ ID NO: 155087 - protein, 9 aa, Homo Sapiens
NADHTTLLL

SEQ ID NO: 155088 - protein, 9 aa, Homo Sapiens
NADIAVVEM

SEQ ID NO: 155089 - protein, 9 aa, Homo Sapiens
NADIFRGLT

SEQ ID NO: 155090 - protein, 9 aa, Homo Sapiens
NADISGMKV

SEQ ID NO: 155091 - protein, 9 aa, Homo Sapiens
NADISQSLL

SEQ ID NO: 155092 - protein, 9 aa, Homo Sapiens
NADLFRGTL

SEQ ID NO: 155093 - protein, 9 aa, Homo Sapiens
NADLINRVL

SEQ ID NO: 155094 - protein, 9 aa, Homo Sapiens
NADLIQVAF

SEQ ID NO: 155095 - protein, 9 aa, Homo Sapiens
NADLPIATA

SEQ ID NO: 155096 - protein, 9 aa, Homo Sapiens
NADLRPSKL

SEQ ID NO: 155097 - protein, 9 aa, Homo Sapiens
NADPASHEI

SEQ ID NO: 155098 - protein, 9 aa, Homo Sapiens
NADPILISL

SEQ ID NO: 155099 - protein, 9 aa, Homo Sapiens
NADPLEVML

SEQ ID NO: 155100 - protein, 9 aa, Homo Sapiens
NADPQAVTM

SEQ ID NO: 155101 - protein, 9 aa, Homo Sapiens
NADQLASKL

SEQ ID NO: 155102 - protein, 9 aa, Homo Sapiens
NADQQNFTV

SEQ ID NO: 155103 - protein, 9 aa, Homo Sapiens
NADSATRLL

SEQ ID NO: 155104 - protein, 9 aa, Homo Sapiens
NADSKALDL

SEQ ID NO: 155105 - protein, 9 aa, Homo Sapiens
NADSQFWSL

SEQ ID NO: 155106 - protein, 9 aa, Homo Sapiens
NADSSNTAL

SEQ ID NO: 155107 - protein, 9 aa, Homo Sapiens
NADTLALVF

SEQ ID NO: 155108 - protein, 9 aa, Homo Sapiens
NADTVSSKL

SEQ ID NO: 155109 - protein, 9 aa, Homo Sapiens
NADVALQNL

SEQ ID NO: 155110 - protein, 9 aa, Homo Sapiens
NADVALVNF

SEQ ID NO: 155111 - protein, 9 aa, Homo Sapiens
NADVPEQLI

SEQ ID NO: 155112 - protein, 9 aa, Homo Sapiens
NADVQERLL

SEQ ID NO: 155113 - protein, 9 aa, Homo Sapiens
NADVQSIAV

SEQ ID NO: 155114 - protein, 9 aa, Homo Sapiens
NADYVAAFL

SEQ ID NO: 155115 - protein, 9 aa, Homo Sapiens
NAEPEPRSL

SEQ ID NO: 155116 - protein, 9 aa, Homo Sapiens
NAEQHVTQL

SEQ ID NO: 155117 - protein, 9 aa, Homo Sapiens
NAETFGIPL

SEQ ID NO: 155118 - protein, 9 aa, Homo Sapiens
NALDLNSVL

SEQ ID NO: 155119 - protein, 9 aa, Homo Sapiens
NFDGHVVLP

SEQ ID NO: 155120 - protein, 9 aa, Homo Sapiens
NGDISSLEL

SEQ ID NO: 155121 - protein, 9 aa, Homo Sapiens
NGDTPNLSF

SEQ ID NO: 155122 - protein, 9 aa, Homo Sapiens
NIDAHNTSV

SEQ ID NO: 155123 - protein, 9 aa, Homo Sapiens
NIDEGPLAF

SEQ ID NO: 155124 - protein, 9 aa, Homo Sapiens
NIDEIYKAL

SEQ ID NO: 155125 - protein, 9 aa, Homo Sapiens
NIDFMPTIL

SEQ ID NO: 155126 - protein, 9 aa, Homo Sapiens
NIDINNNEL

SEQ ID NO: 155127 - protein, 9 aa, Homo Sapiens
NIDIQNGFL

SEQ ID NO: 155128 - protein, 9 aa, Homo Sapiens
NIDLAVQCL

SEQ ID NO: 155129 - protein, 9 aa, Homo Sapiens
NIDLVVKEL

SEQ ID NO: 155130 - protein, 9 aa, Homo Sapiens
NIDVVGVSF

SEQ ID NO: 155131 - protein, 9 aa, Homo Sapiens
NIDYTVHSV

SEQ ID NO: 155132 - protein, 9 aa, Homo Sapiens
NIESPTSIL

SEQ ID NO: 155133 - protein, 9 aa, Homo Sapiens
NLDATVTAL

SEQ ID NO: 155134 - protein, 9 aa, Homo Sapiens
NLDENGLDL

SEQ ID NO: 155135 - protein, 9 aa, Homo Sapiens
NLDETSEIL

SEQ ID NO: 155136 - protein, 9 aa, Homo Sapiens
NLDLAVLEL

SEQ ID NO: 155137 - protein, 9 aa, Homo Sapiens
NLDLQHNEL

SEQ ID NO: 155138 - protein, 9 aa, Homo Sapiens
NLDNSSSHL

SEQ ID NO: 155139 - protein, 9 aa, Homo Sapiens
NMDCPNHGF

SEQ ID NO: 155140 - protein, 9 aa, Homo Sapiens
NMDSPGPML

SEQ ID NO: 155141 - protein, 9 aa, Homo Sapiens
NQDLALSNL

SEQ ID NO: 155142 - protein, 9 aa, Homo Sapiens
NQDLTFQHI

SEQ ID NO: 155143 - protein, 9 aa, Homo Sapiens
NSDADPLCL

SEQ ID NO: 155144 - protein, 9 aa, Homo Sapiens
NSDDIGVFL

SEQ ID NO: 155145 - protein, 9 aa, Homo Sapiens
NSDGLIASL

SEQ ID NO: 155146 - protein, 9 aa, Homo Sapiens
NSDGRQQIL

SEQ ID NO: 155147 - protein, 9 aa, Homo Sapiens
NSDGYPDSL

SEQ ID NO: 155148 - protein, 9 aa, Homo Sapiens
NSDINEWSL

SEQ ID NO: 155149 - protein, 9 aa, Homo Sapiens
NSDLVLQTL

SEQ ID NO: 155150 - protein, 9 aa, Homo Sapiens
NSDPETPVL

SEQ ID NO: 155151 - protein, 9 aa, Homo Sapiens
NSDPYSVAL

SEQ ID NO: 155152 - protein, 9 aa, Homo Sapiens
NSDSPQQVL

SEQ ID NO: 155153 - protein, 9 aa, Homo Sapiens
NSDTHSSTF

SEQ ID NO: 155154 - protein, 9 aa, Homo Sapiens
NSDTSVETL

SEQ ID NO: 155155 - protein, 9 aa, Homo Sapiens
NSDTTSPEL

SEQ ID NO: 155156 - protein, 9 aa, Homo Sapiens
NTDEPPMVF

SEQ ID NO: 155157 - protein, 9 aa, Homo Sapiens
NTDGKTLPS

SEQ ID NO: 155158 - protein, 9 aa, Homo Sapiens
NTDISILSL

SEQ ID NO: 155159 - protein, 9 aa, Homo Sapiens
NTDSSPRCL

SEQ ID NO: 155160 - protein, 9 aa, Homo Sapiens
NTDSVHLAL

SEQ ID NO: 155161 - protein, 9 aa, Homo Sapiens
NVDAGKSTL

SEQ ID NO: 155162 - protein, 9 aa, Homo Sapiens
NVDDCGFSL

SEQ ID NO: 155163 - protein, 9 aa, Homo Sapiens
NVDDPTGNF

SEQ ID NO: 155164 - protein, 9 aa, Homo Sapiens
NVDENVAEL

SEQ ID NO: 155165 - protein, 9 aa, Homo Sapiens
NVDGHLYEL

SEQ ID NO: 155166 - protein, 9 aa, Homo Sapiens
NVDIPDVPL

SEQ ID NO: 155167 - protein, 9 aa, Homo Sapiens
NVDPDNVVL

SEQ ID NO: 155168 - protein, 9 aa, Homo Sapiens
NVDPDSVVL

SEQ ID NO: 155169 - protein, 9 aa, Homo Sapiens
NVDQAFHEL

SEQ ID NO: 155170 - protein, 9 aa, Homo Sapiens
NVDQAVATL

SEQ ID NO: 155171 - protein, 9 aa, Homo Sapiens
NVDSGKSTL

SEQ ID NO: 155172 - protein, 9 aa, Homo Sapiens
NVDSNNKEL

SEQ ID NO: 155173 - protein, 9 aa, Homo Sapiens
NVDTPVSTL

SEQ ID NO: 155174 - protein, 9 aa, Homo Sapiens
NVEEAFFTL

SEQ ID NO: 155175 - protein, 9 aa, Homo Sapiens
NVENAFFTL

SEQ ID NO: 155176 - protein, 9 aa, Homo Sapiens
PADEPRTVL

SEQ ID NO: 155177 - protein, 9 aa, Homo Sapiens
QADAPNPGL

SEQ ID NO: 155178 - protein, 9 aa, Homo Sapiens
QADAPNPSL

SEQ ID NO: 155179 - protein, 9 aa, Homo Sapiens
QADARQVVL

SEQ ID NO: 155180 - protein, 9 aa, Homo Sapiens
QADCAVLIV

SEQ ID NO: 155181 - protein, 9 aa, Homo Sapiens
QADEVIAIL

SEQ ID NO: 155182 - protein, 9 aa, Homo Sapiens
QADFAIEAL

SEQ ID NO: 155183 - protein, 9 aa, Homo Sapiens
QADFEAHNI

SEQ ID NO: 155184 - protein, 9 aa, Homo Sapiens
QADFKPATL

SEQ ID NO: 155185 - protein, 9 aa, Homo Sapiens
QADIALIGL

SEQ ID NO: 155186 - protein, 9 aa, Homo Sapiens
QADICVREI

SEQ ID NO: 155187 - protein, 9 aa, Homo Sapiens
QADIEVRAL

SEQ ID NO: 155188 - protein, 9 aa, Homo Sapiens
QADLAVLVI

SEQ ID NO: 155189 - protein, 9 aa, Homo Sapiens
QADLSNLHL

SEQ ID NO: 155190 - protein, 9 aa, Homo Sapiens
QADNPHVAL

SEQ ID NO: 155191 - protein, 9 aa, Homo Sapiens
QADPSAPCL

SEQ ID NO: 155192 - protein, 9 aa, Homo Sapiens
QADPTKLEL

SEQ ID NO: 155193 - protein, 9 aa, Homo Sapiens
QADQEAKEL

SEQ ID NO: 155194 - protein, 9 aa, Homo Sapiens
QADQTFISL

SEQ ID NO: 155195 - protein, 9 aa, Homo Sapiens
QADSGRVLL

SEQ ID NO: 155196 - protein, 9 aa, Homo Sapiens
QADSLERSL

SEQ ID NO: 155197 - protein, 9 aa, Homo Sapiens
QADTPALSL

SEQ ID NO: 155198 - protein, 9 aa, Homo Sapiens
QADTTRLEL

SEQ ID NO: 155199 - protein, 9 aa, Homo Sapiens
QADVAVLVV

SEQ ID NO: 155200 - protein, 9 aa, Homo Sapiens
QADYGLEHL

SEQ ID NO: 155201 - protein, 9 aa, Homo Sapiens
QAEDGKTEL

SEQ ID NO: 155202 - protein, 9 aa, Homo Sapiens
QAERPDTML

SEQ ID NO: 155203 - protein, 9 aa, Homo Sapiens
QGDGPSRNL

SEQ ID NO: 155204 - protein, 9 aa, Homo Sapiens
QIDELVTRI

SEQ ID NO: 155205 - protein, 9 aa, Homo Sapiens
QIDFPTSAF

SEQ ID NO: 155206 - protein, 9 aa, Homo Sapiens
QIDIGGVTL

SEQ ID NO: 155207 - protein, 9 aa, Homo Sapiens
QIDQINTDL

SEQ ID NO: 155208 - protein, 9 aa, Homo Sapiens
QLDAENLEL

SEQ ID NO: 155209 - protein, 9 aa, Homo Sapiens
QLDIIIHSL

SEQ ID NO: 155210 - protein, 9 aa, Homo Sapiens
QLDLENTEL

SEQ ID NO: 155211 - protein, 9 aa, Homo Sapiens
QLDVSSNEL

SEQ ID NO: 155212 - protein, 9 aa, Homo Sapiens
QNDLGQTAL

SEQ ID NO: 155213 - protein, 9 aa, Homo Sapiens
QQDYFPKAL

SEQ ID NO: 155214 - protein, 9 aa, Homo Sapiens
QSDDPPIIL

SEQ ID NO: 155215 - protein, 9 aa, Homo Sapiens
QSDIPSSLL

SEQ ID NO: 155216 - protein, 9 aa, Homo Sapiens
QSDLGYNSL

SEQ ID NO: 155217 - protein, 9 aa, Homo Sapiens
QSDPSGAYF

SEQ ID NO: 155218 - protein, 9 aa, Homo Sapiens
QSDPVGPAL

SEQ ID NO: 155219 - protein, 9 aa, Homo Sapiens
QSDVYTHVL

SEQ ID NO: 155220 - protein, 9 aa, Homo Sapiens
QTDIPFTRL

SEQ ID NO: 155221 - protein, 9 aa, Homo Sapiens
QTDPPRSSL

SEQ ID NO: 155222 - protein, 9 aa, Homo Sapiens
QTDQPETVI

SEQ ID NO: 155223 - protein, 9 aa, Homo Sapiens
QVDNPVSVL

SEQ ID NO: 155224 - protein, 9 aa, Homo Sapiens
QWDLVENYL

SEQ ID NO: 155225 - protein, 9 aa, Homo Sapiens
RADADTVLL

SEQ ID NO: 155226 - protein, 9 aa, Homo Sapiens
RADAGPLCA

SEQ ID NO: 155227 - protein, 9 aa, Homo Sapiens
RADAPVALV

SEQ ID NO: 155228 - protein, 9 aa, Homo Sapiens
RADDTFEAL

SEQ ID NO: 155229 - protein, 9 aa, Homo Sapiens
RADEDARMI

SEQ ID NO: 155230 - protein, 9 aa, Homo Sapiens
RADEKITNI

SEQ ID NO: 155231 - protein, 9 aa, Homo Sapiens
RADESTYVL

SEQ ID NO: 155232 - protein, 9 aa, Homo Sapiens
RADGENTAF

SEQ ID NO: 155233 - protein, 9 aa, Homo Sapiens
RADHVFICF

SEQ ID NO: 155234 - protein, 9 aa, Homo Sapiens
RADIGAASL

SEQ ID NO: 155235 - protein, 9 aa, Homo Sapiens
RADILQVGL

SEQ ID NO: 155236 - protein, 9 aa, Homo Sapiens
RADKPWTRL

SEQ ID NO: 155237 - protein, 9 aa, Homo Sapiens
RADLIEVVM

SEQ ID NO: 155238 - protein, 9 aa, Homo Sapiens
RADLQATAL

SEQ ID NO: 155239 - protein, 9 aa, Homo Sapiens
RADLTYAEF

SEQ ID NO: 155240 - protein, 9 aa, Homo Sapiens
RADMLEMEL

SEQ ID NO: 155241 - protein, 9 aa, Homo Sapiens
RADPESPIL

SEQ ID NO: 155242 - protein, 9 aa, Homo Sapiens
RADREVAIY

SEQ ID NO: 155243 - protein, 9 aa, Homo Sapiens
RADSSRASL

SEQ ID NO: 155244 - protein, 9 aa, Homo Sapiens
RADSVGKLV

SEQ ID NO: 155245 - protein, 9 aa, Homo Sapiens
RADTFPQVL

SEQ ID NO: 155246 - protein, 9 aa, Homo Sapiens
RADTGHAFL

SEQ ID NO: 155247 - protein, 9 aa, Homo Sapiens
RADTGQERF

SEQ ID NO: 155248 - protein, 9 aa, Homo Sapiens
RADTQAQAL

SEQ ID NO: 155249 - protein, 9 aa, Homo Sapiens
RADVKGGTL

SEQ ID NO: 155250 - protein, 9 aa, Homo Sapiens
RADVSLTTL

SEQ ID NO: 155251 - protein, 9 aa, Homo Sapiens
RADYDNLVL

SEQ ID NO: 155252 - protein, 9 aa, Homo Sapiens
RAEDNADTL

SEQ ID NO: 155253 - protein, 9 aa, Homo Sapiens
RAEEAAGQL

SEQ ID NO: 155254 - protein, 9 aa, Homo Sapiens
RAEEGFTQV

SEQ ID NO: 155255 - protein, 9 aa, Homo Sapiens
RAEELGQEL

SEQ ID NO: 155256 - protein, 9 aa, Homo Sapiens
RAELASAAL

SEQ ID NO: 155257 - protein, 9 aa, Homo Sapiens
RAELHPVEL

SEQ ID NO: 155258 - protein, 9 aa, Homo Sapiens
RATNEGLSL

SEQ ID NO: 155259 - protein, 9 aa, Homo Sapiens
RFDVHDVTL

SEQ ID NO: 155260 - protein, 9 aa, Homo Sapiens
RGDDTPLHL

SEQ ID NO: 155261 - protein, 9 aa, Homo Sapiens
RGDSVIVVL

SEQ ID NO: 155262 - protein, 9 aa, Homo Sapiens
RGDTLLQAL

SEQ ID NO: 155263 - protein, 9 aa, Homo Sapiens
RGDWPGVVL

SEQ ID NO: 155264 - protein, 9 aa, Homo Sapiens
RIDDLQMVL

SEQ ID NO: 155265 - protein, 9 aa, Homo Sapiens
RIDEARQEL

SEQ ID NO: 155266 - protein, 9 aa, Homo Sapiens
RIDEINKEL

SEQ ID NO: 155267 - protein, 9 aa, Homo Sapiens
RIDQVNQLL

SEQ ID NO: 155268 - protein, 9 aa, Homo Sapiens
RLDDAIHVL

SEQ ID NO: 155269 - protein, 9 aa, Homo Sapiens
RLDEVSREL

SEQ ID NO: 155270 - protein, 9 aa, Homo Sapiens
RLDIAGRDI

SEQ ID NO: 155271 - protein, 9 aa, Homo Sapiens
RLDQPMTEI

SEQ ID NO: 155272 - protein, 9 aa, Homo Sapiens
RLDTGPQSL

SEQ ID NO: 155273 - protein, 9 aa, Homo Sapiens
RLDWPVRTL

SEQ ID NO: 155274 - protein, 9 aa, Homo Sapiens
RNDASEVVL

SEQ ID NO: 155275 - protein, 9 aa, Homo Sapiens
RQDAVHAIL

SEQ ID NO: 155276 - protein, 9 aa, Homo Sapiens
RQDEIKNKL

SEQ ID NO: 155277 - protein, 9 aa, Homo Sapiens
RQDFSPEEL

SEQ ID NO: 155278 - protein, 9 aa, Homo Sapiens
RQDLTTLDV

SEQ ID NO: 155279 - protein, 9 aa, Homo Sapiens
RQDNKCLEL

SEQ ID NO: 155280 - protein, 9 aa, Homo Sapiens
RQDVATNLL

SEQ ID NO: 155281 - protein, 9 aa, Homo Sapiens
RQDVDNASL

SEQ ID NO: 155282 - protein, 9 aa, Homo Sapiens
RSDASSPTI

SEQ ID NO: 155283 - protein, 9 aa, Homo Sapiens
RSDELTRHF

SEQ ID NO: 155284 - protein, 9 aa, Homo Sapiens
RSDGEAELL

SEQ ID NO: 155285 - protein, 9 aa, Homo Sapiens
RSDKPIFTL

SEQ ID NO: 155286 - protein, 9 aa, Homo Sapiens
RSDLKAEAL

SEQ ID NO: 155287 - protein, 9 aa, Homo Sapiens
RSDLYAVEM

SEQ ID NO: 155288 - protein, 9 aa, Homo Sapiens
RSDQASISL

SEQ ID NO: 155289 - protein, 9 aa, Homo Sapiens
RSDSYISQL

SEQ ID NO: 155290 - protein, 9 aa, Homo Sapiens
RSDTAQVEL

SEQ ID NO: 155291 - protein, 9 aa, Homo Sapiens
RSDTSSPEV

SEQ ID NO: 155292 - protein, 9 aa, Homo Sapiens
RTDAGVHAL

SEQ ID NO: 155293 - protein, 9 aa, Homo Sapiens
RTDDNCIVL

SEQ ID NO: 155294 - protein, 9 aa, Homo Sapiens
RTDDTPVVL

SEQ ID NO: 155295 - protein, 9 aa, Homo Sapiens
RTDEIGVAF

SEQ ID NO: 155296 - protein, 9 aa, Homo Sapiens
RTDMENLVL

SEQ ID NO: 155297 - protein, 9 aa, Homo Sapiens
RTDNTCVNL

SEQ ID NO: 155298 - protein, 9 aa, Homo Sapiens
RTDPVPVTI

SEQ ID NO: 155299 - protein, 9 aa, Homo Sapiens
RTDRPNFEL

SEQ ID NO: 155300 - protein, 9 aa, Homo Sapiens
RTDVPGELL

SEQ ID NO: 155301 - protein, 9 aa, Homo Sapiens
RVDDIFSDL

SEQ ID NO: 155302 - protein, 9 aa, Homo Sapiens
RVDDPQDVF

SEQ ID NO: 155303 - protein, 9 aa, Homo Sapiens
RVDDVYSVL

SEQ ID NO: 155304 - protein, 9 aa, Homo Sapiens
RVDEEPTTL

SEQ ID NO: 155305 - protein, 9 aa, Homo Sapiens
RVDELTTDL

SEQ ID NO: 155306 - protein, 9 aa, Homo Sapiens
RVDKITEYL

SEQ ID NO: 155307 - protein, 9 aa, Homo Sapiens
RVDKNAPTV

SEQ ID NO: 155308 - protein, 9 aa, Homo Sapiens
RVDLPLAVL

SEQ ID NO: 155309 - protein, 9 aa, Homo Sapiens
RVDNFVIAL

SEQ ID NO: 155310 - protein, 9 aa, Homo Sapiens
SAAFPGASL

SEQ ID NO: 155311 - protein, 9 aa, Homo Sapiens
SAAGPGFSL

SEQ ID NO: 155312 - protein, 9 aa, Homo Sapiens
SAAMPGASL

SEQ ID NO: 155313 - protein, 9 aa, Homo Sapiens
SAAPEGVPL

SEQ ID NO: 155314 - protein, 9 aa, Homo Sapiens
SAAPPEPAV

SEQ ID NO: 155315 - protein, 9 aa, Homo Sapiens
SAAPPGLEA

SEQ ID NO: 155316 - protein, 9 aa, Homo Sapiens
SADACHAEL

SEQ ID NO: 155317 - protein, 9 aa, Homo Sapiens
SADAPMFVM

SEQ ID NO: 155318 - protein, 9 aa, Homo Sapiens
SADARSFEM

SEQ ID NO: 155319 - protein, 9 aa, Homo Sapiens
SADASQRSL

SEQ ID NO: 155320 - protein, 9 aa, Homo Sapiens
SADASVNTL

SEQ ID NO: 155321 - protein, 9 aa, Homo Sapiens
SADCRENVI

SEQ ID NO: 155322 - protein, 9 aa, Homo Sapiens
SADDAEVVL

SEQ ID NO: 155323 - protein, 9 aa, Homo Sapiens
SADDFAMEM

SEQ ID NO: 155324 - protein, 9 aa, Homo Sapiens
SADDFLPTL

SEQ ID NO: 155325 - protein, 9 aa, Homo Sapiens
SADDGIRNL

SEQ ID NO: 155326 - protein, 9 aa, Homo Sapiens
SADDIGTLI

SEQ ID NO: 155327 - protein, 9 aa, Homo Sapiens
SADDKTVRL

SEQ ID NO: 155328 - protein, 9 aa, Homo Sapiens
SADDLLKTL

SEQ ID NO: 155329 - protein, 9 aa, Homo Sapiens
SADDWSEHI

SEQ ID NO: 155330 - protein, 9 aa, Homo Sapiens
SADEAHGLL

SEQ ID NO: 155331 - protein, 9 aa, Homo Sapiens
SADEGQTVF

SEQ ID NO: 155332 - protein, 9 aa, Homo Sapiens
SADELQKML

SEQ ID NO: 155333 - protein, 9 aa, Homo Sapiens
SADELVTRI

SEQ ID NO: 155334 - protein, 9 aa, Homo Sapiens
SADEPMTTF

SEQ ID NO: 155335 - protein, 9 aa, Homo Sapiens
SADERILVI

SEQ ID NO: 155336 - protein, 9 aa, Homo Sapiens
SADERQRML

SEQ ID NO: 155337 - protein, 9 aa, Homo Sapiens
SADESGQIF

SEQ ID NO: 155338 - protein, 9 aa, Homo Sapiens
SADEVMRFF

SEQ ID NO: 155339 - protein, 9 aa, Homo Sapiens
SADEVQRFF

SEQ ID NO: 155340 - protein, 9 aa, Homo Sapiens
SADFAELEV

SEQ ID NO: 155341 - protein, 9 aa, Homo Sapiens
SADFETVRM

SEQ ID NO: 155342 - protein, 9 aa, Homo Sapiens
SADFPALVV

SEQ ID NO: 155343 - protein, 9 aa, Homo Sapiens
SADFPRVGM

SEQ ID NO: 155344 - protein, 9 aa, Homo Sapiens
SADFSPAFL

SEQ ID NO: 155345 - protein, 9 aa, Homo Sapiens
SADFTSENF

SEQ ID NO: 155346 - protein, 9 aa, Homo Sapiens
SADFVVEAI

SEQ ID NO: 155347 - protein, 9 aa, Homo Sapiens
SADFVVESI

SEQ ID NO: 155348 - protein, 9 aa, Homo Sapiens
SADGMRLAL

SEQ ID NO: 155349 - protein, 9 aa, Homo Sapiens
SADHLAHEV

SEQ ID NO: 155350 - protein, 9 aa, Homo Sapiens
SADIARAEV

SEQ ID NO: 155351 - protein, 9 aa, Homo Sapiens
SADIIHRDL

SEQ ID NO: 155352 - protein, 9 aa, Homo Sapiens
SADISGLNL

SEQ ID NO: 155353 - protein, 9 aa, Homo Sapiens
SADISLERL

SEQ ID NO: 155354 - protein, 9 aa, Homo Sapiens
SADITFATL

SEQ ID NO: 155355 - protein, 9 aa, Homo Sapiens
SADKEIMSL

SEQ ID NO: 155356 - protein, 9 aa, Homo Sapiens
SADKFQVLL

SEQ ID NO: 155357 - protein, 9 aa, Homo Sapiens
SADKGSLEV

SEQ ID NO: 155358 - protein, 9 aa, Homo Sapiens
SADKPDSVL

SEQ ID NO: 155359 - protein, 9 aa, Homo Sapiens
SADKPLSNM

SEQ ID NO: 155360 - protein, 9 aa, Homo Sapiens
SADLEVLDL

SEQ ID NO: 155361 - protein, 9 aa, Homo Sapiens
SADLIIQEF

SEQ ID NO: 155362 - protein, 9 aa, Homo Sapiens
SADLIKEKL

SEQ ID NO: 155363 - protein, 9 aa, Homo Sapiens
SADLKELSL

SEQ ID NO: 155364 - protein, 9 aa, Homo Sapiens
SADLPESTL

SEQ ID NO: 155365 - protein, 9 aa, Homo Sapiens
SADLRADAM

SEQ ID NO: 155366 - protein, 9 aa, Homo Sapiens
SADLYYTSF

SEQ ID NO: 155367 - protein, 9 aa, Homo Sapiens
SADMSHVAL

SEQ ID NO: 155368 - protein, 9 aa, Homo Sapiens
SADNVRQQL

SEQ ID NO: 155369 - protein, 9 aa, Homo Sapiens
SADPEVMLL

SEQ ID NO: 155370 - protein, 9 aa, Homo Sapiens
SADPGILVL

SEQ ID NO: 155371 - protein, 9 aa, Homo Sapiens
SADPGVFVL

SEQ ID NO: 155372 - protein, 9 aa, Homo Sapiens
SADPLNSAF

SEQ ID NO: 155373 - protein, 9 aa, Homo Sapiens
SADPNVVDL

SEQ ID NO: 155374 - protein, 9 aa, Homo Sapiens
SADPRHILL

SEQ ID NO: 155375 - protein, 9 aa, Homo Sapiens
SADPRPLAV

SEQ ID NO: 155376 - protein, 9 aa, Homo Sapiens
SADQAVAEL

SEQ ID NO: 155377 - protein, 9 aa, Homo Sapiens
SADQKTTLL

SEQ ID NO: 155378 - protein, 9 aa, Homo Sapiens
SADQSPSAL

SEQ ID NO: 155379 - protein, 9 aa, Homo Sapiens
SADQVTRAL

SEQ ID NO: 155380 - protein, 9 aa, Homo Sapiens
SADRFVTLL

SEQ ID NO: 155381 - protein, 9 aa, Homo Sapiens
SADSANDGF

SEQ ID NO: 155382 - protein, 9 aa, Homo Sapiens
SADSIGAVL

SEQ ID NO: 155383 - protein, 9 aa, Homo Sapiens
SADSKPIDV

SEQ ID NO: 155384 - protein, 9 aa, Homo Sapiens
SADSLEHVL

SEQ ID NO: 155385 - protein, 9 aa, Homo Sapiens
SADSPSPGL

SEQ ID NO: 155386 - protein, 9 aa, Homo Sapiens
SADSRIAEL

SEQ ID NO: 155387 - protein, 9 aa, Homo Sapiens
SADSRIVKM

SEQ ID NO: 155388 - protein, 9 aa, Homo Sapiens
SADTFTRNL

SEQ ID NO: 155389 - protein, 9 aa, Homo Sapiens
SADTPCATV

SEQ ID NO: 155390 - protein, 9 aa, Homo Sapiens
SADTPEASL

SEQ ID NO: 155391 - protein, 9 aa, Homo Sapiens
SADTTILFV

SEQ ID NO: 155392 - protein, 9 aa, Homo Sapiens
SADTVVIFD

SEQ ID NO: 155393 - protein, 9 aa, Homo Sapiens
SADVAAVVM

SEQ ID NO: 155394 - protein, 9 aa, Homo Sapiens
SADVATPKM

SEQ ID NO: 155395 - protein, 9 aa, Homo Sapiens
SADVDIHHL

SEQ ID NO: 155396 - protein, 9 aa, Homo Sapiens
SADVDIKEL

SEQ ID NO: 155397 - protein, 9 aa, Homo Sapiens
SADVKEVLL

SEQ ID NO: 155398 - protein, 9 aa, Homo Sapiens
SADVRCSVF

SEQ ID NO: 155399 - protein, 9 aa, Homo Sapiens
SADVSGLAV

SEQ ID NO: 155400 - protein, 9 aa, Homo Sapiens
SADWSLEAL

SEQ ID NO: 155401 - protein, 9 aa, Homo Sapiens
SADYSTPPH

SEQ ID NO: 155402 - protein, 9 aa, Homo Sapiens
SAEAEASRL

SEQ ID NO: 155403 - protein, 9 aa, Homo Sapiens
SAEAPSHHL

SEQ ID NO: 155404 - protein, 9 aa, Homo Sapiens
SAEAVTTTL

SEQ ID NO: 155405 - protein, 9 aa, Homo Sapiens
SAEEMVTLL

SEQ ID NO: 155406 - protein, 9 aa, Homo Sapiens
SAEEVAKEL

SEQ ID NO: 155407 - protein, 9 aa, Homo Sapiens
SAEHSHPAL

SEQ ID NO: 155408 - protein, 9 aa, Homo Sapiens
SAELASMEL

SEQ ID NO: 155409 - protein, 9 aa, Homo Sapiens
SAEPAGTPL

SEQ ID NO: 155410 - protein, 9 aa, Homo Sapiens
SAEQAKVVL

SEQ ID NO: 155411 - protein, 9 aa, Homo Sapiens
SAETPTIPL

SEQ ID NO: 155412 - protein, 9 aa, Homo Sapiens
SASPPGPTL

SEQ ID NO: 155413 - protein, 9 aa, Homo Sapiens
SATDPVTVL

SEQ ID NO: 155414 - protein, 9 aa, Homo Sapiens
SDSSSAPAF

SEQ ID NO: 155415 - protein, 9 aa, Homo Sapiens
SFDAVLEAL

SEQ ID NO: 155416 - protein, 9 aa, Homo Sapiens
SGDDNLTSL

SEQ ID NO: 155417 - protein, 9 aa, Homo Sapiens
SGDGGRAEL

SEQ ID NO: 155418 - protein, 9 aa, Homo Sapiens
SGDGVTHTV

SEQ ID NO: 155419 - protein, 9 aa, Homo Sapiens
SGDGVTHVI

SEQ ID NO: 155420 - protein, 9 aa, Homo Sapiens
SGDKVGSSL

SEQ ID NO: 155421 - protein, 9 aa, Homo Sapiens
SGDPSIQTL

SEQ ID NO: 155422 - protein, 9 aa, Homo Sapiens
SGDVDSLEL

SEQ ID NO: 155423 - protein, 9 aa, Homo Sapiens
SGLDLNTSL

SEQ ID NO: 155424 - protein, 9 aa, Homo Sapiens
SIDAEVREL

SEQ ID NO: 155425 - protein, 9 aa, Homo Sapiens
SIDAGSKEL

SEQ ID NO: 155426 - protein, 9 aa, Homo Sapiens
SIDDLPTVL

SEQ ID NO: 155427 - protein, 9 aa, Homo Sapiens
SIDDQLNTL

SEQ ID NO: 155428 - protein, 9 aa, Homo Sapiens
SIDDVDSKL

SEQ ID NO: 155429 - protein, 9 aa, Homo Sapiens
SIDFDQGEL

SEQ ID NO: 155430 - protein, 9 aa, Homo Sapiens
SIDFPLTKV

SEQ ID NO: 155431 - protein, 9 aa, Homo Sapiens
SIDICHQVL

SEQ ID NO: 155432 - protein, 9 aa, Homo Sapiens
SIDKAVTKL

SEQ ID NO: 155433 - protein, 9 aa, Homo Sapiens
SIDKTGENF

SEQ ID NO: 155434 - protein, 9 aa, Homo Sapiens
SIDQTGELL

SEQ ID NO: 155435 - protein, 9 aa, Homo Sapiens
SIDRNPPQL

SEQ ID NO: 155436 - protein, 9 aa, Homo Sapiens
SIDSAGIQL

SEQ ID NO: 155437 - protein, 9 aa, Homo Sapiens
SIDTHGETF

SEQ ID NO: 155438 - protein, 9 aa, Homo Sapiens
SIEDKVKAL

SEQ ID NO: 155439 - protein, 9 aa, Homo Sapiens
SIELPSMAV

SEQ ID NO: 155440 - protein, 9 aa, Homo Sapiens
SLDAVNLAL

SEQ ID NO: 155441 - protein, 9 aa, Homo Sapiens
SLDDSCSQL

SEQ ID NO: 155442 - protein, 9 aa, Homo Sapiens
SLDIPATYL

SEQ ID NO: 155443 - protein, 9 aa, Homo Sapiens
SLDKDIVAL

SEQ ID NO: 155444 - protein, 9 aa, Homo Sapiens
SLDLPHSEL

SEQ ID NO: 155445 - protein, 9 aa, Homo Sapiens
SLDNGGCAL

SEQ ID NO: 155446 - protein, 9 aa, Homo Sapiens
SLDQPGGTL

SEQ ID NO: 155447 - protein, 9 aa, Homo Sapiens
SLDQPTQTV

SEQ ID NO: 155448 - protein, 9 aa, Homo Sapiens
SLDQPVTAL

SEQ ID NO: 155449 - protein, 9 aa, Homo Sapiens
SLDRPFTNL

SEQ ID NO: 155450 - protein, 9 aa, Homo Sapiens
SLDSPSYVL

SEQ ID NO: 155451 - protein, 9 aa, Homo Sapiens
SLDSSGFSL

SEQ ID NO: 155452 - protein, 9 aa, Homo Sapiens
SLEPVAVEL

SEQ ID NO: 155453 - protein, 9 aa, Homo Sapiens
SMDDHKLSL

SEQ ID NO: 155454 - protein, 9 aa, Homo Sapiens
SMDEINKQL

SEQ ID NO: 155455 - protein, 9 aa, Homo Sapiens
SMDSSHVSL

SEQ ID NO: 155456 - protein, 9 aa, Homo Sapiens
SNDDAVRVL

SEQ ID NO: 155457 - protein, 9 aa, Homo Sapiens
SNDIVNAIM

SEQ ID NO: 155458 - protein, 9 aa, Homo Sapiens
SPSDPSSSL

SEQ ID NO: 155459 - protein, 9 aa, Homo Sapiens
SQDARFYAL

SEQ ID NO: 155460 - protein, 9 aa, Homo Sapiens
SQDDPLHPL

SEQ ID NO: 155461 - protein, 9 aa, Homo Sapiens
SQDFVESVL

SEQ ID NO: 155462 - protein, 9 aa, Homo Sapiens
SQDGPLSVL

SEQ ID NO: 155463 - protein, 9 aa, Homo Sapiens
SQDIVNQVL

SEQ ID NO: 155464 - protein, 9 aa, Homo Sapiens
SQDLAFLSM

SEQ ID NO: 155465 - protein, 9 aa, Homo Sapiens
SQDLGQHGL

SEQ ID NO: 155466 - protein, 9 aa, Homo Sapiens
SQDLKLSTI

SEQ ID NO: 155467 - protein, 9 aa, Homo Sapiens
SQDLLPLSL

SEQ ID NO: 155468 - protein, 9 aa, Homo Sapiens
SQDLTHLNL

SEQ ID NO: 155469 - protein, 9 aa, Homo Sapiens
SQDLVQVEV

SEQ ID NO: 155470 - protein, 9 aa, Homo Sapiens
SQDPGAVVL

SEQ ID NO: 155471 - protein, 9 aa, Homo Sapiens
SQDPGTHVV

SEQ ID NO: 155472 - protein, 9 aa, Homo Sapiens
SQDPNRVEL

SEQ ID NO: 155473 - protein, 9 aa, Homo Sapiens
SQDVNKQGL

SEQ ID NO: 155474 - protein, 9 aa, Homo Sapiens
SQDVTTVTL

SEQ ID NO: 155475 - protein, 9 aa, Homo Sapiens
SQDYPTLAF

SEQ ID NO: 155476 - protein, 9 aa, Homo Sapiens
SQDYVANEL

SEQ ID NO: 155477 - protein, 9 aa, Homo Sapiens
SSADINSSL

SEQ ID NO: 155478 - protein, 9 aa, Homo Sapiens
SSDAPGNVL

SEQ ID NO: 155479 - protein, 9 aa, Homo Sapiens
SSDDINKFL

SEQ ID NO: 155480 - protein, 9 aa, Homo Sapiens
SSDDYGKDL

SEQ ID NO: 155481 - protein, 9 aa, Homo Sapiens
SSDECVVAL

SEQ ID NO: 155482 - protein, 9 aa, Homo Sapiens
SSDEDILCL

SEQ ID NO: 155483 - protein, 9 aa, Homo Sapiens
SSDGHEFIV

SEQ ID NO: 155484 - protein, 9 aa, Homo Sapiens
SSDIQVKEL

SEQ ID NO: 155485 - protein, 9 aa, Homo Sapiens
SSDKPGLDL

SEQ ID NO: 155486 - protein, 9 aa, Homo Sapiens
SSDLFLISM

SEQ ID NO: 155487 - protein, 9 aa, Homo Sapiens
SSDLGLQAL

SEQ ID NO: 155488 - protein, 9 aa, Homo Sapiens
SSDLHLVTL

SEQ ID NO: 155489 - protein, 9 aa, Homo Sapiens
SSDLPGGEF

SEQ ID NO: 155490 - protein, 9 aa, Homo Sapiens
SSDLPVALL

SEQ ID NO: 155491 - protein, 9 aa, Homo Sapiens
SSDMSSREL

SEQ ID NO: 155492 - protein, 9 aa, Homo Sapiens
SSDNPNVLV

SEQ ID NO: 155493 - protein, 9 aa, Homo Sapiens
SSDNPQPEM

SEQ ID NO: 155494 - protein, 9 aa, Homo Sapiens
SSDPEVLTL

SEQ ID NO: 155495 - protein, 9 aa, Homo Sapiens
SSDPKVLTL

SEQ ID NO: 155496 - protein, 9 aa, Homo Sapiens
SSDPMLSEF

SEQ ID NO: 155497 - protein, 9 aa, Homo Sapiens
SSDPSLIGL

SEQ ID NO: 155498 - protein, 9 aa, Homo Sapiens
SSDRAIQSL

SEQ ID NO: 155499 - protein, 9 aa, Homo Sapiens
SSDSPTNHF

SEQ ID NO: 155500 - protein, 9 aa, Homo Sapiens
SSDSQILDL

SEQ ID NO: 155501 - protein, 9 aa, Homo Sapiens
SSDTSGLSF

SEQ ID NO: 155502 - protein, 9 aa, Homo Sapiens
SSDVQKNAL

SEQ ID NO: 155503 - protein, 9 aa, Homo Sapiens
SSDVRNSAL

SEQ ID NO: 155504 - protein, 9 aa, Homo Sapiens
SSDVTKASL

SEQ ID NO: 155505 - protein, 9 aa, Homo Sapiens
SSDVVVQVL

SEQ ID NO: 155506 - protein, 9 aa, Homo Sapiens
SSDVVYNAF

SEQ ID NO: 155507 - protein, 9 aa, Homo Sapiens
SSDWVTTDI

SEQ ID NO: 155508 - protein, 9 aa, Homo Sapiens
SSNLELHSL

SEQ ID NO: 155509 - protein, 9 aa, Homo Sapiens
SSPAPRTAL

SEQ ID NO: 155510 - protein, 9 aa, Homo Sapiens
STDEEVTSL

SEQ ID NO: 155511 - protein, 9 aa, Homo Sapiens
STDFPQMQL

SEQ ID NO: 155512 - protein, 9 aa, Homo Sapiens
STDFPSTSI

SEQ ID NO: 155513 - protein, 9 aa, Homo Sapiens
STDGAPAQL

SEQ ID NO: 155514 - protein, 9 aa, Homo Sapiens
STDGIGFAI

SEQ ID NO: 155515 - protein, 9 aa, Homo Sapiens
STDSFNNEL

SEQ ID NO: 155516 - protein, 9 aa, Homo Sapiens
STDTVEHSL

SEQ ID NO: 155517 - protein, 9 aa, Homo Sapiens
STDVCGTKL

SEQ ID NO: 155518 - protein, 9 aa, Homo Sapiens
STDYETHEF

SEQ ID NO: 155519 - protein, 9 aa, Homo Sapiens
SVDAHTAEV

SEQ ID NO: 155520 - protein, 9 aa, Homo Sapiens
SVDDAAIVI

SEQ ID NO: 155521 - protein, 9 aa, Homo Sapiens
SVDDFSSAL

SEQ ID NO: 155522 - protein, 9 aa, Homo Sapiens
SVDDTIVAL

SEQ ID NO: 155523 - protein, 9 aa, Homo Sapiens
SVDDYQHRL

SEQ ID NO: 155524 - protein, 9 aa, Homo Sapiens
SVDETTQAM

SEQ ID NO: 155525 - protein, 9 aa, Homo Sapiens
SVDEVARQL

SEQ ID NO: 155526 - protein, 9 aa, Homo Sapiens
SVDEVEISV

SEQ ID NO: 155527 - protein, 9 aa, Homo Sapiens
SVDGDTRMV

SEQ ID NO: 155528 - protein, 9 aa, Homo Sapiens
SVDGSPLLL

SEQ ID NO: 155529 - protein, 9 aa, Homo Sapiens
SVDIGSLAI

SEQ ID NO: 155530 - protein, 9 aa, Homo Sapiens
SVDISGLQL

SEQ ID NO: 155531 - protein, 9 aa, Homo Sapiens
SVDKPGIVV

SEQ ID NO: 155532 - protein, 9 aa, Homo Sapiens
SVDLRGAAL

SEQ ID NO: 155533 - protein, 9 aa, Homo Sapiens
SVDPAGVTM

SEQ ID NO: 155534 - protein, 9 aa, Homo Sapiens
SVDSELTSL

SEQ ID NO: 155535 - protein, 9 aa, Homo Sapiens
SVDSHFCHL

SEQ ID NO: 155536 - protein, 9 aa, Homo Sapiens
SVDSHFSHL

SEQ ID NO: 155537 - protein, 9 aa, Homo Sapiens
SVDSKPPVI

SEQ ID NO: 155538 - protein, 9 aa, Homo Sapiens
SVDTRCSSL

SEQ ID NO: 155539 - protein, 9 aa, Homo Sapiens
SVDVTNTTF

SEQ ID NO: 155540 - protein, 9 aa, Homo Sapiens
SVDWPESFV

SEQ ID NO: 155541 - protein, 9 aa, Homo Sapiens
SVDWPESSL

SEQ ID NO: 155542 - protein, 9 aa, Homo Sapiens
SWDEAVQAL

SEQ ID NO: 155543 - protein, 9 aa, Homo Sapiens
TAASPTIAL

SEQ ID NO: 155544 - protein, 9 aa, Homo Sapiens
TAAVWAVKI

SEQ ID NO: 155545 - protein, 9 aa, Homo Sapiens
TADAMNREV

SEQ ID NO: 155546 - protein, 9 aa, Homo Sapiens
TADCPGHGL

SEQ ID NO: 155547 - protein, 9 aa, Homo Sapiens
TADDFLVFL

SEQ ID NO: 155548 - protein, 9 aa, Homo Sapiens
TADDPSLSL

SEQ ID NO: 155549 - protein, 9 aa, Homo Sapiens
TADEIQNTL

SEQ ID NO: 155550 - protein, 9 aa, Homo Sapiens
TADEVHYFL

SEQ ID NO: 155551 - protein, 9 aa, Homo Sapiens
TADFPPSKL

SEQ ID NO: 155552 - protein, 9 aa, Homo Sapiens
TADFVNYYF

SEQ ID NO: 155553 - protein, 9 aa, Homo Sapiens
TADGAHFEL

SEQ ID NO: 155554 - protein, 9 aa, Homo Sapiens
TADGDLYTL

SEQ ID NO: 155555 - protein, 9 aa, Homo Sapiens
TADGICSMM

SEQ ID NO: 155556 - protein, 9 aa, Homo Sapiens
TADGIVSHL

SEQ ID NO: 155557 - protein, 9 aa, Homo Sapiens
TADGRVVKL

SEQ ID NO: 155558 - protein, 9 aa, Homo Sapiens
TADGVAVIP

SEQ ID NO: 155559 - protein, 9 aa, Homo Sapiens
TADIAIVAL

SEQ ID NO: 155560 - protein, 9 aa, Homo Sapiens
TADIPALFL

SEQ ID NO: 155561 - protein, 9 aa, Homo Sapiens
TADISDVWL

SEQ ID NO: 155562 - protein, 9 aa, Homo Sapiens
TADIVINLL

SEQ ID NO: 155563 - protein, 9 aa, Homo Sapiens
TADKLQEFL

SEQ ID NO: 155564 - protein, 9 aa, Homo Sapiens
TADLDITEI

SEQ ID NO: 155565 - protein, 9 aa, Homo Sapiens
TADLFLTTL

SEQ ID NO: 155566 - protein, 9 aa, Homo Sapiens
TADLPKQSI

SEQ ID NO: 155567 - protein, 9 aa, Homo Sapiens
TADLPNELI

SEQ ID NO: 155568 - protein, 9 aa, Homo Sapiens
TADNISHGL

SEQ ID NO: 155569 - protein, 9 aa, Homo Sapiens
TADNLVLNL

SEQ ID NO: 155570 - protein, 9 aa, Homo Sapiens
TADRIPIAV

SEQ ID NO: 155571 - protein, 9 aa, Homo Sapiens
TADSQPPVF

SEQ ID NO: 155572 - protein, 9 aa, Homo Sapiens
TADTILNTL

SEQ ID NO: 155573 - protein, 9 aa, Homo Sapiens
TADTSKVSL

SEQ ID NO: 155574 - protein, 9 aa, Homo Sapiens
TADVIVNSV

SEQ ID NO: 155575 - protein, 9 aa, Homo Sapiens
TADVKASVL

SEQ ID NO: 155576 - protein, 9 aa, Homo Sapiens
TADVSHTNL

SEQ ID NO: 155577 - protein, 9 aa, Homo Sapiens
TADVTSAVM

SEQ ID NO: 155578 - protein, 9 aa, Homo Sapiens
TAEAIQTPL

SEQ ID NO: 155579 - protein, 9 aa, Homo Sapiens
TAEERVAEL

SEQ ID NO: 155580 - protein, 9 aa, Homo Sapiens
TAEHPGTRL

SEQ ID NO: 155581 - protein, 9 aa, Homo Sapiens
TAESRVSVL

SEQ ID NO: 155582 - protein, 9 aa, Homo Sapiens
TAETPSRPL

SEQ ID NO: 155583 - protein, 9 aa, Homo Sapiens
TAIDDRCEL

SEQ ID NO: 155584 - protein, 9 aa, Homo Sapiens
TASEPSAQL

SEQ ID NO: 155585 - protein, 9 aa, Homo Sapiens
TGDTPGLEV

SEQ ID NO: 155586 - protein, 9 aa, Homo Sapiens
TGDVMSLSL

SEQ ID NO: 155587 - protein, 9 aa, Homo Sapiens
TGDVPHTSV

SEQ ID NO: 155588 - protein, 9 aa, Homo Sapiens
TGTVEFKEF

SEQ ID NO: 155589 - protein, 9 aa, Homo Sapiens
TIDADAPEL

SEQ ID NO: 155590 - protein, 9 aa, Homo Sapiens
TIDADQRVL

SEQ ID NO: 155591 - protein, 9 aa, Homo Sapiens
TIDATGNSV

SEQ ID NO: 155592 - protein, 9 aa, Homo Sapiens
TIDDGIFEV

SEQ ID NO: 155593 - protein, 9 aa, Homo Sapiens
TIDESGSIL

SEQ ID NO: 155594 - protein, 9 aa, Homo Sapiens
TIDESLSEL

SEQ ID NO: 155595 - protein, 9 aa, Homo Sapiens
TIDPNTRTL

SEQ ID NO: 155596 - protein, 9 aa, Homo Sapiens
TIDQGMAAL

SEQ ID NO: 155597 - protein, 9 aa, Homo Sapiens
TIDSSGPSL

SEQ ID NO: 155598 - protein, 9 aa, Homo Sapiens
TIDTENSTV

SEQ ID NO: 155599 - protein, 9 aa, Homo Sapiens
TIDTSRVSL

SEQ ID NO: 155600 - protein, 9 aa, Homo Sapiens
TIEDAIAVL

SEQ ID NO: 155601 - protein, 9 aa, Homo Sapiens
TKDYGNSPL

SEQ ID NO: 155602 - protein, 9 aa, Homo Sapiens
TLDFENEKL

SEQ ID NO: 155603 - protein, 9 aa, Homo Sapiens
TLDLPTAPL

SEQ ID NO: 155604 - protein, 9 aa, Homo Sapiens
TLDLQNNDL

SEQ ID NO: 155605 - protein, 9 aa, Homo Sapiens
TLDLSHNSI

SEQ ID NO: 155606 - protein, 9 aa, Homo Sapiens
TLDQENQQL

SEQ ID NO: 155607 - protein, 9 aa, Homo Sapiens
TLDQTLNEL

SEQ ID NO: 155608 - protein, 9 aa, Homo Sapiens
TLQHIVTLL

SEQ ID NO: 155609 - protein, 9 aa, Homo Sapiens
TMDDLTTAL

SEQ ID NO: 155610 - protein, 9 aa, Homo Sapiens
TMDGANVEM

SEQ ID NO: 155611 - protein, 9 aa, Homo Sapiens
TMDIGRTVL

SEQ ID NO: 155612 - protein, 9 aa, Homo Sapiens
TQDAVPLTL

SEQ ID NO: 155613 - protein, 9 aa, Homo Sapiens
TQDELDQTL

SEQ ID NO: 155614 - protein, 9 aa, Homo Sapiens
TQDELKEVF

SEQ ID NO: 155615 - protein, 9 aa, Homo Sapiens
TQDEVSQTL

SEQ ID NO: 155616 - protein, 9 aa, Homo Sapiens
TQDLPGVKL

SEQ ID NO: 155617 - protein, 9 aa, Homo Sapiens
TQDLQAKEL

SEQ ID NO: 155618 - protein, 9 aa, Homo Sapiens
TQDLTVSQL

SEQ ID NO: 155619 - protein, 9 aa, Homo Sapiens
TQDSSILPL

SEQ ID NO: 155620 - protein, 9 aa, Homo Sapiens
TSDDVAKEF

SEQ ID NO: 155621 - protein, 9 aa, Homo Sapiens
TSDEQNHLV

SEQ ID NO: 155622 - protein, 9 aa, Homo Sapiens
TSDGSPSPL

SEQ ID NO: 155623 - protein, 9 aa, Homo Sapiens
TSDIILVGL

SEQ ID NO: 155624 - protein, 9 aa, Homo Sapiens
TSDIYFVSL

SEQ ID NO: 155625 - protein, 9 aa, Homo Sapiens
TSDKGFVTM

SEQ ID NO: 155626 - protein, 9 aa, Homo Sapiens
TSDKPHSAL

SEQ ID NO: 155627 - protein, 9 aa, Homo Sapiens
TSDLGKTEL

SEQ ID NO: 155628 - protein, 9 aa, Homo Sapiens
TSDLIVLGL

SEQ ID NO: 155629 - protein, 9 aa, Homo Sapiens
TSDLPSFEV

SEQ ID NO: 155630 - protein, 9 aa, Homo Sapiens
TSDMGSYAL

SEQ ID NO: 155631 - protein, 9 aa, Homo Sapiens
TSDNPVVQL

SEQ ID NO: 155632 - protein, 9 aa, Homo Sapiens
TSDPAAHAL

SEQ ID NO: 155633 - protein, 9 aa, Homo Sapiens
TSDPALCTL

SEQ ID NO: 155634 - protein, 9 aa, Homo Sapiens
TSDPALLSF

SEQ ID NO: 155635 - protein, 9 aa, Homo Sapiens
TSDPALNHV

SEQ ID NO: 155636 - protein, 9 aa, Homo Sapiens
TSDPAVQAI

SEQ ID NO: 155637 - protein, 9 aa, Homo Sapiens
TSDPIGEVL

SEQ ID NO: 155638 - protein, 9 aa, Homo Sapiens
TSDVGATLL

SEQ ID NO: 155639 - protein, 9 aa, Homo Sapiens
TSDVSQATL

SEQ ID NO: 155640 - protein, 9 aa, Homo Sapiens
TSSSPGSPI

SEQ ID NO: 155641 - protein, 9 aa, Homo Sapiens
TTDDKAVVL

SEQ ID NO: 155642 - protein, 9 aa, Homo Sapiens
TTDDSICVL

SEQ ID NO: 155643 - protein, 9 aa, Homo Sapiens
TTDEPGLPF

SEQ ID NO: 155644 - protein, 9 aa, Homo Sapiens
TTDPGASSL

SEQ ID NO: 155645 - protein, 9 aa, Homo Sapiens
TTDSPTTKV

SEQ ID NO: 155646 - protein, 9 aa, Homo Sapiens
TVDAPNFIV

SEQ ID NO: 155647 - protein, 9 aa, Homo Sapiens
TVDDLVAEI

SEQ ID NO: 155648 - protein, 9 aa, Homo Sapiens
TVDDPYATF

SEQ ID NO: 155649 - protein, 9 aa, Homo Sapiens
TVDGKTANI

SEQ ID NO: 155650 - protein, 9 aa, Homo Sapiens
TVDGPRNEL

SEQ ID NO: 155651 - protein, 9 aa, Homo Sapiens
TVDGPSGKL

SEQ ID NO: 155652 - protein, 9 aa, Homo Sapiens
TVDGSPHEL

SEQ ID NO: 155653 - protein, 9 aa, Homo Sapiens
TVDTPHGIF

SEQ ID NO: 155654 - protein, 9 aa, Homo Sapiens
TWDELGEAL

SEQ ID NO: 155655 - protein, 9 aa, Homo Sapiens
TWDERFSAL

SEQ ID NO: 155656 - protein, 9 aa, Homo Sapiens
TYDLIKDAL

SEQ ID NO: 155657 - protein, 9 aa, Homo Sapiens
VAAARAVPV

SEQ ID NO: 155658 - protein, 9 aa, Homo Sapiens
VADAIRTSL

SEQ ID NO: 155659 - protein, 9 aa, Homo Sapiens
VADAVTYQL

SEQ ID NO: 155660 - protein, 9 aa, Homo Sapiens
VADAWGVEL

SEQ ID NO: 155661 - protein, 9 aa, Homo Sapiens
VADDPIVMV

SEQ ID NO: 155662 - protein, 9 aa, Homo Sapiens
VADDPNDPY

SEQ ID NO: 155663 - protein, 9 aa, Homo Sapiens
VADDQKLMI

SEQ ID NO: 155664 - protein, 9 aa, Homo Sapiens
VADDTPVLL

SEQ ID NO: 155665 - protein, 9 aa, Homo Sapiens
VADDYIHTA

SEQ ID NO: 155666 - protein, 9 aa, Homo Sapiens
VADEAGQRL

SEQ ID NO: 155667 - protein, 9 aa, Homo Sapiens
VADEDAHNI

SEQ ID NO: 155668 - protein, 9 aa, Homo Sapiens
VADEEIAAL

SEQ ID NO: 155669 - protein, 9 aa, Homo Sapiens
VADEELVHL

SEQ ID NO: 155670 - protein, 9 aa, Homo Sapiens
VADEGICYL

SEQ ID NO: 155671 - protein, 9 aa, Homo Sapiens
VADEISFRL

SEQ ID NO: 155672 - protein, 9 aa, Homo Sapiens
VADELLENL

SEQ ID NO: 155673 - protein, 9 aa, Homo Sapiens
VADELVAEF

SEQ ID NO: 155674 - protein, 9 aa, Homo Sapiens
VADELVSEF

SEQ ID NO: 155675 - protein, 9 aa, Homo Sapiens
VADEMDVML

SEQ ID NO: 155676 - protein, 9 aa, Homo Sapiens
VADENLKAF

SEQ ID NO: 155677 - protein, 9 aa, Homo Sapiens
VADEQNRAL

SEQ ID NO: 155678 - protein, 9 aa, Homo Sapiens
VADEQQRLM

SEQ ID NO: 155679 - protein, 9 aa, Homo Sapiens
VADEYIERL

SEQ ID NO: 155680 - protein, 9 aa, Homo Sapiens
VADFGLARL

SEQ ID NO: 155681 - protein, 9 aa, Homo Sapiens
VADFGLITM

SEQ ID NO: 155682 - protein, 9 aa, Homo Sapiens
VADFGLSRL

SEQ ID NO: 155683 - protein, 9 aa, Homo Sapiens
VADFGSATF

SEQ ID NO: 155684 - protein, 9 aa, Homo Sapiens
VADFLQNIL

SEQ ID NO: 155685 - protein, 9 aa, Homo Sapiens
VADFQRYIL

SEQ ID NO: 155686 - protein, 9 aa, Homo Sapiens
VADFSATYL

SEQ ID NO: 155687 - protein, 9 aa, Homo Sapiens
VADFVRDSL

SEQ ID NO: 155688 - protein, 9 aa, Homo Sapiens
VADGLITTL

SEQ ID NO: 155689 - protein, 9 aa, Homo Sapiens
VADGLPLAA

SEQ ID NO: 155690 - protein, 9 aa, Homo Sapiens
VADGLVTTL

SEQ ID NO: 155691 - protein, 9 aa, Homo Sapiens
VADGYPVRL

SEQ ID NO: 155692 - protein, 9 aa, Homo Sapiens
VADHPFLFL

SEQ ID NO: 155693 - protein, 9 aa, Homo Sapiens
VADHPGIDF

SEQ ID NO: 155694 - protein, 9 aa, Homo Sapiens
VADIAVELL

SEQ ID NO: 155695 - protein, 9 aa, Homo Sapiens
VADIDGSTF

SEQ ID NO: 155696 - protein, 9 aa, Homo Sapiens
VADIKASQI

SEQ ID NO: 155697 - protein, 9 aa, Homo Sapiens
VADILAHEI

SEQ ID NO: 155698 - protein, 9 aa, Homo Sapiens
VADKDLLDL

SEQ ID NO: 155699 - protein, 9 aa, Homo Sapiens
VADKDTVLL

SEQ ID NO: 155700 - protein, 9 aa, Homo Sapiens
VADLAESIM

SEQ ID NO: 155701 - protein, 9 aa, Homo Sapiens
VADLAFAHL

SEQ ID NO: 155702 - protein, 9 aa, Homo Sapiens
VADLGAMVV

SEQ ID NO: 155703 - protein, 9 aa, Homo Sapiens
VADLIESML

SEQ ID NO: 155704 - protein, 9 aa, Homo Sapiens
VADLIGLNL

SEQ ID NO: 155705 - protein, 9 aa, Homo Sapiens
VADLQLIDF

SEQ ID NO: 155706 - protein, 9 aa, Homo Sapiens
VADLQSINI

SEQ ID NO: 155707 - protein, 9 aa, Homo Sapiens
VADLREAIL

SEQ ID NO: 155708 - protein, 9 aa, Homo Sapiens
VADLSEQSL

SEQ ID NO: 155709 - protein, 9 aa, Homo Sapiens
VADLTGELM

SEQ ID NO: 155710 - protein, 9 aa, Homo Sapiens
VADLVVNIL

SEQ ID NO: 155711 - protein, 9 aa, Homo Sapiens
VADMAAYQL

SEQ ID NO: 155712 - protein, 9 aa, Homo Sapiens
VADMVKQFF

SEQ ID NO: 155713 - protein, 9 aa, Homo Sapiens
VADNLAIQL

SEQ ID NO: 155714 - protein, 9 aa, Homo Sapiens
VADNRIQEL

SEQ ID NO: 155715 - protein, 9 aa, Homo Sapiens
VADPETRTV

SEQ ID NO: 155716 - protein, 9 aa, Homo Sapiens
VADPGVTVA

SEQ ID NO: 155717 - protein, 9 aa, Homo Sapiens
VADPIIYVL

SEQ ID NO: 155718 - protein, 9 aa, Homo Sapiens
VADPPIARL

SEQ ID NO: 155719 - protein, 9 aa, Homo Sapiens
VADPVEAVL

SEQ ID NO: 155720 - protein, 9 aa, Homo Sapiens
VADPYVVIM

SEQ ID NO: 155721 - protein, 9 aa, Homo Sapiens
VADQIVTKL

SEQ ID NO: 155722 - protein, 9 aa, Homo Sapiens
VADRLGLEL

SEQ ID NO: 155723 - protein, 9 aa, Homo Sapiens
VADRLLVEL

SEQ ID NO: 155724 - protein, 9 aa, Homo Sapiens
VADRLMLEL

SEQ ID NO: 155725 - protein, 9 aa, Homo Sapiens
VADSHSSHF

SEQ ID NO: 155726 - protein, 9 aa, Homo Sapiens
VADSKTLLE

SEQ ID NO: 155727 - protein, 9 aa, Homo Sapiens
VADSTPAHF

SEQ ID NO: 155728 - protein, 9 aa, Homo Sapiens
VADSVEKGL

SEQ ID NO: 155729 - protein, 9 aa, Homo Sapiens
VADTDQKAL

SEQ ID NO: 155730 - protein, 9 aa, Homo Sapiens
VADTFQDYF

SEQ ID NO: 155731 - protein, 9 aa, Homo Sapiens
VADTGLQIL

SEQ ID NO: 155732 - protein, 9 aa, Homo Sapiens
VADTVARVL

SEQ ID NO: 155733 - protein, 9 aa, Homo Sapiens
VADTVYRAL

SEQ ID NO: 155734 - protein, 9 aa, Homo Sapiens
VADWVYNEL

SEQ ID NO: 155735 - protein, 9 aa, Homo Sapiens
VADYEATTF

SEQ ID NO: 155736 - protein, 9 aa, Homo Sapiens
VAEAPGGEL

SEQ ID NO: 155737 - protein, 9 aa, Homo Sapiens
VAEEAKQAL

SEQ ID NO: 155738 - protein, 9 aa, Homo Sapiens
VAEENTRVL

SEQ ID NO: 155739 - protein, 9 aa, Homo Sapiens
VAEERGAVL

SEQ ID NO: 155740 - protein, 9 aa, Homo Sapiens
VAEEVNAIL

SEQ ID NO: 155741 - protein, 9 aa, Homo Sapiens
VAEGPGAEL

SEQ ID NO: 155742 - protein, 9 aa, Homo Sapiens
VAEHHVATL

SEQ ID NO: 155743 - protein, 9 aa, Homo Sapiens
VAEISSNSL

SEQ ID NO: 155744 - protein, 9 aa, Homo Sapiens
VAEITNACF

SEQ ID NO: 155745 - protein, 9 aa, Homo Sapiens
VAEKHGLTL

SEQ ID NO: 155746 - protein, 9 aa, Homo Sapiens
VAELPTPEL

SEQ ID NO: 155747 - protein, 9 aa, Homo Sapiens
VAELSSPDL

SEQ ID NO: 155748 - protein, 9 aa, Homo Sapiens
VAEPMHGSL

SEQ ID NO: 155749 - protein, 9 aa, Homo Sapiens
VAEQPPLKL

SEQ ID NO: 155750 - protein, 9 aa, Homo Sapiens
VAEQYSEKL

SEQ ID NO: 155751 - protein, 9 aa, Homo Sapiens
VAESAVSKL

SEQ ID NO: 155752 - protein, 9 aa, Homo Sapiens
VAESGLPAL

SEQ ID NO: 155753 - protein, 9 aa, Homo Sapiens
VAETHIVLL

SEQ ID NO: 155754 - protein, 9 aa, Homo Sapiens
VASEVSTSL

SEQ ID NO: 155755 - protein, 9 aa, Homo Sapiens
VATEGSREL

SEQ ID NO: 155756 - protein, 9 aa, Homo Sapiens
VAVEPGAAV

SEQ ID NO: 155757 - protein, 9 aa, Homo Sapiens
VDEASKKEI

SEQ ID NO: 155758 - protein, 9 aa, Homo Sapiens
VFDARELEL

SEQ ID NO: 155759 - protein, 9 aa, Homo Sapiens
VFDVSHNAV

SEQ ID NO: 155760 - protein, 9 aa, Homo Sapiens
VFDYSINSV

SEQ ID NO: 155761 - protein, 9 aa, Homo Sapiens
VGDEAFREL

SEQ ID NO: 155762 - protein, 9 aa, Homo Sapiens
VGDGIGMDL

SEQ ID NO: 155763 - protein, 9 aa, Homo Sapiens
VGDIPGVRF

SEQ ID NO: 155764 - protein, 9 aa, Homo Sapiens
VGDLLEVSL

SEQ ID NO: 155765 - protein, 9 aa, Homo Sapiens
VGDPAGNEL

SEQ ID NO: 155766 - protein, 9 aa, Homo Sapiens
VGDPGQRTL

SEQ ID NO: 155767 - protein, 9 aa, Homo Sapiens
VGDPHTVTV

SEQ ID NO: 155768 - protein, 9 aa, Homo Sapiens
VGDPSTTNL

SEQ ID NO: 155769 - protein, 9 aa, Homo Sapiens
VGDTQVVVF

SEQ ID NO: 155770 - protein, 9 aa, Homo Sapiens
VGDVPILQL

SEQ ID NO: 155771 - protein, 9 aa, Homo Sapiens
VIDAVTHAL

SEQ ID NO: 155772 - protein, 9 aa, Homo Sapiens
VIDDDVEEI

SEQ ID NO: 155773 - protein, 9 aa, Homo Sapiens
VIDDLVYSI

SEQ ID NO: 155774 - protein, 9 aa, Homo Sapiens
VIDDRAARL

SEQ ID NO: 155775 - protein, 9 aa, Homo Sapiens
VIDFTGHAL

SEQ ID NO: 155776 - protein, 9 aa, Homo Sapiens
VIDGEFKEL

SEQ ID NO: 155777 - protein, 9 aa, Homo Sapiens
VIDGNVMAI

SEQ ID NO: 155778 - protein, 9 aa, Homo Sapiens
VIDGSNVAM

SEQ ID NO: 155779 - protein, 9 aa, Homo Sapiens
VIDHHNYDI

SEQ ID NO: 155780 - protein, 9 aa, Homo Sapiens
VIDLETTSL

SEQ ID NO: 155781 - protein, 9 aa, Homo Sapiens
VIDNFTSQL

SEQ ID NO: 155782 - protein, 9 aa, Homo Sapiens
VIDPVPAAV

SEQ ID NO: 155783 - protein, 9 aa, Homo Sapiens
VIDQIAETL

SEQ ID NO: 155784 - protein, 9 aa, Homo Sapiens
VIDTPVFEL

SEQ ID NO: 155785 - protein, 9 aa, Homo Sapiens
VIEEQVAAL

SEQ ID NO: 155786 - protein, 9 aa, Homo Sapiens
VISDKDLEL

SEQ ID NO: 155787 - protein, 9 aa, Homo Sapiens
VISLEGKPL

SEQ ID NO: 155788 - protein, 9 aa, Homo Sapiens
VISQQSLEL

SEQ ID NO: 155789 - protein, 9 aa, Homo Sapiens
VKDVPNSQL

SEQ ID NO: 155790 - protein, 9 aa, Homo Sapiens
VLACNFSVI

SEQ ID NO: 155791 - protein, 9 aa, Homo Sapiens
VLDDSTAKL

SEQ ID NO: 155792 - protein, 9 aa, Homo Sapiens
VLDEADEML

SEQ ID NO: 155793 - protein, 9 aa, Homo Sapiens
VLDEAGSTV

SEQ ID NO: 155794 - protein, 9 aa, Homo Sapiens
VLDEFYSSL

SEQ ID NO: 155795 - protein, 9 aa, Homo Sapiens
VLDEIGIEI

SEQ ID NO: 155796 - protein, 9 aa, Homo Sapiens
VLDELGLSL

SEQ ID NO: 155797 - protein, 9 aa, Homo Sapiens
VLDEPGQDL

SEQ ID NO: 155798 - protein, 9 aa, Homo Sapiens
VLDEVVTVL

SEQ ID NO: 155799 - protein, 9 aa, Homo Sapiens
VLDFDPMAV

SEQ ID NO: 155800 - protein, 9 aa, Homo Sapiens
VLDGSGHIL

SEQ ID NO: 155801 - protein, 9 aa, Homo Sapiens
VLDLQEVTL

SEQ ID NO: 155802 - protein, 9 aa, Homo Sapiens
VLDLQHNAL

SEQ ID NO: 155803 - protein, 9 aa, Homo Sapiens
VLDLTYNNL

SEQ ID NO: 155804 - protein, 9 aa, Homo Sapiens
VLDNPTPEM

SEQ ID NO: 155805 - protein, 9 aa, Homo Sapiens
VLDSDSGLL

SEQ ID NO: 155806 - protein, 9 aa, Homo Sapiens
VLDSEGSFL

SEQ ID NO: 155807 - protein, 9 aa, Homo Sapiens
VLDVQRYPL

SEQ ID NO: 155808 - protein, 9 aa, Homo Sapiens
VLDVVERSL

SEQ ID NO: 155809 - protein, 9 aa, Homo Sapiens
VMDEIHTVL

SEQ ID NO: 155810 - protein, 9 aa, Homo Sapiens
VMDLSIVRL

SEQ ID NO: 155811 - protein, 9 aa, Homo Sapiens
VNDQPSGNL

SEQ ID NO: 155812 - protein, 9 aa, Homo Sapiens
VQDELHSVL

SEQ ID NO: 155813 - protein, 9 aa, Homo Sapiens
VQDESHSEW

SEQ ID NO: 155814 - protein, 9 aa, Homo Sapiens
VQDGATHSL

SEQ ID NO: 155815 - protein, 9 aa, Homo Sapiens
VQDILRTEL

SEQ ID NO: 155816 - protein, 9 aa, Homo Sapiens
VQDKGNAAL

SEQ ID NO: 155817 - protein, 9 aa, Homo Sapiens
VQDLIEGHL

SEQ ID NO: 155818 - protein, 9 aa, Homo Sapiens
VQDLKCLVF

SEQ ID NO: 155819 - protein, 9 aa, Homo Sapiens
VQDLLLLDV

SEQ ID NO: 155820 - protein, 9 aa, Homo Sapiens
VQDLMETDL

SEQ ID NO: 155821 - protein, 9 aa, Homo Sapiens
VQDRPESSL

SEQ ID NO: 155822 - protein, 9 aa, Homo Sapiens
VSDCQRIEL

SEQ ID NO: 155823 - protein, 9 aa, Homo Sapiens
VSDDGTLHM

SEQ ID NO: 155824 - protein, 9 aa, Homo Sapiens
VSDDPRCRL

SEQ ID NO: 155825 - protein, 9 aa, Homo Sapiens
VSDDTVMHL

SEQ ID NO: 155826 - protein, 9 aa, Homo Sapiens
VSDEDFSAL

SEQ ID NO: 155827 - protein, 9 aa, Homo Sapiens
VSDEEMMEL

SEQ ID NO: 155828 - protein, 9 aa, Homo Sapiens
VSDEMVVEL

SEQ ID NO: 155829 - protein, 9 aa, Homo Sapiens
VSDEQVLVL

SEQ ID NO: 155830 - protein, 9 aa, Homo Sapiens
VSDESSQYL

SEQ ID NO: 155831 - protein, 9 aa, Homo Sapiens
VSDEVGFGL

SEQ ID NO: 155832 - protein, 9 aa, Homo Sapiens
VSDFETKSL

SEQ ID NO: 155833 - protein, 9 aa, Homo Sapiens
VSDFGGRSL

SEQ ID NO: 155834 - protein, 9 aa, Homo Sapiens
VSDFGQSHL

SEQ ID NO: 155835 - protein, 9 aa, Homo Sapiens
VSDGVPLVL

SEQ ID NO: 155836 - protein, 9 aa, Homo Sapiens
VSDHFPVEF

SEQ ID NO: 155837 - protein, 9 aa, Homo Sapiens
VSDIGSQEL

SEQ ID NO: 155838 - protein, 9 aa, Homo Sapiens
VSDLGPVVL

SEQ ID NO: 155839 - protein, 9 aa, Homo Sapiens
VSDLNATEI

SEQ ID NO: 155840 - protein, 9 aa, Homo Sapiens
VSDLQHVTL

SEQ ID NO: 155841 - protein, 9 aa, Homo Sapiens
VSDLSQVTV

SEQ ID NO: 155842 - protein, 9 aa, Homo Sapiens
VSDPEEMEL

SEQ ID NO: 155843 - protein, 9 aa, Homo Sapiens
VSDPGVGSI

SEQ ID NO: 155844 - protein, 9 aa, Homo Sapiens
VSDPNLIHV

SEQ ID NO: 155845 - protein, 9 aa, Homo Sapiens
VSDPVTVHF

SEQ ID NO: 155846 - protein, 9 aa, Homo Sapiens
VSDQANHVL

SEQ ID NO: 155847 - protein, 9 aa, Homo Sapiens
VSDRKNIDL

SEQ ID NO: 155848 - protein, 9 aa, Homo Sapiens
VSDSALQEL

SEQ ID NO: 155849 - protein, 9 aa, Homo Sapiens
VSDSGAHVL

SEQ ID NO: 155850 - protein, 9 aa, Homo Sapiens
VSDSGVIAL

SEQ ID NO: 155851 - protein, 9 aa, Homo Sapiens
VSDSVTPVL

SEQ ID NO: 155852 - protein, 9 aa, Homo Sapiens
VSDTPSITA

SEQ ID NO: 155853 - protein, 9 aa, Homo Sapiens
VSDVLGVAV

SEQ ID NO: 155854 - protein, 9 aa, Homo Sapiens
VSDVPSLSV

SEQ ID NO: 155855 - protein, 9 aa, Homo Sapiens
VSDVVKVDL

SEQ ID NO: 155856 - protein, 9 aa, Homo Sapiens
VSDYTPLSL

SEQ ID NO: 155857 - protein, 9 aa, Homo Sapiens
VSELITKAV

SEQ ID NO: 155858 - protein, 9 aa, Homo Sapiens
VTDAAFNFL

SEQ ID NO: 155859 - protein, 9 aa, Homo Sapiens
VTDADRSIL

SEQ ID NO: 155860 - protein, 9 aa, Homo Sapiens
VTDDPTQVH

SEQ ID NO: 155861 - protein, 9 aa, Homo Sapiens
VTDENGNRL

SEQ ID NO: 155862 - protein, 9 aa, Homo Sapiens
VTDGALVVV

SEQ ID NO: 155863 - protein, 9 aa, Homo Sapiens
VTDHATTAL

SEQ ID NO: 155864 - protein, 9 aa, Homo Sapiens
VTDHNLHEL

SEQ ID NO: 155865 - protein, 9 aa, Homo Sapiens
VTDKSGISM

SEQ ID NO: 155866 - protein, 9 aa, Homo Sapiens
VTDLGTAEL

SEQ ID NO: 155867 - protein, 9 aa, Homo Sapiens
VTDLNSLEL

SEQ ID NO: 155868 - protein, 9 aa, Homo Sapiens
VTDSGRTVI

SEQ ID NO: 155869 - protein, 9 aa, Homo Sapiens
VTDTDILAL

SEQ ID NO: 155870 - protein, 9 aa, Homo Sapiens
VTDTGALYL

SEQ ID NO: 155871 - protein, 9 aa, Homo Sapiens
VTDTGCEIL

SEQ ID NO: 155872 - protein, 9 aa, Homo Sapiens
VTDVTSNLL

SEQ ID NO: 155873 - protein, 9 aa, Homo Sapiens
VTENPGKSI

SEQ ID NO: 155874 - protein, 9 aa, Homo Sapiens
VTEPDHPVL

SEQ ID NO: 155875 - protein, 9 aa, Homo Sapiens
VVDAGKVTL

SEQ ID NO: 155876 - protein, 9 aa, Homo Sapiens
VVDAPPLDL

SEQ ID NO: 155877 - protein, 9 aa, Homo Sapiens
VVDDIVSKL

SEQ ID NO: 155878 - protein, 9 aa, Homo Sapiens
VVDEKISAM

SEQ ID NO: 155879 - protein, 9 aa, Homo Sapiens
VVDETGNVL

SEQ ID NO: 155880 - protein, 9 aa, Homo Sapiens
VVDFVAATL

SEQ ID NO: 155881 - protein, 9 aa, Homo Sapiens
VVDGAFSYL

SEQ ID NO: 155882 - protein, 9 aa, Homo Sapiens
VVDGGAIPA

SEQ ID NO: 155883 - protein, 9 aa, Homo Sapiens
VVDGTPLVA

SEQ ID NO: 155884 - protein, 9 aa, Homo Sapiens
VVDKCDEPL

SEQ ID NO: 155885 - protein, 9 aa, Homo Sapiens
VVDKCTEVL

SEQ ID NO: 155886 - protein, 9 aa, Homo Sapiens
VVDKPEQTV

SEQ ID NO: 155887 - protein, 9 aa, Homo Sapiens
VVDKPPSTM

SEQ ID NO: 155888 - protein, 9 aa, Homo Sapiens
VVDLAPLHL

SEQ ID NO: 155889 - protein, 9 aa, Homo Sapiens
VVDLDTSQL

SEQ ID NO: 155890 - protein, 9 aa, Homo Sapiens
VVDLGGLSI

SEQ ID NO: 155891 - protein, 9 aa, Homo Sapiens
VVDLLQQEL

SEQ ID NO: 155892 - protein, 9 aa, Homo Sapiens
VVDNQTEKL

SEQ ID NO: 155893 - protein, 9 aa, Homo Sapiens
VVDQGSTNL

SEQ ID NO: 155894 - protein, 9 aa, Homo Sapiens
VVDSEDIPL

SEQ ID NO: 155895 - protein, 9 aa, Homo Sapiens
VVDSEVPSL

SEQ ID NO: 155896 - protein, 9 aa, Homo Sapiens
VVDSIMTAL

SEQ ID NO: 155897 - protein, 9 aa, Homo Sapiens
VVDSSNTAL

SEQ ID NO: 155898 - protein, 9 aa, Homo Sapiens
VVDVTSLSL

SEQ ID NO: 155899 - protein, 9 aa, Homo Sapiens
VVDYPNSAK

SEQ ID NO: 155900 - protein, 9 aa, Homo Sapiens
VVEPYNATL

SEQ ID NO: 155901 - protein, 9 aa, Homo Sapiens
VVEVPSAVL

SEQ ID NO: 155902 - protein, 9 aa, Homo Sapiens
VWDIVGTEL

SEQ ID NO: 155903 - protein, 9 aa, Homo Sapiens
VWDVIGRSL

SEQ ID NO: 155904 - protein, 9 aa, Homo Sapiens
WTDFPGRVL

SEQ ID NO: 155905 - protein, 9 aa, Homo Sapiens
YADDNSLLF

SEQ ID NO: 155906 - protein, 9 aa, Homo Sapiens
YADEKGLEA

SEQ ID NO: 155907 - protein, 9 aa, Homo Sapiens
YADFAPSLL

SEQ ID NO: 155908 - protein, 9 aa, Homo Sapiens
YADFGPLNL

SEQ ID NO: 155909 - protein, 9 aa, Homo Sapiens
YADFPELDL

SEQ ID NO: 155910 - protein, 9 aa, Homo Sapiens
YADGGGCKL

SEQ ID NO: 155911 - protein, 9 aa, Homo Sapiens
YADHPFIFL

SEQ ID NO: 155912 - protein, 9 aa, Homo Sapiens
YADIEAAWL

SEQ ID NO: 155913 - protein, 9 aa, Homo Sapiens
YADIFPSKV

SEQ ID NO: 155914 - protein, 9 aa, Homo Sapiens
YADIGGMDI

SEQ ID NO: 155915 - protein, 9 aa, Homo Sapiens
YADIVQLLL

SEQ ID NO: 155916 - protein, 9 aa, Homo Sapiens
YADPVADLL

SEQ ID NO: 155917 - protein, 9 aa, Homo Sapiens
YADPVTDLL

SEQ ID NO: 155918 - protein, 9 aa, Homo Sapiens
YADQHSVQV

SEQ ID NO: 155919 - protein, 9 aa, Homo Sapiens
YADQLKEYL

SEQ ID NO: 155920 - protein, 9 aa, Homo Sapiens
YADTQEINL

SEQ ID NO: 155921 - protein, 9 aa, Homo Sapiens
YADTVTTVI

SEQ ID NO: 155922 - protein, 9 aa, Homo Sapiens
YADVGGKQF

SEQ ID NO: 155923 - protein, 9 aa, Homo Sapiens
YADVQKDGV

SEQ ID NO: 155924 - protein, 9 aa, Homo Sapiens
YADYIGFIL

SEQ ID NO: 155925 - protein, 9 aa, Homo Sapiens
YAEEFRTYL

SEQ ID NO: 155926 - protein, 9 aa, Homo Sapiens
YAEIPDETL

SEQ ID NO: 155927 - protein, 9 aa, Homo Sapiens
YAEQLHVQL

SEQ ID NO: 155928 - protein, 9 aa, Homo Sapiens
YAEQLVVEL

SEQ ID NO: 155929 - protein, 9 aa, Homo Sapiens
YAEVGRVLL

SEQ ID NO: 155930 - protein, 9 aa, Homo Sapiens
YAEYMPIKL

SEQ ID NO: 155931 - protein, 9 aa, Homo Sapiens
YCDERITEL

SEQ ID NO: 155932 - protein, 9 aa, Homo Sapiens
YFDAIPVTM

SEQ ID NO: 155933 - protein, 9 aa, Homo Sapiens
YFDDSNVSL

SEQ ID NO: 155934 - protein, 9 aa, Homo Sapiens
YFDLQTHVI

SEQ ID NO: 155935 - protein, 9 aa, Homo Sapiens
YGDEIAIEL

SEQ ID NO: 155936 - protein, 9 aa, Homo Sapiens
YGDESTLAF

SEQ ID NO: 155937 - protein, 9 aa, Homo Sapiens
YGDKIIEEL

SEQ ID NO: 155938 - protein, 9 aa, Homo Sapiens
YGDKQSNAL

SEQ ID NO: 155939 - protein, 9 aa, Homo Sapiens
YGDLGGPII

SEQ ID NO: 155940 - protein, 9 aa, Homo Sapiens
YGDPYYSYL

SEQ ID NO: 155941 - protein, 9 aa, Homo Sapiens
YIDDVFHAL

SEQ ID NO: 155942 - protein, 9 aa, Homo Sapiens
YIDEGRLVL

SEQ ID NO: 155943 - protein, 9 aa, Homo Sapiens
YIDLPPPRL

SEQ ID NO: 155944 - protein, 9 aa, Homo Sapiens
YIDQDMQVL

SEQ ID NO: 155945 - protein, 9 aa, Homo Sapiens
YIDQGIAEL

SEQ ID NO: 155946 - protein, 9 aa, Homo Sapiens
YIDRDSEYL

SEQ ID NO: 155947 - protein, 9 aa, Homo Sapiens
YIDYEFSVL

SEQ ID NO: 155948 - protein, 9 aa, Homo Sapiens
YIEDQKLVL

SEQ ID NO: 155949 - protein, 9 aa, Homo Sapiens
YLDGVGDTL

SEQ ID NO: 155950 - protein, 9 aa, Homo Sapiens
YLDGVHTVF

SEQ ID NO: 155951 - protein, 9 aa, Homo Sapiens
YLDLPSVTI

SEQ ID NO: 155952 - protein, 9 aa, Homo Sapiens
YLDLSNNRL

SEQ ID NO: 155953 - protein, 9 aa, Homo Sapiens
YLDPVQRDL

SEQ ID NO: 155954 - protein, 9 aa, Homo Sapiens
YLDWDVSEL

SEQ ID NO: 155955 - protein, 9 aa, Homo Sapiens
YLEDSPLEL

SEQ ID NO: 155956 - protein, 9 aa, Homo Sapiens
YLEEPLTQV

SEQ ID NO: 155957 - protein, 9 aa, Homo Sapiens
YLENEPLML

SEQ ID NO: 155958 - protein, 9 aa, Homo Sapiens
YMDAPKAAL

SEQ ID NO: 155959 - protein, 9 aa, Homo Sapiens
YNDDKNTYI

SEQ ID NO: 155960 - protein, 9 aa, Homo Sapiens
YNDFINKEL

SEQ ID NO: 155961 - protein, 9 aa, Homo Sapiens
YQDLLNVKM

SEQ ID NO: 155962 - protein, 9 aa, Homo Sapiens
YQDPDATSL

SEQ ID NO: 155963 - protein, 9 aa, Homo Sapiens
YQDQEQRIL

SEQ ID NO: 155964 - protein, 9 aa, Homo Sapiens
YQDTHPERL

SEQ ID NO: 155965 - protein, 9 aa, Homo Sapiens
YQDVGSLNI

SEQ ID NO: 155966 - protein, 9 aa, Homo Sapiens
YSCDHNTSL

SEQ ID NO: 155967 - protein, 9 aa, Homo Sapiens
YSDAPVSEL

SEQ ID NO: 155968 - protein, 9 aa, Homo Sapiens
YSDATTSKI

SEQ ID NO: 155969 - protein, 9 aa, Homo Sapiens
YSDDDVPSV

SEQ ID NO: 155970 - protein, 9 aa, Homo Sapiens
YSDDIPHAL

SEQ ID NO: 155971 - protein, 9 aa, Homo Sapiens
YSDDKVHAI

SEQ ID NO: 155972 - protein, 9 aa, Homo Sapiens
YSDELQSVI

SEQ ID NO: 155973 - protein, 9 aa, Homo Sapiens
YSDEVRNEL

SEQ ID NO: 155974 - protein, 9 aa, Homo Sapiens
YSDFVVHEI

SEQ ID NO: 155975 - protein, 9 aa, Homo Sapiens
YSDGKLQTV

SEQ ID NO: 155976 - protein, 9 aa, Homo Sapiens
YSDGPGEAL

SEQ ID NO: 155977 - protein, 9 aa, Homo Sapiens
YSDGRSLHL

SEQ ID NO: 155978 - protein, 9 aa, Homo Sapiens
YSDHSWVVM

SEQ ID NO: 155979 - protein, 9 aa, Homo Sapiens
YSDLADLML

SEQ ID NO: 155980 - protein, 9 aa, Homo Sapiens
YSDLRKESM

SEQ ID NO: 155981 - protein, 9 aa, Homo Sapiens
YSDMPPLTL

SEQ ID NO: 155982 - protein, 9 aa, Homo Sapiens
YSDNQPGVL

SEQ ID NO: 155983 - protein, 9 aa, Homo Sapiens
YSDPRFLNL

SEQ ID NO: 155984 - protein, 9 aa, Homo Sapiens
YSDPVTLET

SEQ ID NO: 155985 - protein, 9 aa, Homo Sapiens
YSDQPEIAL

SEQ ID NO: 155986 - protein, 9 aa, Homo Sapiens
YSDSAGSFL

SEQ ID NO: 155987 - protein, 9 aa, Homo Sapiens
YSDSFPMEL

SEQ ID NO: 155988 - protein, 9 aa, Homo Sapiens
YSDTQFPSL

SEQ ID NO: 155989 - protein, 9 aa, Homo Sapiens
YSDVEHTSV

SEQ ID NO: 155990 - protein, 9 aa, Homo Sapiens
YSDVHNCSY

SEQ ID NO: 155991 - protein, 9 aa, Homo Sapiens
YSDVILEVL

SEQ ID NO: 155992 - protein, 9 aa, Homo Sapiens
YTDDFTDRL

SEQ ID NO: 155993 - protein, 9 aa, Homo Sapiens
YTDFDGTRV

SEQ ID NO: 155994 - protein, 9 aa, Homo Sapiens
YTDHQFTEL

SEQ ID NO: 155995 - protein, 9 aa, Homo Sapiens
YTDIINIFL

SEQ ID NO: 155996 - protein, 9 aa, Homo Sapiens
YTDIVGLLL

SEQ ID NO: 155997 - protein, 9 aa, Homo Sapiens
YTDKIMTYL

SEQ ID NO: 155998 - protein, 9 aa, Homo Sapiens
YTDLPNRQL

SEQ ID NO: 155999 - protein, 9 aa, Homo Sapiens
YTDLVPKEV

SEQ ID NO: 156000 - protein, 9 aa, Homo Sapiens
YTDPDHASL

SEQ ID NO: 156001 - protein, 9 aa, Homo Sapiens
YTDRETGKL

SEQ ID NO: 156002 - protein, 9 aa, Homo Sapiens
YTDVNIVTI

SEQ ID NO: 156003 - protein, 9 aa, Homo Sapiens
YTEDEAKEL

SEQ ID NO: 156004 - protein, 9 aa, Homo Sapiens
YVAQAGLEL

SEQ ID NO: 156005 - protein, 9 aa, Homo Sapiens
YVDAVGQFL

SEQ ID NO: 156006 - protein, 9 aa, Homo Sapiens
YVDDFGVSV

SEQ ID NO: 156007 - protein, 9 aa, Homo Sapiens
YVDDGLISL

SEQ ID NO: 156008 - protein, 9 aa, Homo Sapiens
YVDEHGTRL

SEQ ID NO: 156009 - protein, 9 aa, Homo Sapiens
YVDEIASVL

SEQ ID NO: 156010 - protein, 9 aa, Homo Sapiens
YVDESRECV

SEQ ID NO: 156011 - protein, 9 aa, Homo Sapiens
YVDEVMTRL

SEQ ID NO: 156012 - protein, 9 aa, Homo Sapiens
YVDGRVLVV

SEQ ID NO: 156013 - protein, 9 aa, Homo Sapiens
YVDISENHL

SEQ ID NO: 156014 - protein, 9 aa, Homo Sapiens
YVDISIIAL

SEQ ID NO: 156015 - protein, 9 aa, Homo Sapiens
YVDLIEEQL

SEQ ID NO: 156016 - protein, 9 aa, Homo Sapiens
YVDNRFFTL

SEQ ID NO: 156017 - protein, 9 aa, Homo Sapiens
YVDPVNKVL

SEQ ID NO: 156018 - protein, 9 aa, Homo Sapiens
YVDRVTEFL

SEQ ID NO: 156019 - protein, 9 aa, Homo Sapiens
YVDSALKPL

SEQ ID NO: 156020 - protein, 9 aa, Homo Sapiens
YVDVQKFPL

SEQ ID NO: 156021 - protein, 9 aa, Homo Sapiens
YVDVVKVLL

SEQ ID NO: 156022 - protein, 9 aa, Homo Sapiens
YYDEIINAL

SEQ ID NO: 156023 - protein, 9 aa, Homo Sapiens
YYDLVRTEI

SEQ ID NO: 156024 - protein, 9 aa, Homo Sapiens
YYEEQHPEL

SEQ ID NO: 156025 - protein, 10 aa, Homo Sapiens
AADFEIGHFL

SEQ ID NO: 156026 - protein, 10 aa, Homo Sapiens
AADGEFLHEL

SEQ ID NO: 156027 - protein, 10 aa, Homo Sapiens
AADGGLRASV

SEQ ID NO: 156028 - protein, 10 aa, Homo Sapiens
AADGGPRVSF

SEQ ID NO: 156029 - protein, 10 aa, Homo Sapiens
AADGKGVVVV

SEQ ID NO: 156030 - protein, 10 aa, Homo Sapiens
AADGRGLQTV

SEQ ID NO: 156031 - protein, 10 aa, Homo Sapiens
AADGSLGRLA

SEQ ID NO: 156032 - protein, 10 aa, Homo Sapiens
AADIDTRSEF

SEQ ID NO: 156033 - protein, 10 aa, Homo Sapiens
AADKAAVVKF

SEQ ID NO: 156034 - protein, 10 aa, Homo Sapiens
AADKSAVVAA

SEQ ID NO: 156035 - protein, 10 aa, Homo Sapiens
AADPGLHETL

SEQ ID NO: 156036 - protein, 10 aa, Homo Sapiens
AADPGLPARL

SEQ ID NO: 156037 - protein, 10 aa, Homo Sapiens
AADPGPGAEL

SEQ ID NO: 156038 - protein, 10 aa, Homo Sapiens
AADTPPLETL

SEQ ID NO: 156039 - protein, 10 aa, Homo Sapiens
AADVAQSTHV

SEQ ID NO: 156040 - protein, 10 aa, Homo Sapiens
AADWIRISEM

SEQ ID NO: 156041 - protein, 10 aa, Homo Sapiens
AAEEPHALEL

SEQ ID NO: 156042 - protein, 10 aa, Homo Sapiens
AAETGSGKTL

SEQ ID NO: 156043 - protein, 10 aa, Homo Sapiens
AAPPAEKAPV

SEQ ID NO: 156044 - protein, 10 aa, Homo Sapiens
ALDASQHSSL

SEQ ID NO: 156045 - protein, 10 aa, Homo Sapiens
ASDGSFSLPL

SEQ ID NO: 156046 - protein, 10 aa, Homo Sapiens
ASDKPSQETL

SEQ ID NO: 156047 - protein, 10 aa, Homo Sapiens
ATDNNCHVTL

SEQ ID NO: 156048 - protein, 10 aa, Homo Sapiens
ATDYQGNTAL

SEQ ID NO: 156049 - protein, 10 aa, Homo Sapiens
AVDGGLSIPH

SEQ ID NO: 156050 - protein, 10 aa, Homo Sapiens
AVDGKEMVTM

SEQ ID NO: 156051 - protein, 10 aa, Homo Sapiens
AVDKANLEIM

SEQ ID NO: 156052 - protein, 10 aa, Homo Sapiens
AVDPNRAVPL

SEQ ID NO: 156053 - protein, 10 aa, Homo Sapiens
AVDQASHQSL

SEQ ID NO: 156054 - protein, 10 aa, Homo Sapiens
AVDTSSEITT

SEQ ID NO: 156055 - protein, 10 aa, Homo Sapiens
CADLLDRQIL

SEQ ID NO: 156056 - protein, 10 aa, Homo Sapiens
CQDPKEPRAL

SEQ ID NO: 156057 - protein, 10 aa, Homo Sapiens
DPPWDIHMEL

SEQ ID NO: 156058 - protein, 10 aa, Homo Sapiens
EEGAPSAAAL

SEQ ID NO: 156059 - protein, 10 aa, Homo Sapiens
ESDLPSAVTL

SEQ ID NO: 156060 - protein, 10 aa, Homo Sapiens
ESDPGVFTEL

SEQ ID NO: 156061 - protein, 10 aa, Homo Sapiens
FADAHNMLLF

SEQ ID NO: 156062 - protein, 10 aa, Homo Sapiens
FADASKGDDL

SEQ ID NO: 156063 - protein, 10 aa, Homo Sapiens
FADDNRFDFL

SEQ ID NO: 156064 - protein, 10 aa, Homo Sapiens
FADDPCSSVK

SEQ ID NO: 156065 - protein, 10 aa, Homo Sapiens
FADDQIAQSL

SEQ ID NO: 156066 - protein, 10 aa, Homo Sapiens
FADEKPLQDM

SEQ ID NO: 156067 - protein, 10 aa, Homo Sapiens
FADENNEKLF

SEQ ID NO: 156068 - protein, 10 aa, Homo Sapiens
FADGHVLELL

SEQ ID NO: 156069 - protein, 10 aa, Homo Sapiens
FADGILPLDL

SEQ ID NO: 156070 - protein, 10 aa, Homo Sapiens
FADGVPREGL

SEQ ID NO: 156071 - protein, 10 aa, Homo Sapiens
FADILNDVAM

SEQ ID NO: 156072 - protein, 10 aa, Homo Sapiens
FADISSQILF

SEQ ID NO: 156073 - protein, 10 aa, Homo Sapiens
FADIVGFTQL

SEQ ID NO: 156074 - protein, 10 aa, Homo Sapiens
FADKETLIQF

SEQ ID NO: 156075 - protein, 10 aa, Homo Sapiens
FADKSKQEAL

SEQ ID NO: 156076 - protein, 10 aa, Homo Sapiens
FADLNLVQAL

SEQ ID NO: 156077 - protein, 10 aa, Homo Sapiens
FADPNMLDTL

SEQ ID NO: 156078 - protein, 10 aa, Homo Sapiens
FADPVDVNPF

SEQ ID NO: 156079 - protein, 10 aa, Homo Sapiens
FADSDSHSSF

SEQ ID NO: 156080 - protein, 10 aa, Homo Sapiens
FADSFDRGTL

SEQ ID NO: 156081 - protein, 10 aa, Homo Sapiens
FADSHELSEL

SEQ ID NO: 156082 - protein, 10 aa, Homo Sapiens
FAEHGETLAM

SEQ ID NO: 156083 - protein, 10 aa, Homo Sapiens
FAEPGSEVYL

SEQ ID NO: 156084 - protein, 10 aa, Homo Sapiens
FGDFDIKTVL

SEQ ID NO: 156085 - protein, 10 aa, Homo Sapiens
FGDPECQVIL

SEQ ID NO: 156086 - protein, 10 aa, Homo Sapiens
FIDKNGETEL

SEQ ID NO: 156087 - protein, 10 aa, Homo Sapiens
FIDPSSGLAF

SEQ ID NO: 156088 - protein, 10 aa, Homo Sapiens
FIEDCEFTVL

SEQ ID NO: 156089 - protein, 10 aa, Homo Sapiens
FLDDEVTVPL

SEQ ID NO: 156090 - protein, 10 aa, Homo Sapiens
FLDNSLDTVL

SEQ ID NO: 156091 - protein, 10 aa, Homo Sapiens
FLDPPPYETL

SEQ ID NO: 156092 - protein, 10 aa, Homo Sapiens
FLEEVGSQAL

SEQ ID NO: 156093 - protein, 10 aa, Homo Sapiens
FMDDTSRSII

SEQ ID NO: 156094 - protein, 10 aa, Homo Sapiens
FNDSDSGISL

SEQ ID NO: 156095 - protein, 10 aa, Homo Sapiens
FSDPAVSQSL

SEQ ID NO: 156096 - protein, 10 aa, Homo Sapiens
FTDEESRVFL

SEQ ID NO: 156097 - protein, 10 aa, Homo Sapiens
FTDSGIHIIL

SEQ ID NO: 156098 - protein, 10 aa, Homo Sapiens
FVDCPGHDIL

SEQ ID NO: 156099 - protein, 10 aa, Homo Sapiens
FVDDETKLTL

SEQ ID NO: 156100 - protein, 10 aa, Homo Sapiens
FVDDGTETHF

SEQ ID NO: 156101 - protein, 10 aa, Homo Sapiens
FVDEGSLYGL

SEQ ID NO: 156102 - protein, 10 aa, Homo Sapiens
FVDGSAIQVL

SEQ ID NO: 156103 - protein, 10 aa, Homo Sapiens
FVDNFVHADL

SEQ ID NO: 156104 - protein, 10 aa, Homo Sapiens
FVDPNGKISL

SEQ ID NO: 156105 - protein, 10 aa, Homo Sapiens
FVDPSQDHAL

SEQ ID NO: 156106 - protein, 10 aa, Homo Sapiens
FVDSGAPPAL

SEQ ID NO: 156107 - protein, 10 aa, Homo Sapiens
FVDTDADTRL

SEQ ID NO: 156108 - protein, 10 aa, Homo Sapiens
FVDTSDCTVM

SEQ ID NO: 156109 - protein, 10 aa, Homo Sapiens
FVEDASGKGL

SEQ ID NO: 156110 - protein, 10 aa, Homo Sapiens
FVEDTECRTL

SEQ ID NO: 156111 - protein, 10 aa, Homo Sapiens
GADDPSSVTA

SEQ ID NO: 156112 - protein, 10 aa, Homo Sapiens
GGVMDVNTAL

SEQ ID NO: 156113 - protein, 10 aa, Homo Sapiens
GSDPPSGDFL

SEQ ID NO: 156114 - protein, 10 aa, Homo Sapiens
HADAPTNKTL

SEQ ID NO: 156115 - protein, 10 aa, Homo Sapiens
HADDCVGLEL

SEQ ID NO: 156116 - protein, 10 aa, Homo Sapiens
HADGERPNVL

SEQ ID NO: 156117 - protein, 10 aa, Homo Sapiens
HADSNIVIML

SEQ ID NO: 156118 - protein, 10 aa, Homo Sapiens
HADSVTGLSL

SEQ ID NO: 156119 - protein, 10 aa, Homo Sapiens
HADTGSIRSL

SEQ ID NO: 156120 - protein, 10 aa, Homo Sapiens
HADTPVDHCL

SEQ ID NO: 156121 - protein, 10 aa, Homo Sapiens
HIDGDHLTLL

SEQ ID NO: 156122 - protein, 10 aa, Homo Sapiens
HIDPKTGVAV

SEQ ID NO: 156123 - protein, 10 aa, Homo Sapiens
HIDRDVLIVL

SEQ ID NO: 156124 - protein, 10 aa, Homo Sapiens
HIDSEAISAL

SEQ ID NO: 156125 - protein, 10 aa, Homo Sapiens
HLDLPSNNNL

SEQ ID NO: 156126 - protein, 10 aa, Homo Sapiens
HSDDYVHISL

SEQ ID NO: 156127 - protein, 10 aa, Homo Sapiens
HSDVAYHNSL

SEQ ID NO: 156128 - protein, 10 aa, Homo Sapiens
IADDYLRTFL

SEQ ID NO: 156129 - protein, 10 aa, Homo Sapiens
IADGNPKLTL

SEQ ID NO: 156130 - protein, 10 aa, Homo Sapiens
IADGNPSLVL

SEQ ID NO: 156131 - protein, 10 aa, Homo Sapiens
IADISSPPVL

SEQ ID NO: 156132 - protein, 10 aa, Homo Sapiens
IADMASAVEI

SEQ ID NO: 156133 - protein, 10 aa, Homo Sapiens
IADNHTPKEL

SEQ ID NO: 156134 - protein, 10 aa, Homo Sapiens
IADNRPSVEF

SEQ ID NO: 156135 - protein, 10 aa, Homo Sapiens
IADPKTDHRL

SEQ ID NO: 156136 - protein, 10 aa, Homo Sapiens
IADSHQNFAL

SEQ ID NO: 156137 - protein, 10 aa, Homo Sapiens
IADTGANVVV

SEQ ID NO: 156138 - protein, 10 aa, Homo Sapiens
IADVSTGLEL

SEQ ID NO: 156139 - protein, 10 aa, Homo Sapiens
IAEEASKVCL

SEQ ID NO: 156140 - protein, 10 aa, Homo Sapiens
ICDLGGVNEL

SEQ ID NO: 156141 - protein, 10 aa, Homo Sapiens
IHDPGRGAPL

SEQ ID NO: 156142 - protein, 10 aa, Homo Sapiens
IIDAPDISSL

SEQ ID NO: 156143 - protein, 10 aa, Homo Sapiens
IIDDPSGNSF

SEQ ID NO: 156144 - protein, 10 aa, Homo Sapiens
IIDGNPSIIL

SEQ ID NO: 156145 - protein, 10 aa, Homo Sapiens
IIDPNHEIEF

SEQ ID NO: 156146 - protein, 10 aa, Homo Sapiens
IIDTANTTEM

SEQ ID NO: 156147 - protein, 10 aa, Homo Sapiens
IIDTKGVTAL

SEQ ID NO: 156148 - protein, 10 aa, Homo Sapiens
IIDTPGHESF

SEQ ID NO: 156149 - protein, 10 aa, Homo Sapiens
ILDDVSLTHL

SEQ ID NO: 156150 - protein, 10 aa, Homo Sapiens
ILDGRPGNPL

SEQ ID NO: 156151 - protein, 10 aa, Homo Sapiens
ISDEISIMTL

SEQ ID NO: 156152 - protein, 10 aa, Homo Sapiens
ISDGPSKVTL

SEQ ID NO: 156153 - protein, 10 aa, Homo Sapiens
ITDADQIRAL

SEQ ID NO: 156154 - protein, 10 aa, Homo Sapiens
ITDPYQQAFL

SEQ ID NO: 156155 - protein, 10 aa, Homo Sapiens
IVDDCGGAFT

SEQ ID NO: 156156 - protein, 10 aa, Homo Sapiens
IVDGHSVEEL

SEQ ID NO: 156157 - protein, 10 aa, Homo Sapiens
KADAASSLTV

SEQ ID NO: 156158 - protein, 10 aa, Homo Sapiens
KADAISKSEL

SEQ ID NO: 156159 - protein, 10 aa, Homo Sapiens
KADGIVSKNF

SEQ ID NO: 156160 - protein, 10 aa, Homo Sapiens
KADKNYSVNL

SEQ ID NO: 156161 - protein, 10 aa, Homo Sapiens
KADLPEGVAV

SEQ ID NO: 156162 - protein, 10 aa, Homo Sapiens
KADPCVAHAL

SEQ ID NO: 156163 - protein, 10 aa, Homo Sapiens
KADPGRQESL

SEQ ID NO: 156164 - protein, 10 aa, Homo Sapiens
KADTIAKNEL

SEQ ID NO: 156165 - protein, 10 aa, Homo Sapiens
KADTISKSEL

SEQ ID NO: 156166 - protein, 10 aa, Homo Sapiens
KADTNGIIKT

SEQ ID NO: 156167 - protein, 10 aa, Homo Sapiens
KADTVSKTEL

SEQ ID NO: 156168 - protein, 10 aa, Homo Sapiens
KADVQSIIGL

SEQ ID NO: 156169 - protein, 10 aa, Homo Sapiens
KAEPPQCTSL

SEQ ID NO: 156170 - protein, 10 aa, Homo Sapiens
KGDNSSVSSL

SEQ ID NO: 156171 - protein, 10 aa, Homo Sapiens
KLDFGETTVL

SEQ ID NO: 156172 - protein, 10 aa, Homo Sapiens
KQDGSPSTEL

SEQ ID NO: 156173 - protein, 10 aa, Homo Sapiens
KSDDKNTVNL

SEQ ID NO: 156174 - protein, 10 aa, Homo Sapiens
KSDDLPHWVL

SEQ ID NO: 156175 - protein, 10 aa, Homo Sapiens
KSDDPIVTSL

SEQ ID NO: 156176 - protein, 10 aa, Homo Sapiens
KSDEGGKVLL

SEQ ID NO: 156177 - protein, 10 aa, Homo Sapiens
KSDQSYVISF

SEQ ID NO: 156178 - protein, 10 aa, Homo Sapiens
KSDVSSLIFL

SEQ ID NO: 156179 - protein, 10 aa, Homo Sapiens
KSGLDLNTSL

SEQ ID NO: 156180 - protein, 10 aa, Homo Sapiens
KTDEGSRLSL

SEQ ID NO: 156181 - protein, 10 aa, Homo Sapiens
KVDEVGGEAL

SEQ ID NO: 156182 - protein, 10 aa, Homo Sapiens
LADDLKIESL

SEQ ID NO: 156183 - protein, 10 aa, Homo Sapiens
LADFGVAGQL

SEQ ID NO: 156184 - protein, 10 aa, Homo Sapiens
LADLPQSIGM

SEQ ID NO: 156185 - protein, 10 aa, Homo Sapiens
LADPSTTGQM

SEQ ID NO: 156186 - protein, 10 aa, Homo Sapiens
LADTSDSRAL

SEQ ID NO: 156187 - protein, 10 aa, Homo Sapiens
LDSITPEVLP

SEQ ID NO: 156188 - protein, 10 aa, Homo Sapiens
LGDGLGHVEL

SEQ ID NO: 156189 - protein, 10 aa, Homo Sapiens
LIDFGSGALL

SEQ ID NO: 156190 - protein, 10 aa, Homo Sapiens
LIDLPGHESL

SEQ ID NO: 156191 - protein, 10 aa, Homo Sapiens
LLDDRGMTAL

SEQ ID NO: 156192 - protein, 10 aa, Homo Sapiens
LSDEENLKLF

SEQ ID NO: 156193 - protein, 10 aa, Homo Sapiens
LSDGRDLVSL

SEQ ID NO: 156194 - protein, 10 aa, Homo Sapiens
LSDPQVHTVL

SEQ ID NO: 156195 - protein, 10 aa, Homo Sapiens
LTDMSRPVEL

SEQ ID NO: 156196 - protein, 10 aa, Homo Sapiens
LVADAKDNSI

SEQ ID NO: 156197 - protein, 10 aa, Homo Sapiens
LVDDSFSQAL

SEQ ID NO: 156198 - protein, 10 aa, Homo Sapiens
LVDISQDNAL

SEQ ID NO: 156199 - protein, 10 aa, Homo Sapiens
LVDWSSGNVL

SEQ ID NO: 156200 - protein, 10 aa, Homo Sapiens
MADEALGSGL

SEQ ID NO: 156201 - protein, 10 aa, Homo Sapiens
MADTGKLNTL

SEQ ID NO: 156202 - protein, 10 aa, Homo Sapiens
MQDESSQTSL

SEQ ID NO: 156203 - protein, 10 aa, Homo Sapiens
NADDCYQSKL

SEQ ID NO: 156204 - protein, 10 aa, Homo Sapiens
NADDMAETVL

SEQ ID NO: 156205 - protein, 10 aa, Homo Sapiens
NADDVVATAL

SEQ ID NO: 156206 - protein, 10 aa, Homo Sapiens
NADEASTAEL

SEQ ID NO: 156207 - protein, 10 aa, Homo Sapiens
NADELLESFL

SEQ ID NO: 156208 - protein, 10 aa, Homo Sapiens
NADGPAPLEL

SEQ ID NO: 156209 - protein, 10 aa, Homo Sapiens
NADGPGFHSL

SEQ ID NO: 156210 - protein, 10 aa, Homo Sapiens
NADGPNPWML

SEQ ID NO: 156211 - protein, 10 aa, Homo Sapiens
NADPSVINCL

SEQ ID NO: 156212 - protein, 10 aa, Homo Sapiens
NAENPRGTFL

SEQ ID NO: 156213 - protein, 10 aa, Homo Sapiens
NAESGRGQVM

SEQ ID NO: 156214 - protein, 10 aa, Homo Sapiens
NSDDSSRNLF

SEQ ID NO: 156215 - protein, 10 aa, Homo Sapiens
NSDPGTETEL

SEQ ID NO: 156216 - protein, 10 aa, Homo Sapiens
NVDAFKLESL

SEQ ID NO: 156217 - protein, 10 aa, Homo Sapiens
NVDIATTEAL

SEQ ID NO: 156218 - protein, 10 aa, Homo Sapiens
PEVKFNWYVD

SEQ ID NO: 156219 - protein, 10 aa, Homo Sapiens
QADEANKRLL

SEQ ID NO: 156220 - protein, 10 aa, Homo Sapiens
QAEEPRGSSL

SEQ ID NO: 156221 - protein, 10 aa, Homo Sapiens
RADGENTAFL

SEQ ID NO: 156222 - protein, 10 aa, Homo Sapiens
RADGLGIPQL

SEQ ID NO: 156223 - protein, 10 aa, Homo Sapiens
RADPGVLAAL

SEQ ID NO: 156224 - protein, 10 aa, Homo Sapiens
RADTDGGLIF

SEQ ID NO: 156225 - protein, 10 aa, Homo Sapiens
RIDGGITGAL

SEQ ID NO: 156226 - protein, 10 aa, Homo Sapiens
RIDGGITGNM

SEQ ID NO: 156227 - protein, 10 aa, Homo Sapiens
RMDGEGQLTL

SEQ ID NO: 156228 - protein, 10 aa, Homo Sapiens
RSDVPSLVTF

SEQ ID NO: 156229 - protein, 10 aa, Homo Sapiens
RTDGKVFQFL

SEQ ID NO: 156230 - protein, 10 aa, Homo Sapiens
SADEPGVMYL

SEQ ID NO: 156231 - protein, 10 aa, Homo Sapiens
SADEPMTTFV

SEQ ID NO: 156232 - protein, 10 aa, Homo Sapiens
SADESGQALL

SEQ ID NO: 156233 - protein, 10 aa, Homo Sapiens
SADESGQIFI

SEQ ID NO: 156234 - protein, 10 aa, Homo Sapiens
SADETFTHHL

SEQ ID NO: 156235 - protein, 10 aa, Homo Sapiens
SADGSQAQNL

SEQ ID NO: 156236 - protein, 10 aa, Homo Sapiens
SADIESILAL

SEQ ID NO: 156237 - protein, 10 aa, Homo Sapiens
SADKGGFLYL

SEQ ID NO: 156238 - protein, 10 aa, Homo Sapiens
SADLPPPSAL

SEQ ID NO: 156239 - protein, 10 aa, Homo Sapiens
SADPFPQVKL

SEQ ID NO: 156240 - protein, 10 aa, Homo Sapiens
SADPGVFVLL

SEQ ID NO: 156241 - protein, 10 aa, Homo Sapiens
SADPLPNSYL

SEQ ID NO: 156242 - protein, 10 aa, Homo Sapiens
SADSAEAHSL

SEQ ID NO: 156243 - protein, 10 aa, Homo Sapiens
SADTPCATVL

SEQ ID NO: 156244 - protein, 10 aa, Homo Sapiens
SADVPLVVEY

SEQ ID NO: 156245 - protein, 10 aa, Homo Sapiens
SAEEGGAARL

SEQ ID NO: 156246 - protein, 10 aa, Homo Sapiens
SAELGSSTSL

SEQ ID NO: 156247 - protein, 10 aa, Homo Sapiens
SAEQASILSL

SEQ ID NO: 156248 - protein, 10 aa, Homo Sapiens
SFGGGSFGGG

SEQ ID NO: 156249 - protein, 10 aa, Homo Sapiens
SIDKGDTPSL

SEQ ID NO: 156250 - protein, 10 aa, Homo Sapiens
SIDLPGIKGL

SEQ ID NO: 156251 - protein, 10 aa, Homo Sapiens
SIDSEGRTVL

SEQ ID NO: 156252 - protein, 10 aa, Homo Sapiens
SLDDRVLSSL

SEQ ID NO: 156253 - protein, 10 aa, Homo Sapiens
SSDGEALFAL

SEQ ID NO: 156254 - protein, 10 aa, Homo Sapiens
STDKGPNSAL

SEQ ID NO: 156255 - protein, 10 aa, Homo Sapiens
SVDGSPTTAF

SEQ ID NO: 156256 - protein, 10 aa, Homo Sapiens
SVGESSSKGP

SEQ ID NO: 156257 - protein, 10 aa, Homo Sapiens
TADDINKVVL

SEQ ID NO: 156258 - protein, 10 aa, Homo Sapiens
TADDPSLSLI

SEQ ID NO: 156259 - protein, 10 aa, Homo Sapiens
TADDQRSSSL

SEQ ID NO: 156260 - protein, 10 aa, Homo Sapiens
TADFSGDVTL

SEQ ID NO: 156261 - protein, 10 aa, Homo Sapiens
TADGLPVGVL

SEQ ID NO: 156262 - protein, 10 aa, Homo Sapiens
TADKGWQNSI

SEQ ID NO: 156263 - protein, 10 aa, Homo Sapiens
TADNHGYTAL

SEQ ID NO: 156264 - protein, 10 aa, Homo Sapiens
TADNVLTLSL

SEQ ID NO: 156265 - protein, 10 aa, Homo Sapiens
TADPGATMTF

SEQ ID NO: 156266 - protein, 10 aa, Homo Sapiens
TADPLSNMVL

SEQ ID NO: 156267 - protein, 10 aa, Homo Sapiens
TAEDPSKSYV

SEQ ID NO: 156268 - protein, 10 aa, Homo Sapiens
TAEEPTGVFL

SEQ ID NO: 156269 - protein, 10 aa, Homo Sapiens
TAVEGDEVSL

SEQ ID NO: 156270 - protein, 10 aa, Homo Sapiens
TIDAEVMNSL

SEQ ID NO: 156271 - protein, 10 aa, Homo Sapiens
TIDDRIVHEL

SEQ ID NO: 156272 - protein, 10 aa, Homo Sapiens
TIDFTPGSEL

SEQ ID NO: 156273 - protein, 10 aa, Homo Sapiens
TIDGSKTCTI

SEQ ID NO: 156274 - protein, 10 aa, Homo Sapiens
TLDKPSVVSL

SEQ ID NO: 156275 - protein, 10 aa, Homo Sapiens
TVDADTVTEL

SEQ ID NO: 156276 - protein, 10 aa, Homo Sapiens
TVDDPYATFV

SEQ ID NO: 156277 - protein, 10 aa, Homo Sapiens
VAAEPPPGQL

SEQ ID NO: 156278 - protein, 10 aa, Homo Sapiens
VADDIMDSSL

SEQ ID NO: 156279 - protein, 10 aa, Homo Sapiens
VADDQGQHPL

SEQ ID NO: 156280 - protein, 10 aa, Homo Sapiens
VADDRFTKSI

SEQ ID NO: 156281 - protein, 10 aa, Homo Sapiens
VADDYIHTAA

SEQ ID NO: 156282 - protein, 10 aa, Homo Sapiens
VADGAGAVII

SEQ ID NO: 156283 - protein, 10 aa, Homo Sapiens
VADGIFKAEL

SEQ ID NO: 156284 - protein, 10 aa, Homo Sapiens
VADGSLINQL

SEQ ID NO: 156285 - protein, 10 aa, Homo Sapiens
VADIDGQYAM

SEQ ID NO: 156286 - protein, 10 aa, Homo Sapiens
VADKTGSITI

SEQ ID NO: 156287 - protein, 10 aa, Homo Sapiens
VADNRKVQEL

SEQ ID NO: 156288 - protein, 10 aa, Homo Sapiens
VADPDNPLVL

SEQ ID NO: 156289 - protein, 10 aa, Homo Sapiens
VADPVYRTFL

SEQ ID NO: 156290 - protein, 10 aa, Homo Sapiens
VADPYVVIMS

SEQ ID NO: 156291 - protein, 10 aa, Homo Sapiens
VADSDRQLAL

SEQ ID NO: 156292 - protein, 10 aa, Homo Sapiens
VADSPAEVAL

SEQ ID NO: 156293 - protein, 10 aa, Homo Sapiens
VADTPENLRL

SEQ ID NO: 156294 - protein, 10 aa, Homo Sapiens
VADWGQKVSF

SEQ ID NO: 156295 - protein, 10 aa, Homo Sapiens
VADYCENNYI

SEQ ID NO: 156296 - protein, 10 aa, Homo Sapiens
VAEEPAGTSL

SEQ ID NO: 156297 - protein, 10 aa, Homo Sapiens
VIDFDENTAL

SEQ ID NO: 156298 - protein, 10 aa, Homo Sapiens
VIDFSHGLAL

SEQ ID NO: 156299 - protein, 10 aa, Homo Sapiens
VIDIPGADTL

SEQ ID NO: 156300 - protein, 10 aa, Homo Sapiens
VIDPATATSV

SEQ ID NO: 156301 - protein, 10 aa, Homo Sapiens
VIDPESGNTL

SEQ ID NO: 156302 - protein, 10 aa, Homo Sapiens
VIDSGDGVTH

SEQ ID NO: 156303 - protein, 10 aa, Homo Sapiens
VIEDFPAKEL

SEQ ID NO: 156304 - protein, 10 aa, Homo Sapiens
VLDENKNTAL

SEQ ID NO: 156305 - protein, 10 aa, Homo Sapiens
VSDDPQVLAV

SEQ ID NO: 156306 - protein, 10 aa, Homo Sapiens
VSDDSLGSLL

SEQ ID NO: 156307 - protein, 10 aa, Homo Sapiens
VSDGAAAILL

SEQ ID NO: 156308 - protein, 10 aa, Homo Sapiens
VSDIVGPDGL

SEQ ID NO: 156309 - protein, 10 aa, Homo Sapiens
VSDMGVIHPL

SEQ ID NO: 156310 - protein, 10 aa, Homo Sapiens
VSDPESTVAV

SEQ ID NO: 156311 - protein, 10 aa, Homo Sapiens
VSDPNLIHVL

SEQ ID NO: 156312 - protein, 10 aa, Homo Sapiens
VSDPSHCNVL

SEQ ID NO: 156313 - protein, 10 aa, Homo Sapiens
VTDEFLSDFL

SEQ ID NO: 156314 - protein, 10 aa, Homo Sapiens
VTDEPVYIDL

SEQ ID NO: 156315 - protein, 10 aa, Homo Sapiens
VTDETSGCSL

SEQ ID NO: 156316 - protein, 10 aa, Homo Sapiens
VTDGLPATAL

SEQ ID NO: 156317 - protein, 10 aa, Homo Sapiens
VTDSAAFNAL

SEQ ID NO: 156318 - protein, 10 aa, Homo Sapiens
VTVSSDHEVI

SEQ ID NO: 156319 - protein, 10 aa, Homo Sapiens
VVDDSNEHML

SEQ ID NO: 156320 - protein, 10 aa, Homo Sapiens
VVDNPQKFAL

SEQ ID NO: 156321 - protein, 10 aa, Homo Sapiens
VVDSPGQEVL

SEQ ID NO: 156322 - protein, 10 aa, Homo Sapiens
VVPPFLQPEV

SEQ ID NO: 156323 - protein, 10 aa, Homo Sapiens
WADGLIHTSL

SEQ ID NO: 156324 - protein, 10 aa, Homo Sapiens
WLDPNETNEI

SEQ ID NO: 156325 - protein, 10 aa, Homo Sapiens
YADASGRNTL

SEQ ID NO: 156326 - protein, 10 aa, Homo Sapiens
YADDNSLLFM

SEQ ID NO: 156327 - protein, 10 aa, Homo Sapiens
YADPGAEVKI

SEQ ID NO: 156328 - protein, 10 aa, Homo Sapiens
YADPVSAQHA

SEQ ID NO: 156329 - protein, 10 aa, Homo Sapiens
YADQHSVQVF

SEQ ID NO: 156330 - protein, 10 aa, Homo Sapiens
YCEPPTGVSL

SEQ ID NO: 156331 - protein, 10 aa, Homo Sapiens
YGDDPTAQSL

SEQ ID NO: 156332 - protein, 10 aa, Homo Sapiens
YIDPYKLLPL

SEQ ID NO: 156333 - protein, 10 aa, Homo Sapiens
YIEQGNTKAL

SEQ ID NO: 156334 - protein, 10 aa, Homo Sapiens
YLDEEFHQSL

SEQ ID NO: 156335 - protein, 10 aa, Homo Sapiens
YLDGHLITTV

SEQ ID NO: 156336 - protein, 10 aa, Homo Sapiens
YQDPSFHLSL

SEQ ID NO: 156337 - protein, 10 aa, Homo Sapiens
YSDTELQQCL

SEQ ID NO: 156338 - protein, 10 aa, Homo Sapiens
YTDDESMKSL

SEQ ID NO: 156339 - protein, 10 aa, Homo Sapiens
YTDTSNHSSL

SEQ ID NO: 156340 - protein, 10 aa, Homo Sapiens
YVDAGTPMYL

SEQ ID NO: 156341 - protein, 10 aa, Homo Sapiens
YVDDPPRIVL

SEQ ID NO: 156342 - protein, 10 aa, Homo Sapiens
YVDEAGTVKL

SEQ ID NO: 156343 - protein, 10 aa, Homo Sapiens
YVDEASKKEI

SEQ ID NO: 156344 - protein, 10 aa, Homo Sapiens
YVDGPASTAF

SEQ ID NO: 156345 - protein, 10 aa, Homo Sapiens
YVDPYELASL

SEQ ID NO: 156346 - protein, 10 aa, Homo Sapiens
YVDQNIHEQL

SEQ ID NO: 156347 - protein, 11 aa, Homo Sapiens
AADAEPLEIIL

SEQ ID NO: 156348 - protein, 11 aa, Homo Sapiens
AADALGKLISI

SEQ ID NO: 156349 - protein, 11 aa, Homo Sapiens
AADDIMDPTSL

SEQ ID NO: 156350 - protein, 11 aa, Homo Sapiens
AADDPLVHESL

SEQ ID NO: 156351 - protein, 11 aa, Homo Sapiens
AADFSGFGSTL

SEQ ID NO: 156352 - protein, 11 aa, Homo Sapiens
AADGGLRASVT

SEQ ID NO: 156353 - protein, 11 aa, Homo Sapiens
AADGSVKLWSL

SEQ ID NO: 156354 - protein, 11 aa, Homo Sapiens
AADIENRVLEL

SEQ ID NO: 156355 - protein, 11 aa, Homo Sapiens
AADLDAVPMSL

SEQ ID NO: 156356 - protein, 11 aa, Homo Sapiens
AADMLGSYGSL

SEQ ID NO: 156357 - protein, 11 aa, Homo Sapiens
AADVAQSTHVL

SEQ ID NO: 156358 - protein, 11 aa, Homo Sapiens
AAENPGKYNIL

SEQ ID NO: 156359 - protein, 11 aa, Homo Sapiens
ADPPWDIHMEL

SEQ ID NO: 156360 - protein, 11 aa, Homo Sapiens
ASDLVSKSSSL

SEQ ID NO: 156361 - protein, 11 aa, Homo Sapiens
AVDKANLEIMT

SEQ ID NO: 156362 - protein, 11 aa, Homo Sapiens
AVDNQPRDIGL

SEQ ID NO: 156363 - protein, 11 aa, Homo Sapiens
AVDTSSEITTK

SEQ ID NO: 156364 - protein, 11 aa, Homo Sapiens
FADDGVKYLEL

SEQ ID NO: 156365 - protein, 11 aa, Homo Sapiens
FADDPCSSVKR

SEQ ID NO: 156366 - protein, 11 aa, Homo Sapiens
FADDTYTESYI

SEQ ID NO: 156367 - protein, 11 aa, Homo Sapiens
FADFVEGSSHL

SEQ ID NO: 156368 - protein, 11 aa, Homo Sapiens
FADGERKVEHL

SEQ ID NO: 156369 - protein, 11 aa, Homo Sapiens
FADHGQDSSSL

SEQ ID NO: 156370 - protein, 11 aa, Homo Sapiens
FADKETLIQFL

SEQ ID NO: 156371 - protein, 11 aa, Homo Sapiens
FADLGDLSSGL

SEQ ID NO: 156372 - protein, 11 aa, Homo Sapiens
FADLSQKSPEL

SEQ ID NO: 156373 - protein, 11 aa, Homo Sapiens
FADNPGPMVVF

SEQ ID NO: 156374 - protein, 11 aa, Homo Sapiens
FADPAHGGSWL

SEQ ID NO: 156375 - protein, 11 aa, Homo Sapiens
FADQNSVPRAL

SEQ ID NO: 156376 - protein, 11 aa, Homo Sapiens
FADVLPEAAAL

SEQ ID NO: 156377 - protein, 11 aa, Homo Sapiens
FAEDITTGQVL

SEQ ID NO: 156378 - protein, 11 aa, Homo Sapiens
FAEDVGSNKGA

SEQ ID NO: 156379 - protein, 11 aa, Homo Sapiens
FAEISSNTSQL

SEQ ID NO: 156380 - protein, 11 aa, Homo Sapiens
FAYDGKDYIAL

SEQ ID NO: 156381 - protein, 11 aa, Homo Sapiens
FAYDGKDYLTL

SEQ ID NO: 156382 - protein, 11 aa, Homo Sapiens
FAYDPSNYEYL

SEQ ID NO: 156383 - protein, 11 aa, Homo Sapiens
FGDEGAVIEVL

SEQ ID NO: 156384 - protein, 11 aa, Homo Sapiens
FGDESNKPILL

SEQ ID NO: 156385 - protein, 11 aa, Homo Sapiens
FIDDANYSVGL

SEQ ID NO: 156386 - protein, 11 aa, Homo Sapiens
FIDDLADLSCL

SEQ ID NO: 156387 - protein, 11 aa, Homo Sapiens
FIDLDSHAEAL

SEQ ID NO: 156388 - protein, 11 aa, Homo Sapiens
FLDNPGILSEL

SEQ ID NO: 156389 - protein, 11 aa, Homo Sapiens
FLDVGEYNSAL

SEQ ID NO: 156390 - protein, 11 aa, Homo Sapiens
FQDPSAVYSEL

SEQ ID NO: 156391 - protein, 11 aa, Homo Sapiens
FSDDAFNTTFI

SEQ ID NO: 156392 - protein, 11 aa, Homo Sapiens
FSDDPNVTKTL

SEQ ID NO: 156393 - protein, 11 aa, Homo Sapiens
FTDLSRLPLAL

SEQ ID NO: 156394 - protein, 11 aa, Homo Sapiens
FVDDSGRYLAI

SEQ ID NO: 156395 - protein, 11 aa, Homo Sapiens
FVDLEQFNQQL

SEQ ID NO: 156396 - protein, 11 aa, Homo Sapiens
FVDTADRLASL

SEQ ID NO: 156397 - protein, 11 aa, Homo Sapiens
FVEDASTASAL

SEQ ID NO: 156398 - protein, 11 aa, Homo Sapiens
FVEEPSKKGAL

SEQ ID NO: 156399 - protein, 11 aa, Homo Sapiens
GAEDPETQVVL

SEQ ID NO: 156400 - protein, 11 aa, Homo Sapiens
GAFLSRPINTI

SEQ ID NO: 156401 - protein, 11 aa, Homo Sapiens
HADTSVKPQAL

SEQ ID NO: 156402 - protein, 11 aa, Homo Sapiens
HADTVGIDAVL

SEQ ID NO: 156403 - protein, 11 aa, Homo Sapiens
HLDPAGTHSTL

SEQ ID NO: 156404 - protein, 11 aa, Homo Sapiens
HVDGSSKPAVL

SEQ ID NO: 156405 - protein, 11 aa, Homo Sapiens
IADDADPRVAL

SEQ ID NO: 156406 - protein, 11 aa, Homo Sapiens
IADLSHEAILL

SEQ ID NO: 156407 - protein, 11 aa, Homo Sapiens
IADLSNIINKL

SEQ ID NO: 156408 - protein, 11 aa, Homo Sapiens
IADSNQNMQSL

SEQ ID NO: 156409 - protein, 11 aa, Homo Sapiens
IIDDPNLVVKI

SEQ ID NO: 156410 - protein, 11 aa, Homo Sapiens
IIDLEQTATHL

SEQ ID NO: 156411 - protein, 11 aa, Homo Sapiens
IMDDPAGNSYL

SEQ ID NO: 156412 - protein, 11 aa, Homo Sapiens
IQDLIDDKDAL

SEQ ID NO: 156413 - protein, 11 aa, Homo Sapiens
IQDQLSLSEAL

SEQ ID NO: 156414 - protein, 11 aa, Homo Sapiens
ISDDSRTASQL

SEQ ID NO: 156415 - protein, 11 aa, Homo Sapiens
ISDDTTHPISY

SEQ ID NO: 156416 - protein, 11 aa, Homo Sapiens
ISDLDRQIEQL

SEQ ID NO: 156417 - protein, 11 aa, Homo Sapiens
IVDGGINPDSL

SEQ ID NO: 156418 - protein, 11 aa, Homo Sapiens
IVDLARYVQEL

SEQ ID NO: 156419 - protein, 11 aa, Homo Sapiens
IVDLGDHREVL

SEQ ID NO: 156420 - protein, 11 aa, Homo Sapiens
IVDPTGEEEHL

SEQ ID NO: 156421 - protein, 11 aa, Homo Sapiens
IVDPVEPHGEM

SEQ ID NO: 156422 - protein, 11 aa, Homo Sapiens
KADGQGSTTML

SEQ ID NO: 156423 - protein, 11 aa, Homo Sapiens
KADPAAASHPL

SEQ ID NO: 156424 - protein, 11 aa, Homo Sapiens
KADPQEAINCL

SEQ ID NO: 156425 - protein, 11 aa, Homo Sapiens
KSDQTNILSAL

SEQ ID NO: 156426 - protein, 11 aa, Homo Sapiens
KTDLDDDITAL

SEQ ID NO: 156427 - protein, 11 aa, Homo Sapiens
KVDSPTVNTTL

SEQ ID NO: 156428 - protein, 11 aa, Homo Sapiens
KVDSPTVTTTL

SEQ ID NO: 156429 - protein, 11 aa, Homo Sapiens
KVDVASVIVTK

SEQ ID NO: 156430 - protein, 11 aa, Homo Sapiens
LADLNSVERSL

SEQ ID NO: 156431 - protein, 11 aa, Homo Sapiens
LADWVSGKISF

SEQ ID NO: 156432 - protein, 11 aa, Homo Sapiens
LAEMPDSAAAL

SEQ ID NO: 156433 - protein, 11 aa, Homo Sapiens
LLDEPTNHLDL

SEQ ID NO: 156434 - protein, 11 aa, Homo Sapiens
LSDEHAGVISV

SEQ ID NO: 156435 - protein, 11 aa, Homo Sapiens
LSDYSDIVTTL

SEQ ID NO: 156436 - protein, 11 aa, Homo Sapiens
LVDAGVPMRAL

SEQ ID NO: 156437 - protein, 11 aa, Homo Sapiens
MADKPGNTVNF

SEQ ID NO: 156438 - protein, 11 aa, Homo Sapiens
MAPSETQFSHL

SEQ ID NO: 156439 - protein, 11 aa, Homo Sapiens
NADDMDRIMTL

SEQ ID NO: 156440 - protein, 11 aa, Homo Sapiens
NLDVPHSYSVL

SEQ ID NO: 156441 - protein, 11 aa, Homo Sapiens
NSDGYPDSLAL

SEQ ID NO: 156442 - protein, 11 aa, Homo Sapiens
NTDQTTASSSL

SEQ ID NO: 156443 - protein, 11 aa, Homo Sapiens
NVDSSGNKSVL

SEQ ID NO: 156444 - protein, 11 aa, Homo Sapiens
QADNPMESSIL

SEQ ID NO: 156445 - protein, 11 aa, Homo Sapiens
RADSTYGSSSL

SEQ ID NO: 156446 - protein, 11 aa, Homo Sapiens
RAEDNADTLAL

SEQ ID NO: 156447 - protein, 11 aa, Homo Sapiens
RQILKNPDDPD

SEQ ID NO: 156448 - protein, 11 aa, Homo Sapiens
SADDIAGKFQF

SEQ ID NO: 156449 - protein, 11 aa, Homo Sapiens
SADGTIKLWAL

SEQ ID NO: 156450 - protein, 11 aa, Homo Sapiens
SADLTCRTSDL

SEQ ID NO: 156451 - protein, 11 aa, Homo Sapiens
SADTILIGHSL

SEQ ID NO: 156452 - protein, 11 aa, Homo Sapiens
SADVNGKIIVW

SEQ ID NO: 156453 - protein, 11 aa, Homo Sapiens
SAEDLEKALEL

SEQ ID NO: 156454 - protein, 11 aa, Homo Sapiens
SAEYSTKNNAL

SEQ ID NO: 156455 - protein, 11 aa, Homo Sapiens
SFGAGGGFGSR

SEQ ID NO: 156456 - protein, 11 aa, Homo Sapiens
SFQSPVKISEI

SEQ ID NO: 156457 - protein, 11 aa, Homo Sapiens
SIDSPKAITSL

SEQ ID NO: 156458 - protein, 11 aa, Homo Sapiens
SIDVSLPLNTL

SEQ ID NO: 156459 - protein, 11 aa, Homo Sapiens
SQDLLDLMHTL

SEQ ID NO: 156460 - protein, 11 aa, Homo Sapiens
TADDKKLQSSL

SEQ ID NO: 156461 - protein, 11 aa, Homo Sapiens
TADENPDKSTL

SEQ ID NO: 156462 - protein, 11 aa, Homo Sapiens
TADLPNELIEL

SEQ ID NO: 156463 - protein, 11 aa, Homo Sapiens
TADQVDLTSAL

SEQ ID NO: 156464 - protein, 11 aa, Homo Sapiens
TANGGLALASI

SEQ ID NO: 156465 - protein, 11 aa, Homo Sapiens
TIDQSELSSQL

SEQ ID NO: 156466 - protein, 11 aa, Homo Sapiens
TLDGGDIINAL

SEQ ID NO: 156467 - protein, 11 aa, Homo Sapiens
TSDVQDRLSAL

SEQ ID NO: 156468 - protein, 11 aa, Homo Sapiens
TVDLGEPLHSL

SEQ ID NO: 156469 - protein, 11 aa, Homo Sapiens
VADAGAATREL

SEQ ID NO: 156470 - protein, 11 aa, Homo Sapiens
VADIQDRIQAL

SEQ ID NO: 156471 - protein, 11 aa, Homo Sapiens
VADPPRDSKGL

SEQ ID NO: 156472 - protein, 11 aa, Homo Sapiens
VADSPRDTASL

SEQ ID NO: 156473 - protein, 11 aa, Homo Sapiens
VIDESTTASIL

SEQ ID NO: 156474 - protein, 11 aa, Homo Sapiens
VIDFTGHALAL

SEQ ID NO: 156475 - protein, 11 aa, Homo Sapiens
VIWTSSDHQVL

SEQ ID NO: 156476 - protein, 11 aa, Homo Sapiens
VLDKDLQKLPW

SEQ ID NO: 156477 - protein, 11 aa, Homo Sapiens
VLDQAGGLIAF

SEQ ID NO: 156478 - protein, 11 aa, Homo Sapiens
VQDILEQNEAL

SEQ ID NO: 156479 - protein, 11 aa, Homo Sapiens
VSDGENVIISH

SEQ ID NO: 156480 - protein, 11 aa, Homo Sapiens
VSDGHLQDESL

SEQ ID NO: 156481 - protein, 11 aa, Homo Sapiens
VTEGVSETSFL

SEQ ID NO: 156482 - protein, 11 aa, Homo Sapiens
VVDPVTSEHEL

SEQ ID NO: 156483 - protein, 11 aa, Homo Sapiens
YADGEAKVEQL

SEQ ID NO: 156484 - protein, 11 aa, Homo Sapiens
YADIDAAWQAL

SEQ ID NO: 156485 - protein, 11 aa, Homo Sapiens
YADIGGLDNQI

SEQ ID NO: 156486 - protein, 11 aa, Homo Sapiens
YADPNFVRTFL

SEQ ID NO: 156487 - protein, 11 aa, Homo Sapiens
YADVQKDGVGM

SEQ ID NO: 156488 - protein, 11 aa, Homo Sapiens
YAYDGKDYIAL

SEQ ID NO: 156489 - protein, 11 aa, Homo Sapiens
YGDLGGPIITT

SEQ ID NO: 156490 - protein, 11 aa, Homo Sapiens
YIDFRDGAGLL

SEQ ID NO: 156491 - protein, 11 aa, Homo Sapiens
YIDIADRSQVL

SEQ ID NO: 156492 - protein, 11 aa, Homo Sapiens
YLDCGDLSNAL

SEQ ID NO: 156493 - protein, 11 aa, Homo Sapiens
YLDLDSKVRTL

SEQ ID NO: 156494 - protein, 11 aa, Homo Sapiens
YSDELQSVISH

SEQ ID NO: 156495 - protein, 11 aa, Homo Sapiens
YSDFDLLNNSL

SEQ ID NO: 156496 - protein, 11 aa, Homo Sapiens
YSDPGLAGVSL

SEQ ID NO: 156497 - protein, 11 aa, Homo Sapiens
YTDVGEKGSQL

SEQ ID NO: 156498 - protein, 11 aa, Homo Sapiens
YVDDIEKGHTL

SEQ ID NO: 156499 - protein, 11 aa, Homo Sapiens
YVDLLKLEDVL

SEQ ID NO: 156500 - protein, 8 aa, Homo Sapiens
AAAVGAVF

SEQ ID NO: 156501 - protein, 8 aa, Homo Sapiens
AAGKPRVL

SEQ ID NO: 156502 - protein, 8 aa, Homo Sapiens
AASVRPVL

SEQ ID NO: 156503 - protein, 8 aa, Homo Sapiens
ASYVSPVL

SEQ ID NO: 156504 - protein, 8 aa, Homo Sapiens
FAGAAREV

SEQ ID NO: 156505 - protein, 8 aa, Homo Sapiens
FAYTGTEM

SEQ ID NO: 156506 - protein, 8 aa, Homo Sapiens
FSPVGSVL

SEQ ID NO: 156507 - protein, 8 aa, Homo Sapiens
FTYVAPSV

SEQ ID NO: 156508 - protein, 8 aa, Homo Sapiens
GKAPGTPH

SEQ ID NO: 156509 - protein, 8 aa, Homo Sapiens
HAGPIIVH

SEQ ID NO: 156510 - protein, 8 aa, Homo Sapiens
HTGPITCL

SEQ ID NO: 156511 - protein, 8 aa, Homo Sapiens
IQTAVTSY

SEQ ID NO: 156512 - protein, 8 aa, Homo Sapiens
LAFVSPSL

SEQ ID NO: 156513 - protein, 8 aa, Homo Sapiens
LAGPVQEV

SEQ ID NO: 156514 - protein, 8 aa, Homo Sapiens
LEALQPAL

SEQ ID NO: 156515 - protein, 8 aa, Homo Sapiens
LSKVSPSF

SEQ ID NO: 156516 - protein, 8 aa, Homo Sapiens
MAYNAPSL

SEQ ID NO: 156517 - protein, 8 aa, Homo Sapiens
MTGPISTH

SEQ ID NO: 156518 - protein, 8 aa, Homo Sapiens
NIDVSHPI

SEQ ID NO: 156519 - protein, 8 aa, Homo Sapiens
QALESHPL

SEQ ID NO: 156520 - protein, 8 aa, Homo Sapiens
SAGEPRVL

SEQ ID NO: 156521 - protein, 8 aa, Homo Sapiens
SAGPMRLY

SEQ ID NO: 156522 - protein, 8 aa, Homo Sapiens
SPVKPSMV

SEQ ID NO: 156523 - protein, 8 aa, Homo Sapiens
TVGPLVVY

SEQ ID NO: 156524 - protein, 8 aa, Homo Sapiens
VAKVGVSM

SEQ ID NO: 156525 - protein, 8 aa, Homo Sapiens
VAMNPVEH

SEQ ID NO: 156526 - protein, 8 aa, Homo Sapiens
VAQLAQEI

SEQ ID NO: 156527 - protein, 8 aa, Homo Sapiens
VAYEAPSL

SEQ ID NO: 156528 - protein, 8 aa, Homo Sapiens
VIHNLPVL

SEQ ID NO: 156529 - protein, 8 aa, Homo Sapiens
VIRDAVTY

SEQ ID NO: 156530 - protein, 8 aa, Homo Sapiens
VSPTGTAV

SEQ ID NO: 156531 - protein, 8 aa, Homo Sapiens
VSQVGKEL

SEQ ID NO: 156532 - protein, 8 aa, Homo Sapiens
VTHTVPIY

SEQ ID NO: 156533 - protein, 8 aa, Homo Sapiens
VVGPSSVL

SEQ ID NO: 156534 - protein, 8 aa, Homo Sapiens
YAAAAGVL

SEQ ID NO: 156535 - protein, 8 aa, Homo Sapiens
YAAFVQTH

SEQ ID NO: 156536 - protein, 8 aa, Homo Sapiens
YSGHYIAH

SEQ ID NO: 156537 - protein, 9 aa, Homo Sapiens
AAAAAAAAI

SEQ ID NO: 156538 - protein, 9 aa, Homo Sapiens
AAAAAAATM

SEQ ID NO: 156539 - protein, 9 aa, Homo Sapiens
AAAAAQSVY

SEQ ID NO: 156540 - protein, 9 aa, Homo Sapiens
AAAAGLAVY

SEQ ID NO: 156541 - protein, 9 aa, Homo Sapiens
AAAALPTLY

SEQ ID NO: 156542 - protein, 9 aa, Homo Sapiens
AAAAPRAVA

SEQ ID NO: 156543 - protein, 9 aa, Homo Sapiens
AAAAVGGAL

SEQ ID NO: 156544 - protein, 9 aa, Homo Sapiens
AAAAVGLAL

SEQ ID NO: 156545 - protein, 9 aa, Homo Sapiens
AAADHHSLY

SEQ ID NO: 156546 - protein, 9 aa, Homo Sapiens
AAADITSSL

SEQ ID NO: 156547 - protein, 9 aa, Homo Sapiens
AAADPKVAF

SEQ ID NO: 156548 - protein, 9 aa, Homo Sapiens
AAAEIYEEF

SEQ ID NO: 156549 - protein, 9 aa, Homo Sapiens
AAAEVAGQF

SEQ ID NO: 156550 - protein, 9 aa, Homo Sapiens
AAAEVLQVY

SEQ ID NO: 156551 - protein, 9 aa, Homo Sapiens
AAAGGLHEF

SEQ ID NO: 156552 - protein, 9 aa, Homo Sapiens
AAAGPGAAL

SEQ ID NO: 156553 - protein, 9 aa, Homo Sapiens
AAAGPGEVL

SEQ ID NO: 156554 - protein, 9 aa, Homo Sapiens
AAAGVFALL

SEQ ID NO: 156555 - protein, 9 aa, Homo Sapiens
AAAHCAHVF

SEQ ID NO: 156556 - protein, 9 aa, Homo Sapiens
AAAHTHPVY

SEQ ID NO: 156557 - protein, 9 aa, Homo Sapiens
AAAKIQASF

SEQ ID NO: 156558 - protein, 9 aa, Homo Sapiens
AAALPSNSF

SEQ ID NO: 156559 - protein, 9 aa, Homo Sapiens
AAANAIRVY

SEQ ID NO: 156560 - protein, 9 aa, Homo Sapiens
AAANPTLAF

SEQ ID NO: 156561 - protein, 9 aa, Homo Sapiens
AAAPAGTTF

SEQ ID NO: 156562 - protein, 9 aa, Homo Sapiens
AAAPAPASV

SEQ ID NO: 156563 - protein, 9 aa, Homo Sapiens
AAAPASGEM

SEQ ID NO: 156564 - protein, 9 aa, Homo Sapiens
AAAPIISSV

SEQ ID NO: 156565 - protein, 9 aa, Homo Sapiens
AAAPPAKEI

SEQ ID NO: 156566 - protein, 9 aa, Homo Sapiens
AAAPPALCY

SEQ ID NO: 156567 - protein, 9 aa, Homo Sapiens
AAARPKSAF

SEQ ID NO: 156568 - protein, 9 aa, Homo Sapiens
AAASAFTSL

SEQ ID NO: 156569 - protein, 9 aa, Homo Sapiens
AAASIANIV

SEQ ID NO: 156570 - protein, 9 aa, Homo Sapiens
AAASKLGEF

SEQ ID NO: 156571 - protein, 9 aa, Homo Sapiens
AAATGGSVL

SEQ ID NO: 156572 - protein, 9 aa, Homo Sapiens
AAATGLHPA

SEQ ID NO: 156573 - protein, 9 aa, Homo Sapiens
AAATRTTSF

SEQ ID NO: 156574 - protein, 9 aa, Homo Sapiens
AAATYILEA

SEQ ID NO: 156575 - protein, 9 aa, Homo Sapiens
AAAVPRAAF

SEQ ID NO: 156576 - protein, 9 aa, Homo Sapiens
AAAVPTRSY

SEQ ID NO: 156577 - protein, 9 aa, Homo Sapiens
AACDLVQRF

SEQ ID NO: 156578 - protein, 9 aa, Homo Sapiens
AAFADALEF

SEQ ID NO: 156579 - protein, 9 aa, Homo Sapiens
AAFAGGTSL

SEQ ID NO: 156580 - protein, 9 aa, Homo Sapiens
AAFAYTVKY

SEQ ID NO: 156581 - protein, 9 aa, Homo Sapiens
AAFCKLIVY

SEQ ID NO: 156582 - protein, 9 aa, Homo Sapiens
AAFDFPTSF

SEQ ID NO: 156583 - protein, 9 aa, Homo Sapiens
AAFDHICTF

SEQ ID NO: 156584 - protein, 9 aa, Homo Sapiens
AAFFTGQIF

SEQ ID NO: 156585 - protein, 9 aa, Homo Sapiens
AAFPGASLY

SEQ ID NO: 156586 - protein, 9 aa, Homo Sapiens
AAFPIAVVA

SEQ ID NO: 156587 - protein, 9 aa, Homo Sapiens
AAFPLPVVV

SEQ ID NO: 156588 - protein, 9 aa, Homo Sapiens
AAFPMASSF

SEQ ID NO: 156589 - protein, 9 aa, Homo Sapiens
AAFPYGGVL

SEQ ID NO: 156590 - protein, 9 aa, Homo Sapiens
AAGEPGTSM

SEQ ID NO: 156591 - protein, 9 aa, Homo Sapiens
AAGPTGMFF

SEQ ID NO: 156592 - protein, 9 aa, Homo Sapiens
AAGPVGMAA

SEQ ID NO: 156593 - protein, 9 aa, Homo Sapiens
AAHLPTQPH

SEQ ID NO: 156594 - protein, 9 aa, Homo Sapiens
AAHTVTAAY

SEQ ID NO: 156595 - protein, 9 aa, Homo Sapiens
AAHVAGAAY

SEQ ID NO: 156596 - protein, 9 aa, Homo Sapiens
AAIEASQSL

SEQ ID NO: 156597 - protein, 9 aa, Homo Sapiens
AAIEFISKM

SEQ ID NO: 156598 - protein, 9 aa, Homo Sapiens
AAIHCGHTF

SEQ ID NO: 156599 - protein, 9 aa, Homo Sapiens
AAIKPGTPL

SEQ ID NO: 156600 - protein, 9 aa, Homo Sapiens
AAINFQPKM

SEQ ID NO: 156601 - protein, 9 aa, Homo Sapiens
AAISHGRVF

SEQ ID NO: 156602 - protein, 9 aa, Homo Sapiens
AAITIQSSY

SEQ ID NO: 156603 - protein, 9 aa, Homo Sapiens
AAIWQYESL

SEQ ID NO: 156604 - protein, 9 aa, Homo Sapiens
AAIYHVLHF

SEQ ID NO: 156605 - protein, 9 aa, Homo Sapiens
AAKAAGVSF

SEQ ID NO: 156606 - protein, 9 aa, Homo Sapiens
AAKAALEEF

SEQ ID NO: 156607 - protein, 9 aa, Homo Sapiens
AAKAVANTM

SEQ ID NO: 156608 - protein, 9 aa, Homo Sapiens
AAKCALAYF

SEQ ID NO: 156609 - protein, 9 aa, Homo Sapiens
AAKDHTVVL

SEQ ID NO: 156610 - protein, 9 aa, Homo Sapiens
AAKDKLSEL

SEQ ID NO: 156611 - protein, 9 aa, Homo Sapiens
AAKDKLTEL

SEQ ID NO: 156612 - protein, 9 aa, Homo Sapiens
AAKDPSPSV

SEQ ID NO: 156613 - protein, 9 aa, Homo Sapiens
AAKDYNQKL

SEQ ID NO: 156614 - protein, 9 aa, Homo Sapiens
AAKFKTPEL

SEQ ID NO: 156615 - protein, 9 aa, Homo Sapiens
AAKPPPLSA

SEQ ID NO: 156616 - protein, 9 aa, Homo Sapiens
AAKSFSHSF

SEQ ID NO: 156617 - protein, 9 aa, Homo Sapiens
AAKSKIAHL

SEQ ID NO: 156618 - protein, 9 aa, Homo Sapiens
AAKSPSAQL

SEQ ID NO: 156619 - protein, 9 aa, Homo Sapiens
AAMDYHWVF

SEQ ID NO: 156620 - protein, 9 aa, Homo Sapiens
AAMLDTVVF

SEQ ID NO: 156621 - protein, 9 aa, Homo Sapiens
AAMLKIAEM

SEQ ID NO: 156622 - protein, 9 aa, Homo Sapiens
AAMPRPVSY

SEQ ID NO: 156623 - protein, 9 aa, Homo Sapiens
AAMPVAQHL

SEQ ID NO: 156624 - protein, 9 aa, Homo Sapiens
AANPHSFVF

SEQ ID NO: 156625 - protein, 9 aa, Homo Sapiens
AAPAYSRAL

SEQ ID NO: 156626 - protein, 9 aa, Homo Sapiens
AAPDGTRNL

SEQ ID NO: 156627 - protein, 9 aa, Homo Sapiens
AAPEGAGAL

SEQ ID NO: 156628 - protein, 9 aa, Homo Sapiens
AAPTAQKSL

SEQ ID NO: 156629 - protein, 9 aa, Homo Sapiens
AAPTSAAAL

SEQ ID NO: 156630 - protein, 9 aa, Homo Sapiens
AAPVATGAV

SEQ ID NO: 156631 - protein, 9 aa, Homo Sapiens
AAPVPTTTL

SEQ ID NO: 156632 - protein, 9 aa, Homo Sapiens
AAQMPTVHY

SEQ ID NO: 156633 - protein, 9 aa, Homo Sapiens
AAQSFYQTY

SEQ ID NO: 156634 - protein, 9 aa, Homo Sapiens
AAQTVGNTY

SEQ ID NO: 156635 - protein, 9 aa, Homo Sapiens
AARAALRVY

SEQ ID NO: 156636 - protein, 9 aa, Homo Sapiens
AARDFLQTF

SEQ ID NO: 156637 - protein, 9 aa, Homo Sapiens
AARLVLENY

SEQ ID NO: 156638 - protein, 9 aa, Homo Sapiens
AARNVPVGF

SEQ ID NO: 156639 - protein, 9 aa, Homo Sapiens
AARPATSTL

SEQ ID NO: 156640 - protein, 9 aa, Homo Sapiens
AARSGPLAM

SEQ ID NO: 156641 - protein, 9 aa, Homo Sapiens
AARVIIEKY

SEQ ID NO: 156642 - protein, 9 aa, Homo Sapiens
AARVPGVEH

SEQ ID NO: 156643 - protein, 9 aa, Homo Sapiens
AARYPQITF

SEQ ID NO: 156644 - protein, 9 aa, Homo Sapiens
AASPIITLV

SEQ ID NO: 156645 - protein, 9 aa, Homo Sapiens
AASPVVAEY

SEQ ID NO: 156646 - protein, 9 aa, Homo Sapiens
AASPVVSSM

SEQ ID NO: 156647 - protein, 9 aa, Homo Sapiens
AASSIYSMY

SEQ ID NO: 156648 - protein, 9 aa, Homo Sapiens
AASTAIYVY

SEQ ID NO: 156649 - protein, 9 aa, Homo Sapiens
AATCNHTVM

SEQ ID NO: 156650 - protein, 9 aa, Homo Sapiens
AATDITSSL

SEQ ID NO: 156651 - protein, 9 aa, Homo Sapiens
AATGATPIA

SEQ ID NO: 156652 - protein, 9 aa, Homo Sapiens
AATGHTVVL

SEQ ID NO: 156653 - protein, 9 aa, Homo Sapiens
AAVAAAAYY

SEQ ID NO: 156654 - protein, 9 aa, Homo Sapiens
AAVAPGHPL

SEQ ID NO: 156655 - protein, 9 aa, Homo Sapiens
AAVDAGMAM

SEQ ID NO: 156656 - protein, 9 aa, Homo Sapiens
AAVDRTTEL

SEQ ID NO: 156657 - protein, 9 aa, Homo Sapiens
AAVEDLHHY

SEQ ID NO: 156658 - protein, 9 aa, Homo Sapiens
AAVELWQHF

SEQ ID NO: 156659 - protein, 9 aa, Homo Sapiens
AAVGHVLVV

SEQ ID NO: 156660 - protein, 9 aa, Homo Sapiens
AAVGTGSSY

SEQ ID NO: 156661 - protein, 9 aa, Homo Sapiens
AAVIIQTHF

SEQ ID NO: 156662 - protein, 9 aa, Homo Sapiens
AAVNHISQL

SEQ ID NO: 156663 - protein, 9 aa, Homo Sapiens
AAVPEVAVY

SEQ ID NO: 156664 - protein, 9 aa, Homo Sapiens
AAVSFISKF

SEQ ID NO: 156665 - protein, 9 aa, Homo Sapiens
AAYGYKITE

SEQ ID NO: 156666 - protein, 9 aa, Homo Sapiens
AAYLPKNTH

SEQ ID NO: 156667 - protein, 9 aa, Homo Sapiens
AAYPNSSLF

SEQ ID NO: 156668 - protein, 9 aa, Homo Sapiens
AAYYHPSYL

SEQ ID NO: 156669 - protein, 9 aa, Homo Sapiens
AFAAAAAAA

SEQ ID NO: 156670 - protein, 9 aa, Homo Sapiens
AGMPITEVF

SEQ ID NO: 156671 - protein, 9 aa, Homo Sapiens
AIAAAAAAA

SEQ ID NO: 156672 - protein, 9 aa, Homo Sapiens
AIDVILEGY

SEQ ID NO: 156673 - protein, 9 aa, Homo Sapiens
AIFRPGTSF

SEQ ID NO: 156674 - protein, 9 aa, Homo Sapiens
AIIADSSTF

SEQ ID NO: 156675 - protein, 9 aa, Homo Sapiens
AIIDILTHY

SEQ ID NO: 156676 - protein, 9 aa, Homo Sapiens
AIIDTVINY

SEQ ID NO: 156677 - protein, 9 aa, Homo Sapiens
AIIENLKYF

SEQ ID NO: 156678 - protein, 9 aa, Homo Sapiens
AIIERTASF

SEQ ID NO: 156679 - protein, 9 aa, Homo Sapiens
AIIHGLSSL

SEQ ID NO: 156680 - protein, 9 aa, Homo Sapiens
AIINNCQTF

SEQ ID NO: 156681 - protein, 9 aa, Homo Sapiens
AIITPQTCY

SEQ ID NO: 156682 - protein, 9 aa, Homo Sapiens
AIKLVTAVF

SEQ ID NO: 156683 - protein, 9 aa, Homo Sapiens
AIPAFISLL

SEQ ID NO: 156684 - protein, 9 aa, Homo Sapiens
AIRDGVIEA

SEQ ID NO: 156685 - protein, 9 aa, Homo Sapiens
AIYGGSASY

SEQ ID NO: 156686 - protein, 9 aa, Homo Sapiens
ALAGPAAAL

SEQ ID NO: 156687 - protein, 9 aa, Homo Sapiens
ALPEFTSIF

SEQ ID NO: 156688 - protein, 9 aa, Homo Sapiens
AMYPHIFYF

SEQ ID NO: 156689 - protein, 9 aa, Homo Sapiens
AQGPTPRYF

SEQ ID NO: 156690 - protein, 9 aa, Homo Sapiens
AQISWVTVF

SEQ ID NO: 156691 - protein, 9 aa, Homo Sapiens
AQKNHIPVF

SEQ ID NO: 156692 - protein, 9 aa, Homo Sapiens
AQVPFEQIL

SEQ ID NO: 156693 - protein, 9 aa, Homo Sapiens
ASAPPGPPA

SEQ ID NO: 156694 - protein, 9 aa, Homo Sapiens
ASKEPPLYY

SEQ ID NO: 156695 - protein, 9 aa, Homo Sapiens
ASPSSIRSL

SEQ ID NO: 156696 - protein, 9 aa, Homo Sapiens
ASSPLITVF

SEQ ID NO: 156697 - protein, 9 aa, Homo Sapiens
ASVPAALAS

SEQ ID NO: 156698 - protein, 9 aa, Homo Sapiens
ATAAAAAAY

SEQ ID NO: 156699 - protein, 9 aa, Homo Sapiens
AVAAVVPAM

SEQ ID NO: 156700 - protein, 9 aa, Homo Sapiens
AVAPPGCSH

SEQ ID NO: 156701 - protein, 9 aa, Homo Sapiens
AVHDITVAY

SEQ ID NO: 156702 - protein, 9 aa, Homo Sapiens
AVIAPKSSY

SEQ ID NO: 156703 - protein, 9 aa, Homo Sapiens
AVLASGATF

SEQ ID NO: 156704 - protein, 9 aa, Homo Sapiens
AVNALQSVY

SEQ ID NO: 156705 - protein, 9 aa, Homo Sapiens
AVRENIEEF

SEQ ID NO: 156706 - protein, 9 aa, Homo Sapiens
AVRIPGGPA

SEQ ID NO: 156707 - protein, 9 aa, Homo Sapiens
AVYEHPSIL

SEQ ID NO: 156708 - protein, 9 aa, Homo Sapiens
CAAAPGAHY

SEQ ID NO: 156709 - protein, 9 aa, Homo Sapiens
CAAPILDKV

SEQ ID NO: 156710 - protein, 9 aa, Homo Sapiens
CAGPAYSSY

SEQ ID NO: 156711 - protein, 9 aa, Homo Sapiens
CAIAQAESL

SEQ ID NO: 156712 - protein, 9 aa, Homo Sapiens
CSFPFKYTY

SEQ ID NO: 156713 - protein, 9 aa, Homo Sapiens
CSSPIVVKF

SEQ ID NO: 156714 - protein, 9 aa, Homo Sapiens
CTYGKPVTF

SEQ ID NO: 156715 - protein, 9 aa, Homo Sapiens
EAIIPGSVY

SEQ ID NO: 156716 - protein, 9 aa, Homo Sapiens
EGGQLASCF

SEQ ID NO: 156717 - protein, 9 aa, Homo Sapiens
EVKRPGESL

SEQ ID NO: 156718 - protein, 9 aa, Homo Sapiens
FAAASREVL

SEQ ID NO: 156719 - protein, 9 aa, Homo Sapiens
FAADIISVL

SEQ ID NO: 156720 - protein, 9 aa, Homo Sapiens
FAAHLRCTY

SEQ ID NO: 156721 - protein, 9 aa, Homo Sapiens
FAAIGSAVF

SEQ ID NO: 156722 - protein, 9 aa, Homo Sapiens
FAANVYEAF

SEQ ID NO: 156723 - protein, 9 aa, Homo Sapiens
FAATLEQVY

SEQ ID NO: 156724 - protein, 9 aa, Homo Sapiens
FAFDPSVNY

SEQ ID NO: 156725 - protein, 9 aa, Homo Sapiens
FAFEHSEEY

SEQ ID NO: 156726 - protein, 9 aa, Homo Sapiens
FAFLTGVGL

SEQ ID NO: 156727 - protein, 9 aa, Homo Sapiens
FAFVTDNTY

SEQ ID NO: 156728 - protein, 9 aa, Homo Sapiens
FAHLINVEF

SEQ ID NO: 156729 - protein, 9 aa, Homo Sapiens
FAHLPKSTF

SEQ ID NO: 156730 - protein, 9 aa, Homo Sapiens
FAHPPRVCH

SEQ ID NO: 156731 - protein, 9 aa, Homo Sapiens
FAIPLIEKL

SEQ ID NO: 156732 - protein, 9 aa, Homo Sapiens
FAIQRTTNF

SEQ ID NO: 156733 - protein, 9 aa, Homo Sapiens
FAKEVSHEM

SEQ ID NO: 156734 - protein, 9 aa, Homo Sapiens
FAKGTEITH

SEQ ID NO: 156735 - protein, 9 aa, Homo Sapiens
FAKPENIDL

SEQ ID NO: 156736 - protein, 9 aa, Homo Sapiens
FAKPFLASL

SEQ ID NO: 156737 - protein, 9 aa, Homo Sapiens
FAMEFVKYY

SEQ ID NO: 156738 - protein, 9 aa, Homo Sapiens
FANEPFADF

SEQ ID NO: 156739 - protein, 9 aa, Homo Sapiens
FANGHVNSV

SEQ ID NO: 156740 - protein, 9 aa, Homo Sapiens
FANLPNQVY

SEQ ID NO: 156741 - protein, 9 aa, Homo Sapiens
FAQDVGRMF

SEQ ID NO: 156742 - protein, 9 aa, Homo Sapiens
FAQEAISVL

SEQ ID NO: 156743 - protein, 9 aa, Homo Sapiens
FAQEALTVL

SEQ ID NO: 156744 - protein, 9 aa, Homo Sapiens
FAQTGIIVH

SEQ ID NO: 156745 - protein, 9 aa, Homo Sapiens
FARNKEIVH

SEQ ID NO: 156746 - protein, 9 aa, Homo Sapiens
FARSPGADL

SEQ ID NO: 156747 - protein, 9 aa, Homo Sapiens
FASEVSNVL

SEQ ID NO: 156748 - protein, 9 aa, Homo Sapiens
FASHVSPEV

SEQ ID NO: 156749 - protein, 9 aa, Homo Sapiens
FASIPGLEF

SEQ ID NO: 156750 - protein, 9 aa, Homo Sapiens
FASPMKSVV

SEQ ID NO: 156751 - protein, 9 aa, Homo Sapiens
FATEVRAVI

SEQ ID NO: 156752 - protein, 9 aa, Homo Sapiens
FATFPSSAF

SEQ ID NO: 156753 - protein, 9 aa, Homo Sapiens
FATHHSPEM

SEQ ID NO: 156754 - protein, 9 aa, Homo Sapiens
FATPPSSTY

SEQ ID NO: 156755 - protein, 9 aa, Homo Sapiens
FAVPHTYNY

SEQ ID NO: 156756 - protein, 9 aa, Homo Sapiens
FAVVPSTAT

SEQ ID NO: 156757 - protein, 9 aa, Homo Sapiens
FAYEGPMYL

SEQ ID NO: 156758 - protein, 9 aa, Homo Sapiens
FAYHYPYTY

SEQ ID NO: 156759 - protein, 9 aa, Homo Sapiens
FAYLGRLAH

SEQ ID NO: 156760 - protein, 9 aa, Homo Sapiens
FAYMPNNSL

SEQ ID NO: 156761 - protein, 9 aa, Homo Sapiens
FAYPAIRYL

SEQ ID NO: 156762 - protein, 9 aa, Homo Sapiens
FAYTVKYVL

SEQ ID NO: 156763 - protein, 9 aa, Homo Sapiens
FGADVVSKF

SEQ ID NO: 156764 - protein, 9 aa, Homo Sapiens
FGKAPGTPH

SEQ ID NO: 156765 - protein, 9 aa, Homo Sapiens
FGYDYPSVL

SEQ ID NO: 156766 - protein, 9 aa, Homo Sapiens
FGYPDPTYL

SEQ ID NO: 156767 - protein, 9 aa, Homo Sapiens
FIAPTGHSL

SEQ ID NO: 156768 - protein, 9 aa, Homo Sapiens
FIIPQIVKY

SEQ ID NO: 156769 - protein, 9 aa, Homo Sapiens
FIIQGLRSV

SEQ ID NO: 156770 - protein, 9 aa, Homo Sapiens
FIKASSMSH

SEQ ID NO: 156771 - protein, 9 aa, Homo Sapiens
FIKDGSSTY

SEQ ID NO: 156772 - protein, 9 aa, Homo Sapiens
FIKDRILVY

SEQ ID NO: 156773 - protein, 9 aa, Homo Sapiens
FIKEIGYTH

SEQ ID NO: 156774 - protein, 9 aa, Homo Sapiens
FIMGKTIEF

SEQ ID NO: 156775 - protein, 9 aa, Homo Sapiens
FINGDISSL

SEQ ID NO: 156776 - protein, 9 aa, Homo Sapiens
FINPKPITY

SEQ ID NO: 156777 - protein, 9 aa, Homo Sapiens
FIQTRGGTF

SEQ ID NO: 156778 - protein, 9 aa, Homo Sapiens
FIRVVGSEF

SEQ ID NO: 156779 - protein, 9 aa, Homo Sapiens
FIVDARPAM

SEQ ID NO: 156780 - protein, 9 aa, Homo Sapiens
FIYHLPQEF

SEQ ID NO: 156781 - protein, 9 aa, Homo Sapiens
FIYQNPHIF

SEQ ID NO: 156782 - protein, 9 aa, Homo Sapiens
FLAPLVTEY

SEQ ID NO: 156783 - protein, 9 aa, Homo Sapiens
FLAPPGAYY

SEQ ID NO: 156784 - protein, 9 aa, Homo Sapiens
FLFDGSPTY

SEQ ID NO: 156785 - protein, 9 aa, Homo Sapiens
FLIDRSPEY

SEQ ID NO: 156786 - protein, 9 aa, Homo Sapiens
FLKEIVETF

SEQ ID NO: 156787 - protein, 9 aa, Homo Sapiens
FLKEVVETF

SEQ ID NO: 156788 - protein, 9 aa, Homo Sapiens
FLRDKIASY

SEQ ID NO: 156789 - protein, 9 aa, Homo Sapiens
FLRDPARVF

SEQ ID NO: 156790 - protein, 9 aa, Homo Sapiens
FLREWVESM

SEQ ID NO: 156791 - protein, 9 aa, Homo Sapiens
FQAEIAQLM

SEQ ID NO: 156792 - protein, 9 aa, Homo Sapiens
FQAPTAKEM

SEQ ID NO: 156793 - protein, 9 aa, Homo Sapiens
FSAPLFLSH

SEQ ID NO: 156794 - protein, 9 aa, Homo Sapiens
FSCGVISTL

SEQ ID NO: 156795 - protein, 9 aa, Homo Sapiens
FSEPFHLIV

SEQ ID NO: 156796 - protein, 9 aa, Homo Sapiens
FSFDGPEIM

SEQ ID NO: 156797 - protein, 9 aa, Homo Sapiens
FSHIPEASF

SEQ ID NO: 156798 - protein, 9 aa, Homo Sapiens
FSIDSPDSL

SEQ ID NO: 156799 - protein, 9 aa, Homo Sapiens
FSKAKPSVL

SEQ ID NO: 156800 - protein, 9 aa, Homo Sapiens
FSKDIVENY

SEQ ID NO: 156801 - protein, 9 aa, Homo Sapiens
FSKPSSDTF

SEQ ID NO: 156802 - protein, 9 aa, Homo Sapiens
FSMYKPITY

SEQ ID NO: 156803 - protein, 9 aa, Homo Sapiens
FSNDIYSTY

SEQ ID NO: 156804 - protein, 9 aa, Homo Sapiens
FSNGHIKVL

SEQ ID NO: 156805 - protein, 9 aa, Homo Sapiens
FSNPYSIEY

SEQ ID NO: 156806 - protein, 9 aa, Homo Sapiens
FSQDHLVIY

SEQ ID NO: 156807 - protein, 9 aa, Homo Sapiens
FSSDLISIH

SEQ ID NO: 156808 - protein, 9 aa, Homo Sapiens
FSSDVTHEM

SEQ ID NO: 156809 - protein, 9 aa, Homo Sapiens
FSSPSTSTF

SEQ ID NO: 156810 - protein, 9 aa, Homo Sapiens
FSYAFPKEF

SEQ ID NO: 156811 - protein, 9 aa, Homo Sapiens
FSYQHAIEE

SEQ ID NO: 156812 - protein, 9 aa, Homo Sapiens
FTADVRSVL

SEQ ID NO: 156813 - protein, 9 aa, Homo Sapiens
FTFTPTVTY

SEQ ID NO: 156814 - protein, 9 aa, Homo Sapiens
FTHASPTLF

SEQ ID NO: 156815 - protein, 9 aa, Homo Sapiens
FTITKTVEY

SEQ ID NO: 156816 - protein, 9 aa, Homo Sapiens
FTKPPIAAH

SEQ ID NO: 156817 - protein, 9 aa, Homo Sapiens
FTLDNILSH

SEQ ID NO: 156818 - protein, 9 aa, Homo Sapiens
FTMPLHMTF

SEQ ID NO: 156819 - protein, 9 aa, Homo Sapiens
FTNKITSVH

SEQ ID NO: 156820 - protein, 9 aa, Homo Sapiens
FTRSINITH

SEQ ID NO: 156821 - protein, 9 aa, Homo Sapiens
FTVPHTHVF

SEQ ID NO: 156822 - protein, 9 aa, Homo Sapiens
FVITKPDVY

SEQ ID NO: 156823 - protein, 9 aa, Homo Sapiens
FVKDSGACF

SEQ ID NO: 156824 - protein, 9 aa, Homo Sapiens
FVKPAFEEF

SEQ ID NO: 156825 - protein, 9 aa, Homo Sapiens
FVKVVPTVY

SEQ ID NO: 156826 - protein, 9 aa, Homo Sapiens
FVNDYILYY

SEQ ID NO: 156827 - protein, 9 aa, Homo Sapiens
FVNPGVVEF

SEQ ID NO: 156828 - protein, 9 aa, Homo Sapiens
FVNPHVSSF

SEQ ID NO: 156829 - protein, 9 aa, Homo Sapiens
FVRDMIREV

SEQ ID NO: 156830 - protein, 9 aa, Homo Sapiens
FVRENVWTY

SEQ ID NO: 156831 - protein, 9 aa, Homo Sapiens
FVRNVPWEF

SEQ ID NO: 156832 - protein, 9 aa, Homo Sapiens
GALAPGTPA

SEQ ID NO: 156833 - protein, 9 aa, Homo Sapiens
GAPVAAAAL

SEQ ID NO: 156834 - protein, 9 aa, Homo Sapiens
GAVGFFTHY

SEQ ID NO: 156835 - protein, 9 aa, Homo Sapiens
GAVGFVTHY

SEQ ID NO: 156836 - protein, 9 aa, Homo Sapiens
GAYGQAVRY

SEQ ID NO: 156837 - protein, 9 aa, Homo Sapiens
GIIRPGTAF

SEQ ID NO: 156838 - protein, 9 aa, Homo Sapiens
GVGVGAAAV

SEQ ID NO: 156839 - protein, 9 aa, Homo Sapiens
GVKKPTKAL

SEQ ID NO: 156840 - protein, 9 aa, Homo Sapiens
HAAAPTSTL

SEQ ID NO: 156841 - protein, 9 aa, Homo Sapiens
HAAGFAYTY

SEQ ID NO: 156842 - protein, 9 aa, Homo Sapiens
HAAHIISEL

SEQ ID NO: 156843 - protein, 9 aa, Homo Sapiens
HAAPPAHPL

SEQ ID NO: 156844 - protein, 9 aa, Homo Sapiens
HACGVIATI

SEQ ID NO: 156845 - protein, 9 aa, Homo Sapiens
HAFVTEVAY

SEQ ID NO: 156846 - protein, 9 aa, Homo Sapiens
HAFWGGSVV

SEQ ID NO: 156847 - protein, 9 aa, Homo Sapiens
HAHLSQTTL

SEQ ID NO: 156848 - protein, 9 aa, Homo Sapiens
HAIPPTLAM

SEQ ID NO: 156849 - protein, 9 aa, Homo Sapiens
HAKPPTPSL

SEQ ID NO: 156850 - protein, 9 aa, Homo Sapiens
HAKTNISSY

SEQ ID NO: 156851 - protein, 9 aa, Homo Sapiens
HAMEKMEEF

SEQ ID NO: 156852 - protein, 9 aa, Homo Sapiens
HAMQFPAEL

SEQ ID NO: 156853 - protein, 9 aa, Homo Sapiens
HANDQTVIF

SEQ ID NO: 156854 - protein, 9 aa, Homo Sapiens
HANLTEVTF

SEQ ID NO: 156855 - protein, 9 aa, Homo Sapiens
HARGNLASY

SEQ ID NO: 156856 - protein, 9 aa, Homo Sapiens
HAVEISAVH

SEQ ID NO: 156857 - protein, 9 aa, Homo Sapiens
HAVEWPVVM

SEQ ID NO: 156858 - protein, 9 aa, Homo Sapiens
HAWSGGLDH

SEQ ID NO: 156859 - protein, 9 aa, Homo Sapiens
HAYPYPQMY

SEQ ID NO: 156860 - protein, 9 aa, Homo Sapiens
HGIDPTGTY

SEQ ID NO: 156861 - protein, 9 aa, Homo Sapiens
HIASFLSVF

SEQ ID NO: 156862 - protein, 9 aa, Homo Sapiens
HIIEDPCTL

SEQ ID NO: 156863 - protein, 9 aa, Homo Sapiens
HIITGVAVF

SEQ ID NO: 156864 - protein, 9 aa, Homo Sapiens
HIMEIFSTY

SEQ ID NO: 156865 - protein, 9 aa, Homo Sapiens
HINLMEVSY

SEQ ID NO: 156866 - protein, 9 aa, Homo Sapiens
HINSIKSVF

SEQ ID NO: 156867 - protein, 9 aa, Homo Sapiens
HIYDKTSVL

SEQ ID NO: 156868 - protein, 9 aa, Homo Sapiens
HLKDLIAVH

SEQ ID NO: 156869 - protein, 9 aa, Homo Sapiens
HLPSHIRIL

SEQ ID NO: 156870 - protein, 9 aa, Homo Sapiens
HSAGVGAIF

SEQ ID NO: 156871 - protein, 9 aa, Homo Sapiens
HSPGAVSSL

SEQ ID NO: 156872 - protein, 9 aa, Homo Sapiens
HTADISSHF

SEQ ID NO: 156873 - protein, 9 aa, Homo Sapiens
HTAMPGSVF

SEQ ID NO: 156874 - protein, 9 aa, Homo Sapiens
HTFLPKIFF

SEQ ID NO: 156875 - protein, 9 aa, Homo Sapiens
HTKLSLGSY

SEQ ID NO: 156876 - protein, 9 aa, Homo Sapiens
HVRDCVQTY

SEQ ID NO: 156877 - protein, 9 aa, Homo Sapiens
IAADILIKE

SEQ ID NO: 156878 - protein, 9 aa, Homo Sapiens
IAAGIFNDL

SEQ ID NO: 156879 - protein, 9 aa, Homo Sapiens
IAAPFTSKL

SEQ ID NO: 156880 - protein, 9 aa, Homo Sapiens
IAAPTSSAL

SEQ ID NO: 156881 - protein, 9 aa, Homo Sapiens
IAAVPATAM

SEQ ID NO: 156882 - protein, 9 aa, Homo Sapiens
IAFDPRSAY

SEQ ID NO: 156883 - protein, 9 aa, Homo Sapiens
IAFGFHQLY

SEQ ID NO: 156884 - protein, 9 aa, Homo Sapiens
IAFPKAEEL

SEQ ID NO: 156885 - protein, 9 aa, Homo Sapiens
IAFPTSISV

SEQ ID NO: 156886 - protein, 9 aa, Homo Sapiens
IAFSRPVKY

SEQ ID NO: 156887 - protein, 9 aa, Homo Sapiens
IAHDTGTSL

SEQ ID NO: 156888 - protein, 9 aa, Homo Sapiens
IAHGFFSVY

SEQ ID NO: 156889 - protein, 9 aa, Homo Sapiens
IAIEPGAAL

SEQ ID NO: 156890 - protein, 9 aa, Homo Sapiens
IAIPVTVAF

SEQ ID NO: 156891 - protein, 9 aa, Homo Sapiens
IAISLAQRY

SEQ ID NO: 156892 - protein, 9 aa, Homo Sapiens
IAISRTPVL

SEQ ID NO: 156893 - protein, 9 aa, Homo Sapiens
IAKAGIPVY

SEQ ID NO: 156894 - protein, 9 aa, Homo Sapiens
IAKATIEVF

SEQ ID NO: 156895 - protein, 9 aa, Homo Sapiens
IAKDEIGEF

SEQ ID NO: 156896 - protein, 9 aa, Homo Sapiens
IAKDVCTFL

SEQ ID NO: 156897 - protein, 9 aa, Homo Sapiens
IAKELSKTY

SEQ ID NO: 156898 - protein, 9 aa, Homo Sapiens
IAKENLDVF

SEQ ID NO: 156899 - protein, 9 aa, Homo Sapiens
IAKSGTKAF

SEQ ID NO: 156900 - protein, 9 aa, Homo Sapiens
IAKSGTSEF

SEQ ID NO: 156901 - protein, 9 aa, Homo Sapiens
IANENHSTL

SEQ ID NO: 156902 - protein, 9 aa, Homo Sapiens
IANMPASTF

SEQ ID NO: 156903 - protein, 9 aa, Homo Sapiens
IAPETRRSI

SEQ ID NO: 156904 - protein, 9 aa, Homo Sapiens
IAPTGHSLK

SEQ ID NO: 156905 - protein, 9 aa, Homo Sapiens
IASAIVNEL

SEQ ID NO: 156906 - protein, 9 aa, Homo Sapiens
IASDIVSRF

SEQ ID NO: 156907 - protein, 9 aa, Homo Sapiens
IASPVIAAV

SEQ ID NO: 156908 - protein, 9 aa, Homo Sapiens
IASPVQPVL

SEQ ID NO: 156909 - protein, 9 aa, Homo Sapiens
IAVGHIYFF

SEQ ID NO: 156910 - protein, 9 aa, Homo Sapiens
IAVGHIYYF

SEQ ID NO: 156911 - protein, 9 aa, Homo Sapiens
IAVGIMSYY

SEQ ID NO: 156912 - protein, 9 aa, Homo Sapiens
IAYEPQIGY

SEQ ID NO: 156913 - protein, 9 aa, Homo Sapiens
IAYSRPVYF

SEQ ID NO: 156914 - protein, 9 aa, Homo Sapiens
IGAPVGISL

SEQ ID NO: 156915 - protein, 9 aa, Homo Sapiens
IGKDVSTSY

SEQ ID NO: 156916 - protein, 9 aa, Homo Sapiens
IGVEHVVVY

SEQ ID NO: 156917 - protein, 9 aa, Homo Sapiens
IIAEPGRYY

SEQ ID NO: 156918 - protein, 9 aa, Homo Sapiens
IIHDLAQVY

SEQ ID NO: 156919 - protein, 9 aa, Homo Sapiens
IIHDPGRGA

SEQ ID NO: 156920 - protein, 9 aa, Homo Sapiens
IIIDKEYYY

SEQ ID NO: 156921 - protein, 9 aa, Homo Sapiens
IIKVGGERF

SEQ ID NO: 156922 - protein, 9 aa, Homo Sapiens
IINGKISFF

SEQ ID NO: 156923 - protein, 9 aa, Homo Sapiens
IIRKPVTVH

SEQ ID NO: 156924 - protein, 9 aa, Homo Sapiens
IISEPGSYY

SEQ ID NO: 156925 - protein, 9 aa, Homo Sapiens
IISSVIQKF

SEQ ID NO: 156926 - protein, 9 aa, Homo Sapiens
IKADHVSTY

SEQ ID NO: 156927 - protein, 9 aa, Homo Sapiens
ILGPPGSVY

SEQ ID NO: 156928 - protein, 9 aa, Homo Sapiens
IMKKIRESY

SEQ ID NO: 156929 - protein, 9 aa, Homo Sapiens
IQAGIFQEF

SEQ ID NO: 156930 - protein, 9 aa, Homo Sapiens
ISIGGLSSF

SEQ ID NO: 156931 - protein, 9 aa, Homo Sapiens
ISIGPGASF

SEQ ID NO: 156932 - protein, 9 aa, Homo Sapiens
ISKALVAYY

SEQ ID NO: 156933 - protein, 9 aa, Homo Sapiens
ISNLPAATF

SEQ ID NO: 156934 - protein, 9 aa, Homo Sapiens
ISPEFEPVF

SEQ ID NO: 156935 - protein, 9 aa, Homo Sapiens
ISPSHIWIF

SEQ ID NO: 156936 - protein, 9 aa, Homo Sapiens
ISRETGEPY

SEQ ID NO: 156937 - protein, 9 aa, Homo Sapiens
ISRWPLPEY

SEQ ID NO: 156938 - protein, 9 aa, Homo Sapiens
ISSPVVTSL

SEQ ID NO: 156939 - protein, 9 aa, Homo Sapiens
ISTPVIRTF

SEQ ID NO: 156940 - protein, 9 aa, Homo Sapiens
ITAPPGTAA

SEQ ID NO: 156941 - protein, 9 aa, Homo Sapiens
ITPEFISTF

SEQ ID NO: 156942 - protein, 9 aa, Homo Sapiens
IVAEPGAVL

SEQ ID NO: 156943 - protein, 9 aa, Homo Sapiens
IVIDPKNPL

SEQ ID NO: 156944 - protein, 9 aa, Homo Sapiens
IVKEMTEVF

SEQ ID NO: 156945 - protein, 9 aa, Homo Sapiens
IVKERGTVY

SEQ ID NO: 156946 - protein, 9 aa, Homo Sapiens
IVKKPGNIY

SEQ ID NO: 156947 - protein, 9 aa, Homo Sapiens
IVPGNVKSL

SEQ ID NO: 156948 - protein, 9 aa, Homo Sapiens
IVYPGIAVF

SEQ ID NO: 156949 - protein, 9 aa, Homo Sapiens
KAADIASKV

SEQ ID NO: 156950 - protein, 9 aa, Homo Sapiens
KAADIGVAM

SEQ ID NO: 156951 - protein, 9 aa, Homo Sapiens
KAAGFISVL

SEQ ID NO: 156952 - protein, 9 aa, Homo Sapiens
KAAGPSLSH

SEQ ID NO: 156953 - protein, 9 aa, Homo Sapiens
KAAHFFSTL

SEQ ID NO: 156954 - protein, 9 aa, Homo Sapiens
KAANAFHVY

SEQ ID NO: 156955 - protein, 9 aa, Homo Sapiens
KAANPGCSL

SEQ ID NO: 156956 - protein, 9 aa, Homo Sapiens
KAATVTGKL

SEQ ID NO: 156957 - protein, 9 aa, Homo Sapiens
KACDYIQEL

SEQ ID NO: 156958 - protein, 9 aa, Homo Sapiens
KAFDFPSSF

SEQ ID NO: 156959 - protein, 9 aa, Homo Sapiens
KAFDRPSLF

SEQ ID NO: 156960 - protein, 9 aa, Homo Sapiens
KAFDSPSVF

SEQ ID NO: 156961 - protein, 9 aa, Homo Sapiens
KAFDYPSRF

SEQ ID NO: 156962 - protein, 9 aa, Homo Sapiens
KAFGSKSTL

SEQ ID NO: 156963 - protein, 9 aa, Homo Sapiens
KAFIQKSHF

SEQ ID NO: 156964 - protein, 9 aa, Homo Sapiens
KAFNQSSTL

SEQ ID NO: 156965 - protein, 9 aa, Homo Sapiens
KAFNWPSTL

SEQ ID NO: 156966 - protein, 9 aa, Homo Sapiens
KAFPFHIIF

SEQ ID NO: 156967 - protein, 9 aa, Homo Sapiens
KAFPFYSSY

SEQ ID NO: 156968 - protein, 9 aa, Homo Sapiens
KAFPYSSHL

SEQ ID NO: 156969 - protein, 9 aa, Homo Sapiens
KAFQHPSHL

SEQ ID NO: 156970 - protein, 9 aa, Homo Sapiens
KAFQKIVVL

SEQ ID NO: 156971 - protein, 9 aa, Homo Sapiens
KAFSHGSSL

SEQ ID NO: 156972 - protein, 9 aa, Homo Sapiens
KAFSHSSTL

SEQ ID NO: 156973 - protein, 9 aa, Homo Sapiens
KAFSQSSTL

SEQ ID NO: 156974 - protein, 9 aa, Homo Sapiens
KAFSYPSKL

SEQ ID NO: 156975 - protein, 9 aa, Homo Sapiens
KAFTHYSTY

SEQ ID NO: 156976 - protein, 9 aa, Homo Sapiens
KAFTKSSTL

SEQ ID NO: 156977 - protein, 9 aa, Homo Sapiens
KAFVYPSVF

SEQ ID NO: 156978 - protein, 9 aa, Homo Sapiens
KAHGSPRVY

SEQ ID NO: 156979 - protein, 9 aa, Homo Sapiens
KAIATTVTY

SEQ ID NO: 156980 - protein, 9 aa, Homo Sapiens
KAIDFAASL

SEQ ID NO: 156981 - protein, 9 aa, Homo Sapiens
KAIELLQEF

SEQ ID NO: 156982 - protein, 9 aa, Homo Sapiens
KAINPINTF

SEQ ID NO: 156983 - protein, 9 aa, Homo Sapiens
KAISGVHTV

SEQ ID NO: 156984 - protein, 9 aa, Homo Sapiens
KAITFVTQY

SEQ ID NO: 156985 - protein, 9 aa, Homo Sapiens
KAKDGTHVL

SEQ ID NO: 156986 - protein, 9 aa, Homo Sapiens
KAKEIYMTF

SEQ ID NO: 156987 - protein, 9 aa, Homo Sapiens
KAKKIIETM

SEQ ID NO: 156988 - protein, 9 aa, Homo Sapiens
KAKNLIEVM

SEQ ID NO: 156989 - protein, 9 aa, Homo Sapiens
KAKPVTTNL

SEQ ID NO: 156990 - protein, 9 aa, Homo Sapiens
KAMEAASSL

SEQ ID NO: 156991 - protein, 9 aa, Homo Sapiens
KAMELIREL

SEQ ID NO: 156992 - protein, 9 aa, Homo Sapiens
KAMGIMNSF

SEQ ID NO: 156993 - protein, 9 aa, Homo Sapiens
KAMYPGTFY

SEQ ID NO: 156994 - protein, 9 aa, Homo Sapiens
KAPGSTSNL

SEQ ID NO: 156995 - protein, 9 aa, Homo Sapiens
KAPVTKVAA

SEQ ID NO: 156996 - protein, 9 aa, Homo Sapiens
KAQSVREVF

SEQ ID NO: 156997 - protein, 9 aa, Homo Sapiens
KAQVALTEY

SEQ ID NO: 156998 - protein, 9 aa, Homo Sapiens
KASGIIHSY

SEQ ID NO: 156999 - protein, 9 aa, Homo Sapiens
KASGTLREY

SEQ ID NO: 157000 - protein, 9 aa, Homo Sapiens
KASNPRTTF

SEQ ID NO: 157001 - protein, 9 aa, Homo Sapiens
KAVNPGRSL

SEQ ID NO: 157002 - protein, 9 aa, Homo Sapiens
KAVSLFLCY

SEQ ID NO: 157003 - protein, 9 aa, Homo Sapiens
KAYGASKTF

SEQ ID NO: 157004 - protein, 9 aa, Homo Sapiens
KAYPFPLSH

SEQ ID NO: 157005 - protein, 9 aa, Homo Sapiens
KIIDGLLVM

SEQ ID NO: 157006 - protein, 9 aa, Homo Sapiens
KIKNGTPPM

SEQ ID NO: 157007 - protein, 9 aa, Homo Sapiens
KIKPVSLTF

SEQ ID NO: 157008 - protein, 9 aa, Homo Sapiens
KIKTIGSTY

SEQ ID NO: 157009 - protein, 9 aa, Homo Sapiens
KIRDLLPVM

SEQ ID NO: 157010 - protein, 9 aa, Homo Sapiens
KIRPHIATL

SEQ ID NO: 157011 - protein, 9 aa, Homo Sapiens
KLPDFESRY

SEQ ID NO: 157012 - protein, 9 aa, Homo Sapiens
KLPDIFSVY

SEQ ID NO: 157013 - protein, 9 aa, Homo Sapiens
KQAEIVKRL

SEQ ID NO: 157014 - protein, 9 aa, Homo Sapiens
KQFHRIVTY

SEQ ID NO: 157015 - protein, 9 aa, Homo Sapiens
KQFPEVIKY

SEQ ID NO: 157016 - protein, 9 aa, Homo Sapiens
KSFPGGKEY

SEQ ID NO: 157017 - protein, 9 aa, Homo Sapiens
KSIHIVVTM

SEQ ID NO: 157018 - protein, 9 aa, Homo Sapiens
KSKNPGEAL

SEQ ID NO: 157019 - protein, 9 aa, Homo Sapiens
KSMFQRTTY

SEQ ID NO: 157020 - protein, 9 aa, Homo Sapiens
KSNELFTTF

SEQ ID NO: 157021 - protein, 9 aa, Homo Sapiens
KSPSHVWIF

SEQ ID NO: 157022 - protein, 9 aa, Homo Sapiens
KSSEVFTTF

SEQ ID NO: 157023 - protein, 9 aa, Homo Sapiens
KSVDWLLVF

SEQ ID NO: 157024 - protein, 9 aa, Homo Sapiens
KSVRPGASY

SEQ ID NO: 157025 - protein, 9 aa, Homo Sapiens
KTFDHYCEY

SEQ ID NO: 157026 - protein, 9 aa, Homo Sapiens
KTGPVAKEL

SEQ ID NO: 157027 - protein, 9 aa, Homo Sapiens
KTKDPTAAL

SEQ ID NO: 157028 - protein, 9 aa, Homo Sapiens
KTPDFILQV

SEQ ID NO: 157029 - protein, 9 aa, Homo Sapiens
KTQKPSKPF

SEQ ID NO: 157030 - protein, 9 aa, Homo Sapiens
KTRIPPRTY

SEQ ID NO: 157031 - protein, 9 aa, Homo Sapiens
KVADPVVTF

SEQ ID NO: 157032 - protein, 9 aa, Homo Sapiens
KVAQPKEVY

SEQ ID NO: 157033 - protein, 9 aa, Homo Sapiens
KVFNIPSSF

SEQ ID NO: 157034 - protein, 9 aa, Homo Sapiens
LAADCAHEL

SEQ ID NO: 157035 - protein, 9 aa, Homo Sapiens
LAADIFAIA

SEQ ID NO: 157036 - protein, 9 aa, Homo Sapiens
LAAPVISVL

SEQ ID NO: 157037 - protein, 9 aa, Homo Sapiens
LAASASAEF

SEQ ID NO: 157038 - protein, 9 aa, Homo Sapiens
LAFEWLGHF

SEQ ID NO: 157039 - protein, 9 aa, Homo Sapiens
LAFPGEMLL

SEQ ID NO: 157040 - protein, 9 aa, Homo Sapiens
LAFPTGCSL

SEQ ID NO: 157041 - protein, 9 aa, Homo Sapiens
LAFSRLIVE

SEQ ID NO: 157042 - protein, 9 aa, Homo Sapiens
LAGQATTAY

SEQ ID NO: 157043 - protein, 9 aa, Homo Sapiens
LAHEVGWKY

SEQ ID NO: 157044 - protein, 9 aa, Homo Sapiens
LAIEHVRFF

SEQ ID NO: 157045 - protein, 9 aa, Homo Sapiens
LAINHAYFY

SEQ ID NO: 157046 - protein, 9 aa, Homo Sapiens
LAIPITNTY

SEQ ID NO: 157047 - protein, 9 aa, Homo Sapiens
LAKAPFAAH

SEQ ID NO: 157048 - protein, 9 aa, Homo Sapiens
LAKASGNTL

SEQ ID NO: 157049 - protein, 9 aa, Homo Sapiens
LAKEVGTSY

SEQ ID NO: 157050 - protein, 9 aa, Homo Sapiens
LAKGEVTEM

SEQ ID NO: 157051 - protein, 9 aa, Homo Sapiens
LAKGGTVEY

SEQ ID NO: 157052 - protein, 9 aa, Homo Sapiens
LAKGWAPTF

SEQ ID NO: 157053 - protein, 9 aa, Homo Sapiens
LAKTGVHHY

SEQ ID NO: 157054 - protein, 9 aa, Homo Sapiens
LAKTQGNVF

SEQ ID NO: 157055 - protein, 9 aa, Homo Sapiens
LALEPGVAY

SEQ ID NO: 157056 - protein, 9 aa, Homo Sapiens
LANKLITVY

SEQ ID NO: 157057 - protein, 9 aa, Homo Sapiens
LAQTTRTAY

SEQ ID NO: 157058 - protein, 9 aa, Homo Sapiens
LARCSIVSY

SEQ ID NO: 157059 - protein, 9 aa, Homo Sapiens
LARDFLDEY

SEQ ID NO: 157060 - protein, 9 aa, Homo Sapiens
LARIIDSEY

SEQ ID NO: 157061 - protein, 9 aa, Homo Sapiens
LARPLPVEY

SEQ ID NO: 157062 - protein, 9 aa, Homo Sapiens
LARTAGTSF

SEQ ID NO: 157063 - protein, 9 aa, Homo Sapiens
LASAVISVL

SEQ ID NO: 157064 - protein, 9 aa, Homo Sapiens
LASEIYDIL

SEQ ID NO: 157065 - protein, 9 aa, Homo Sapiens
LASELIQVH

SEQ ID NO: 157066 - protein, 9 aa, Homo Sapiens
LASPIYTHF

SEQ ID NO: 157067 - protein, 9 aa, Homo Sapiens
LASPVSPEL

SEQ ID NO: 157068 - protein, 9 aa, Homo Sapiens
LATEVVTVF

SEQ ID NO: 157069 - protein, 9 aa, Homo Sapiens
LAVGLTSCF

SEQ ID NO: 157070 - protein, 9 aa, Homo Sapiens
LIHVPLETF

SEQ ID NO: 157071 - protein, 9 aa, Homo Sapiens
LIKETTTGY

SEQ ID NO: 157072 - protein, 9 aa, Homo Sapiens
LIKRNKQTY

SEQ ID NO: 157073 - protein, 9 aa, Homo Sapiens
LIRDNRVVY

SEQ ID NO: 157074 - protein, 9 aa, Homo Sapiens
LIREYIVEY

SEQ ID NO: 157075 - protein, 9 aa, Homo Sapiens
LIRPVSASF

SEQ ID NO: 157076 - protein, 9 aa, Homo Sapiens
LLKSPGACF

SEQ ID NO: 157077 - protein, 9 aa, Homo Sapiens
LMMGHPGMH

SEQ ID NO: 157078 - protein, 9 aa, Homo Sapiens
LQAESIVVH

SEQ ID NO: 157079 - protein, 9 aa, Homo Sapiens
LQIGVIRVY

SEQ ID NO: 157080 - protein, 9 aa, Homo Sapiens
LSADPRSVY

SEQ ID NO: 157081 - protein, 9 aa, Homo Sapiens
LSAPIHTQM

SEQ ID NO: 157082 - protein, 9 aa, Homo Sapiens
LSFLIPSSL

SEQ ID NO: 157083 - protein, 9 aa, Homo Sapiens
LSFPTTKTY

SEQ ID NO: 157084 - protein, 9 aa, Homo Sapiens
LSHLPSHHY

SEQ ID NO: 157085 - protein, 9 aa, Homo Sapiens
LSKDDIENM

SEQ ID NO: 157086 - protein, 9 aa, Homo Sapiens
LSKGPGLEV

SEQ ID NO: 157087 - protein, 9 aa, Homo Sapiens
LSKLPCGEY

SEQ ID NO: 157088 - protein, 9 aa, Homo Sapiens
LSPTPATAL

SEQ ID NO: 157089 - protein, 9 aa, Homo Sapiens
LTFPHPVYY

SEQ ID NO: 157090 - protein, 9 aa, Homo Sapiens
LTNLPHTDF

SEQ ID NO: 157091 - protein, 9 aa, Homo Sapiens
LTRDTIASH

SEQ ID NO: 157092 - protein, 9 aa, Homo Sapiens
LVKEVPEEY

SEQ ID NO: 157093 - protein, 9 aa, Homo Sapiens
MAADVSVTH

SEQ ID NO: 157094 - protein, 9 aa, Homo Sapiens
MAAEIKTEY

SEQ ID NO: 157095 - protein, 9 aa, Homo Sapiens
MAAMPQTVY

SEQ ID NO: 157096 - protein, 9 aa, Homo Sapiens
MAASIGTDF

SEQ ID NO: 157097 - protein, 9 aa, Homo Sapiens
MADPNIRFL

SEQ ID NO: 157098 - protein, 9 aa, Homo Sapiens
MAFDPTSTL

SEQ ID NO: 157099 - protein, 9 aa, Homo Sapiens
MAFSPNEKF

SEQ ID NO: 157100 - protein, 9 aa, Homo Sapiens
MAGDIYSVF

SEQ ID NO: 157101 - protein, 9 aa, Homo Sapiens
MAHQIQEMF

SEQ ID NO: 157102 - protein, 9 aa, Homo Sapiens
MAIANTRTH

SEQ ID NO: 157103 - protein, 9 aa, Homo Sapiens
MAIEAQQKF

SEQ ID NO: 157104 - protein, 9 aa, Homo Sapiens
MAKDNVPFH

SEQ ID NO: 157105 - protein, 9 aa, Homo Sapiens
MAKQEGMEM

SEQ ID NO: 157106 - protein, 9 aa, Homo Sapiens
MANGAVIHL

SEQ ID NO: 157107 - protein, 9 aa, Homo Sapiens
MANGEIHIY

SEQ ID NO: 157108 - protein, 9 aa, Homo Sapiens
MAPLKMLAL

SEQ ID NO: 157109 - protein, 9 aa, Homo Sapiens
MAQEVLTHL

SEQ ID NO: 157110 - protein, 9 aa, Homo Sapiens
MARSPGRAY

SEQ ID NO: 157111 - protein, 9 aa, Homo Sapiens
MGFSGIVVH

SEQ ID NO: 157112 - protein, 9 aa, Homo Sapiens
MGRDPGVSF

SEQ ID NO: 157113 - protein, 9 aa, Homo Sapiens
MIISPGRYF

SEQ ID NO: 157114 - protein, 9 aa, Homo Sapiens
MSKAPSNTF

SEQ ID NO: 157115 - protein, 9 aa, Homo Sapiens
MTKKPGMFF

SEQ ID NO: 157116 - protein, 9 aa, Homo Sapiens
MVVEERCVY

SEQ ID NO: 157117 - protein, 9 aa, Homo Sapiens
NAAAIYDLL

SEQ ID NO: 157118 - protein, 9 aa, Homo Sapiens
NAAERRGPL

SEQ ID NO: 157119 - protein, 9 aa, Homo Sapiens
NAAPPPVTY

SEQ ID NO: 157120 - protein, 9 aa, Homo Sapiens
NAAQIFAIY

SEQ ID NO: 157121 - protein, 9 aa, Homo Sapiens
NAFHHPSAV

SEQ ID NO: 157122 - protein, 9 aa, Homo Sapiens
NAFKEITTM

SEQ ID NO: 157123 - protein, 9 aa, Homo Sapiens
NAFPVGSEY

SEQ ID NO: 157124 - protein, 9 aa, Homo Sapiens
NAFSGVMML

SEQ ID NO: 157125 - protein, 9 aa, Homo Sapiens
NAHYPKQSF

SEQ ID NO: 157126 - protein, 9 aa, Homo Sapiens
NAIEGLTEY

SEQ ID NO: 157127 - protein, 9 aa, Homo Sapiens
NAIGVAATM

SEQ ID NO: 157128 - protein, 9 aa, Homo Sapiens
NAIKASLPH

SEQ ID NO: 157129 - protein, 9 aa, Homo Sapiens
NAINITSAL

SEQ ID NO: 157130 - protein, 9 aa, Homo Sapiens
NAIQTMCPH

SEQ ID NO: 157131 - protein, 9 aa, Homo Sapiens
NAISGPNEF

SEQ ID NO: 157132 - protein, 9 aa, Homo Sapiens
NAISVTTSY

SEQ ID NO: 157133 - protein, 9 aa, Homo Sapiens
NAITLPEEF

SEQ ID NO: 157134 - protein, 9 aa, Homo Sapiens
NAKAQTPIF

SEQ ID NO: 157135 - protein, 9 aa, Homo Sapiens
NAKCPNLEF

SEQ ID NO: 157136 - protein, 9 aa, Homo Sapiens
NAKGYTIPL

SEQ ID NO: 157137 - protein, 9 aa, Homo Sapiens
NAKLKILEH

SEQ ID NO: 157138 - protein, 9 aa, Homo Sapiens
NAMDFSSVF

SEQ ID NO: 157139 - protein, 9 aa, Homo Sapiens
NARPAVASY

SEQ ID NO: 157140 - protein, 9 aa, Homo Sapiens
NASPVISSV

SEQ ID NO: 157141 - protein, 9 aa, Homo Sapiens
NATKARIPF

SEQ ID NO: 157142 - protein, 9 aa, Homo Sapiens
NAVAFLSSF

SEQ ID NO: 157143 - protein, 9 aa, Homo Sapiens
NAVHWQPVF

SEQ ID NO: 157144 - protein, 9 aa, Homo Sapiens
NAYSSPSVV

SEQ ID NO: 157145 - protein, 9 aa, Homo Sapiens
NAYTGIVLL

SEQ ID NO: 157146 - protein, 9 aa, Homo Sapiens
NIICGITSV

SEQ ID NO: 157147 - protein, 9 aa, Homo Sapiens
NIKFIGELF

SEQ ID NO: 157148 - protein, 9 aa, Homo Sapiens
NIKSPALAF

SEQ ID NO: 157149 - protein, 9 aa, Homo Sapiens
NIRDQTISY

SEQ ID NO: 157150 - protein, 9 aa, Homo Sapiens
NIREIEIDY

SEQ ID NO: 157151 - protein, 9 aa, Homo Sapiens
NISSGHVPH

SEQ ID NO: 157152 - protein, 9 aa, Homo Sapiens
NLKAPSRHY

SEQ ID NO: 157153 - protein, 9 aa, Homo Sapiens
NLKSHILTH

SEQ ID NO: 157154 - protein, 9 aa, Homo Sapiens
NQIPFIIQY

SEQ ID NO: 157155 - protein, 9 aa, Homo Sapiens
NSFGSPLEF

SEQ ID NO: 157156 - protein, 9 aa, Homo Sapiens
NSRAPTTTM

SEQ ID NO: 157157 - protein, 9 aa, Homo Sapiens
NSRGIWLSY

SEQ ID NO: 157158 - protein, 9 aa, Homo Sapiens
NSSPVINHL

SEQ ID NO: 157159 - protein, 9 aa, Homo Sapiens
NTIDPSHPM

SEQ ID NO: 157160 - protein, 9 aa, Homo Sapiens
NTIDSTSSF

SEQ ID NO: 157161 - protein, 9 aa, Homo Sapiens
NTKEPPLSL

SEQ ID NO: 157162 - protein, 9 aa, Homo Sapiens
NVIRDAVTY

SEQ ID NO: 157163 - protein, 9 aa, Homo Sapiens
NVKEAPTEY

SEQ ID NO: 157164 - protein, 9 aa, Homo Sapiens
NVNVIISTY

SEQ ID NO: 157165 - protein, 9 aa, Homo Sapiens
NVRTATESF

SEQ ID NO: 157166 - protein, 9 aa, Homo Sapiens
PAGVGPGLS

SEQ ID NO: 157167 - protein, 9 aa, Homo Sapiens
PIRPDIVNF

SEQ ID NO: 157168 - protein, 9 aa, Homo Sapiens
QAADTVVIF

SEQ ID NO: 157169 - protein, 9 aa, Homo Sapiens
QAASILTKF

SEQ ID NO: 157170 - protein, 9 aa, Homo Sapiens
QAFPGGHSM

SEQ ID NO: 157171 - protein, 9 aa, Homo Sapiens
QAIQWILHY

SEQ ID NO: 157172 - protein, 9 aa, Homo Sapiens
QAMGKTSFF

SEQ ID NO: 157173 - protein, 9 aa, Homo Sapiens
QASHPSAHF

SEQ ID NO: 157174 - protein, 9 aa, Homo Sapiens
QAVAIFTVY

SEQ ID NO: 157175 - protein, 9 aa, Homo Sapiens
QAYAVPYQY

SEQ ID NO: 157176 - protein, 9 aa, Homo Sapiens
QIPEIKQTL

SEQ ID NO: 157177 - protein, 9 aa, Homo Sapiens
QIRDVPVLY

SEQ ID NO: 157178 - protein, 9 aa, Homo Sapiens
QLGPVGGVF

SEQ ID NO: 157179 - protein, 9 aa, Homo Sapiens
QSVHFQTIF

SEQ ID NO: 157180 - protein, 9 aa, Homo Sapiens
QVKNPPHTY

SEQ ID NO: 157181 - protein, 9 aa, Homo Sapiens
QVYGGVTYY

SEQ ID NO: 157182 - protein, 9 aa, Homo Sapiens
RAAAKLLSH

SEQ ID NO: 157183 - protein, 9 aa, Homo Sapiens
RAADLLAVH

SEQ ID NO: 157184 - protein, 9 aa, Homo Sapiens
RAADVLVYL

SEQ ID NO: 157185 - protein, 9 aa, Homo Sapiens
RAAEILYYF

SEQ ID NO: 157186 - protein, 9 aa, Homo Sapiens
RAAEIRETL

SEQ ID NO: 157187 - protein, 9 aa, Homo Sapiens
RAAPFSLEY

SEQ ID NO: 157188 - protein, 9 aa, Homo Sapiens
RAFCTGQEL

SEQ ID NO: 157189 - protein, 9 aa, Homo Sapiens
RAFDCPSSF

SEQ ID NO: 157190 - protein, 9 aa, Homo Sapiens
RAFEYEIRF

SEQ ID NO: 157191 - protein, 9 aa, Homo Sapiens
RAHAAEVSF

SEQ ID NO: 157192 - protein, 9 aa, Homo Sapiens
RAIEIYTDM

SEQ ID NO: 157193 - protein, 9 aa, Homo Sapiens
RAIENIDTL

SEQ ID NO: 157194 - protein, 9 aa, Homo Sapiens
RAKDIKSSL

SEQ ID NO: 157195 - protein, 9 aa, Homo Sapiens
RAKQPPSTF

SEQ ID NO: 157196 - protein, 9 aa, Homo Sapiens
RANEPCTSF

SEQ ID NO: 157197 - protein, 9 aa, Homo Sapiens
RANPFNTPH

SEQ ID NO: 157198 - protein, 9 aa, Homo Sapiens
RAQDKVHYY

SEQ ID NO: 157199 - protein, 9 aa, Homo Sapiens
RAQPRGAVY

SEQ ID NO: 157200 - protein, 9 aa, Homo Sapiens
RARELLVSY

SEQ ID NO: 157201 - protein, 9 aa, Homo Sapiens
RARPATDSF

SEQ ID NO: 157202 - protein, 9 aa, Homo Sapiens
RASPLFSQH

SEQ ID NO: 157203 - protein, 9 aa, Homo Sapiens
RASWIAQVF

SEQ ID NO: 157204 - protein, 9 aa, Homo Sapiens
RAVEAQSCY

SEQ ID NO: 157205 - protein, 9 aa, Homo Sapiens
RAVEPAQQY

SEQ ID NO: 157206 - protein, 9 aa, Homo Sapiens
RAVWHTNVF

SEQ ID NO: 157207 - protein, 9 aa, Homo Sapiens
RAYGRDIVE

SEQ ID NO: 157208 - protein, 9 aa, Homo Sapiens
RIADISQVY

SEQ ID NO: 157209 - protein, 9 aa, Homo Sapiens
RIHFPLATY

SEQ ID NO: 157210 - protein, 9 aa, Homo Sapiens
RIKAINTFF

SEQ ID NO: 157211 - protein, 9 aa, Homo Sapiens
RIKDKVVTH

SEQ ID NO: 157212 - protein, 9 aa, Homo Sapiens
RIKDLGQFY

SEQ ID NO: 157213 - protein, 9 aa, Homo Sapiens
RIKETKEVY

SEQ ID NO: 157214 - protein, 9 aa, Homo Sapiens
RIKKDPVPY

SEQ ID NO: 157215 - protein, 9 aa, Homo Sapiens
RIKPNAITY

SEQ ID NO: 157216 - protein, 9 aa, Homo Sapiens
RIPSFVTEL

SEQ ID NO: 157217 - protein, 9 aa, Homo Sapiens
RIREDIAKY

SEQ ID NO: 157218 - protein, 9 aa, Homo Sapiens
RLKNPTVEY

SEQ ID NO: 157219 - protein, 9 aa, Homo Sapiens
RLPAWQPIL

SEQ ID NO: 157220 - protein, 9 aa, Homo Sapiens
RMKEVGKVF

SEQ ID NO: 157221 - protein, 9 aa, Homo Sapiens
RQADFVQVL

SEQ ID NO: 157222 - protein, 9 aa, Homo Sapiens
RQINWTVLY

SEQ ID NO: 157223 - protein, 9 aa, Homo Sapiens
RSPDFASSF

SEQ ID NO: 157224 - protein, 9 aa, Homo Sapiens
RSSPPGHYY

SEQ ID NO: 157225 - protein, 9 aa, Homo Sapiens
RTHLPGRTY

SEQ ID NO: 157226 - protein, 9 aa, Homo Sapiens
RTKDTPLSL

SEQ ID NO: 157227 - protein, 9 aa, Homo Sapiens
RTNAIKQTF

SEQ ID NO: 157228 - protein, 9 aa, Homo Sapiens
RVFPYISVM

SEQ ID NO: 157229 - protein, 9 aa, Homo Sapiens
RVKEIGSTM

SEQ ID NO: 157230 - protein, 9 aa, Homo Sapiens
RVYHAVSVM

SEQ ID NO: 157231 - protein, 9 aa, Homo Sapiens
RVYPQAVYF

SEQ ID NO: 157232 - protein, 9 aa, Homo Sapiens
SAAAVFSHF

SEQ ID NO: 157233 - protein, 9 aa, Homo Sapiens
SAADFFSHY

SEQ ID NO: 157234 - protein, 9 aa, Homo Sapiens
SAADVVVVH

SEQ ID NO: 157235 - protein, 9 aa, Homo Sapiens
SAAEIMAVL

SEQ ID NO: 157236 - protein, 9 aa, Homo Sapiens
SAAFPGASL

SEQ ID NO: 157237 - protein, 9 aa, Homo Sapiens
SAAGLHRAL

SEQ ID NO: 157238 - protein, 9 aa, Homo Sapiens
SAAKTGVRF

SEQ ID NO: 157239 - protein, 9 aa, Homo Sapiens
SAAMPGASL

SEQ ID NO: 157240 - protein, 9 aa, Homo Sapiens
SAAMVFSAL

SEQ ID NO: 157241 - protein, 9 aa, Homo Sapiens
SAANIQPIF

SEQ ID NO: 157242 - protein, 9 aa, Homo Sapiens
SAAPEGVPL

SEQ ID NO: 157243 - protein, 9 aa, Homo Sapiens
SAAPFAQRY

SEQ ID NO: 157244 - protein, 9 aa, Homo Sapiens
SAAPFFVLF

SEQ ID NO: 157245 - protein, 9 aa, Homo Sapiens
SAAPGTASL

SEQ ID NO: 157246 - protein, 9 aa, Homo Sapiens
SAAPGVGSV

SEQ ID NO: 157247 - protein, 9 aa, Homo Sapiens
SAAPPGLEA

SEQ ID NO: 157248 - protein, 9 aa, Homo Sapiens
SAAQPGVAF

SEQ ID NO: 157249 - protein, 9 aa, Homo Sapiens
SAASLYPVL

SEQ ID NO: 157250 - protein, 9 aa, Homo Sapiens
SAASVVSEI

SEQ ID NO: 157251 - protein, 9 aa, Homo Sapiens
SAATIVAKH

SEQ ID NO: 157252 - protein, 9 aa, Homo Sapiens
SACGHTAVL

SEQ ID NO: 157253 - protein, 9 aa, Homo Sapiens
SAFDEAMSY

SEQ ID NO: 157254 - protein, 9 aa, Homo Sapiens
SAFDRCATL

SEQ ID NO: 157255 - protein, 9 aa, Homo Sapiens
SAFPFPVTV

SEQ ID NO: 157256 - protein, 9 aa, Homo Sapiens
SAFTNRIFF

SEQ ID NO: 157257 - protein, 9 aa, Homo Sapiens
SAGVGAAHF

SEQ ID NO: 157258 - protein, 9 aa, Homo Sapiens
SAHLAFMTF

SEQ ID NO: 157259 - protein, 9 aa, Homo Sapiens
SAHNLQSVF

SEQ ID NO: 157260 - protein, 9 aa, Homo Sapiens
SAIASTKVM

SEQ ID NO: 157261 - protein, 9 aa, Homo Sapiens
SAIDRIFTL

SEQ ID NO: 157262 - protein, 9 aa, Homo Sapiens
SAIGYIHSL

SEQ ID NO: 157263 - protein, 9 aa, Homo Sapiens
SAIKTPQCY

SEQ ID NO: 157264 - protein, 9 aa, Homo Sapiens
SAILHPSTY

SEQ ID NO: 157265 - protein, 9 aa, Homo Sapiens
SAIPHPLIM

SEQ ID NO: 157266 - protein, 9 aa, Homo Sapiens
SAISRAASV

SEQ ID NO: 157267 - protein, 9 aa, Homo Sapiens
SAKDGTCTL

SEQ ID NO: 157268 - protein, 9 aa, Homo Sapiens
SAKDLICTH

SEQ ID NO: 157269 - protein, 9 aa, Homo Sapiens
SAKDWPQTF

SEQ ID NO: 157270 - protein, 9 aa, Homo Sapiens
SAKFASCFY

SEQ ID NO: 157271 - protein, 9 aa, Homo Sapiens
SAKITGVSH

SEQ ID NO: 157272 - protein, 9 aa, Homo Sapiens
SAKPEISAM

SEQ ID NO: 157273 - protein, 9 aa, Homo Sapiens
SAKPPTHKY

SEQ ID NO: 157274 - protein, 9 aa, Homo Sapiens
SAKPQTTVF

SEQ ID NO: 157275 - protein, 9 aa, Homo Sapiens
SAKSPTATF

SEQ ID NO: 157276 - protein, 9 aa, Homo Sapiens
SAKTPGFSV

SEQ ID NO: 157277 - protein, 9 aa, Homo Sapiens
SAKVANASY

SEQ ID NO: 157278 - protein, 9 aa, Homo Sapiens
SAKVPSDEY

SEQ ID NO: 157279 - protein, 9 aa, Homo Sapiens
SALVTGQSY

SEQ ID NO: 157280 - protein, 9 aa, Homo Sapiens
SAMEVVPAL

SEQ ID NO: 157281 - protein, 9 aa, Homo Sapiens
SAMPTSSSF

SEQ ID NO: 157282 - protein, 9 aa, Homo Sapiens
SAMSNPRAM

SEQ ID NO: 157283 - protein, 9 aa, Homo Sapiens
SAMSRPIIH

SEQ ID NO: 157284 - protein, 9 aa, Homo Sapiens
SANDAIATL

SEQ ID NO: 157285 - protein, 9 aa, Homo Sapiens
SANDFFSYY

SEQ ID NO: 157286 - protein, 9 aa, Homo Sapiens
SANVSKVSF

SEQ ID NO: 157287 - protein, 9 aa, Homo Sapiens
SAPASQASL

SEQ ID NO: 157288 - protein, 9 aa, Homo Sapiens
SAPGIISAL

SEQ ID NO: 157289 - protein, 9 aa, Homo Sapiens
SAPSHSTSL

SEQ ID NO: 157290 - protein, 9 aa, Homo Sapiens
SAPSSSTPF

SEQ ID NO: 157291 - protein, 9 aa, Homo Sapiens
SAREAAASL

SEQ ID NO: 157292 - protein, 9 aa, Homo Sapiens
SARIIGVSH

SEQ ID NO: 157293 - protein, 9 aa, Homo Sapiens
SARTPGPAV

SEQ ID NO: 157294 - protein, 9 aa, Homo Sapiens
SASDHIVQF

SEQ ID NO: 157295 - protein, 9 aa, Homo Sapiens
SASDVHGNF

SEQ ID NO: 157296 - protein, 9 aa, Homo Sapiens
SASGPFESH

SEQ ID NO: 157297 - protein, 9 aa, Homo Sapiens
SASPIFTHV

SEQ ID NO: 157298 - protein, 9 aa, Homo Sapiens
SASPSTSSF

SEQ ID NO: 157299 - protein, 9 aa, Homo Sapiens
SASVVFTTY

SEQ ID NO: 157300 - protein, 9 aa, Homo Sapiens
SATELMNIL

SEQ ID NO: 157301 - protein, 9 aa, Homo Sapiens
SATSVHTSV

SEQ ID NO: 157302 - protein, 9 aa, Homo Sapiens
SATYIAEEY

SEQ ID NO: 157303 - protein, 9 aa, Homo Sapiens
SAVAKALEH

SEQ ID NO: 157304 - protein, 9 aa, Homo Sapiens
SAVELVQEF

SEQ ID NO: 157305 - protein, 9 aa, Homo Sapiens
SAVEPINTF

SEQ ID NO: 157306 - protein, 9 aa, Homo Sapiens
SAVPSTSTM

SEQ ID NO: 157307 - protein, 9 aa, Homo Sapiens
SAVQDISSH

SEQ ID NO: 157308 - protein, 9 aa, Homo Sapiens
SAYAQIVQF

SEQ ID NO: 157309 - protein, 9 aa, Homo Sapiens
SAYQHPASF

SEQ ID NO: 157310 - protein, 9 aa, Homo Sapiens
SAYQHPTTF

SEQ ID NO: 157311 - protein, 9 aa, Homo Sapiens
SAYQSITHY

SEQ ID NO: 157312 - protein, 9 aa, Homo Sapiens
SGGPGPRVY

SEQ ID NO: 157313 - protein, 9 aa, Homo Sapiens
SGPGPAAAL

SEQ ID NO: 157314 - protein, 9 aa, Homo Sapiens
SGPVPGTAI

SEQ ID NO: 157315 - protein, 9 aa, Homo Sapiens
SIESIHSEM

SEQ ID NO: 157316 - protein, 9 aa, Homo Sapiens
SIIDTPGIL

SEQ ID NO: 157317 - protein, 9 aa, Homo Sapiens
SIIKPQNTY

SEQ ID NO: 157318 - protein, 9 aa, Homo Sapiens
SIKEPVSTL

SEQ ID NO: 157319 - protein, 9 aa, Homo Sapiens
SINGAITQF

SEQ ID NO: 157320 - protein, 9 aa, Homo Sapiens
SIPDFPMHL

SEQ ID NO: 157321 - protein, 9 aa, Homo Sapiens
SIPENVSTH

SEQ ID NO: 157322 - protein, 9 aa, Homo Sapiens
SIRDGVRAY

SEQ ID NO: 157323 - protein, 9 aa, Homo Sapiens
SIREAGGAF

SEQ ID NO: 157324 - protein, 9 aa, Homo Sapiens
SIRPGLSPY

SEQ ID NO: 157325 - protein, 9 aa, Homo Sapiens
SIRQQILEH

SEQ ID NO: 157326 - protein, 9 aa, Homo Sapiens
SLKDPSNNF

SEQ ID NO: 157327 - protein, 9 aa, Homo Sapiens
SLKTPGTSL

SEQ ID NO: 157328 - protein, 9 aa, Homo Sapiens
SLPSFPSTL

SEQ ID NO: 157329 - protein, 9 aa, Homo Sapiens
SLRPDRPLH

SEQ ID NO: 157330 - protein, 9 aa, Homo Sapiens
SQANIAQVL

SEQ ID NO: 157331 - protein, 9 aa, Homo Sapiens
SQYPFPVTL

SEQ ID NO: 157332 - protein, 9 aa, Homo Sapiens
SQYQGVVVY

SEQ ID NO: 157333 - protein, 9 aa, Homo Sapiens
SSFDMAQVF

SEQ ID NO: 157334 - protein, 9 aa, Homo Sapiens
SSFPTVVIY

SEQ ID NO: 157335 - protein, 9 aa, Homo Sapiens
SSHVTNVSF

SEQ ID NO: 157336 - protein, 9 aa, Homo Sapiens
SSIGKLSEY

SEQ ID NO: 157337 - protein, 9 aa, Homo Sapiens
SSKEGGVTF

SEQ ID NO: 157338 - protein, 9 aa, Homo Sapiens
SSKEPAMSM

SEQ ID NO: 157339 - protein, 9 aa, Homo Sapiens
SSKEPPSAY

SEQ ID NO: 157340 - protein, 9 aa, Homo Sapiens
SSKEPSNSL

SEQ ID NO: 157341 - protein, 9 aa, Homo Sapiens
SSKPATSTF

SEQ ID NO: 157342 - protein, 9 aa, Homo Sapiens
SSMKPTLSH

SEQ ID NO: 157343 - protein, 9 aa, Homo Sapiens
SSRDPGTHF

SEQ ID NO: 157344 - protein, 9 aa, Homo Sapiens
SSSPVVVQH

SEQ ID NO: 157345 - protein, 9 aa, Homo Sapiens
SSVEVRMEF

SEQ ID NO: 157346 - protein, 9 aa, Homo Sapiens
SSYPNPVAH

SEQ ID NO: 157347 - protein, 9 aa, Homo Sapiens
STFLSQTTY

SEQ ID NO: 157348 - protein, 9 aa, Homo Sapiens
STHVTISTY

SEQ ID NO: 157349 - protein, 9 aa, Homo Sapiens
STKEPGRTL

SEQ ID NO: 157350 - protein, 9 aa, Homo Sapiens
STPDHTSTL

SEQ ID NO: 157351 - protein, 9 aa, Homo Sapiens
STVEVTNTF

SEQ ID NO: 157352 - protein, 9 aa, Homo Sapiens
SVHQPGSHY

SEQ ID NO: 157353 - protein, 9 aa, Homo Sapiens
SVIATIQEY

SEQ ID NO: 157354 - protein, 9 aa, Homo Sapiens
SVIDSPGIL

SEQ ID NO: 157355 - protein, 9 aa, Homo Sapiens
SVIDVKTTM

SEQ ID NO: 157356 - protein, 9 aa, Homo Sapiens
SVIESHTEF

SEQ ID NO: 157357 - protein, 9 aa, Homo Sapiens
SVINPGAIY

SEQ ID NO: 157358 - protein, 9 aa, Homo Sapiens
SVKEWTITY

SEQ ID NO: 157359 - protein, 9 aa, Homo Sapiens
SVKPASSSF

SEQ ID NO: 157360 - protein, 9 aa, Homo Sapiens
SVKSPNQSL

SEQ ID NO: 157361 - protein, 9 aa, Homo Sapiens
SVKWPNSVM

SEQ ID NO: 157362 - protein, 9 aa, Homo Sapiens
SVNGFISTL

SEQ ID NO: 157363 - protein, 9 aa, Homo Sapiens
SVPAFASSL

SEQ ID NO: 157364 - protein, 9 aa, Homo Sapiens
SVPSAVSSL

SEQ ID NO: 157365 - protein, 9 aa, Homo Sapiens
SVRKDIESY

SEQ ID NO: 157366 - protein, 9 aa, Homo Sapiens
SVRSNLTSF

SEQ ID NO: 157367 - protein, 9 aa, Homo Sapiens
TAAAVGAVF

SEQ ID NO: 157368 - protein, 9 aa, Homo Sapiens
TAADIFKQY

SEQ ID NO: 157369 - protein, 9 aa, Homo Sapiens
TAADLGSVV

SEQ ID NO: 157370 - protein, 9 aa, Homo Sapiens
TAADLVPIF

SEQ ID NO: 157371 - protein, 9 aa, Homo Sapiens
TAADTVIIY

SEQ ID NO: 157372 - protein, 9 aa, Homo Sapiens
TAAGVTSIV

SEQ ID NO: 157373 - protein, 9 aa, Homo Sapiens
TAAPPAQPL

SEQ ID NO: 157374 - protein, 9 aa, Homo Sapiens
TAAPTGTTI

SEQ ID NO: 157375 - protein, 9 aa, Homo Sapiens
TAAPTIGVL

SEQ ID NO: 157376 - protein, 9 aa, Homo Sapiens
TAAPVPTTL

SEQ ID NO: 157377 - protein, 9 aa, Homo Sapiens
TAARAWALF

SEQ ID NO: 157378 - protein, 9 aa, Homo Sapiens
TAAWTGTTF

SEQ ID NO: 157379 - protein, 9 aa, Homo Sapiens
TAFPEASFL

SEQ ID NO: 157380 - protein, 9 aa, Homo Sapiens
TAFPQRTEL

SEQ ID NO: 157381 - protein, 9 aa, Homo Sapiens
TAIEKPEEF

SEQ ID NO: 157382 - protein, 9 aa, Homo Sapiens
TAIESGQHY

SEQ ID NO: 157383 - protein, 9 aa, Homo Sapiens
TAIRALETY

SEQ ID NO: 157384 - protein, 9 aa, Homo Sapiens
TAISLCQTF

SEQ ID NO: 157385 - protein, 9 aa, Homo Sapiens
TAISRYMEL

SEQ ID NO: 157386 - protein, 9 aa, Homo Sapiens
TAITRAQSL

SEQ ID NO: 157387 - protein, 9 aa, Homo Sapiens
TAKDPSVSI

SEQ ID NO: 157388 - protein, 9 aa, Homo Sapiens
TAKEAGCRF

SEQ ID NO: 157389 - protein, 9 aa, Homo Sapiens
TAKEIIQHF

SEQ ID NO: 157390 - protein, 9 aa, Homo Sapiens
TAKELNVSF

SEQ ID NO: 157391 - protein, 9 aa, Homo Sapiens
TAKGPGSGF

SEQ ID NO: 157392 - protein, 9 aa, Homo Sapiens
TAKPGVSTV

SEQ ID NO: 157393 - protein, 9 aa, Homo Sapiens
TAKRSGAVF

SEQ ID NO: 157394 - protein, 9 aa, Homo Sapiens
TAKSATWTY

SEQ ID NO: 157395 - protein, 9 aa, Homo Sapiens
TAKSPATCY

SEQ ID NO: 157396 - protein, 9 aa, Homo Sapiens
TAKSVTCTY

SEQ ID NO: 157397 - protein, 9 aa, Homo Sapiens
TAMFIASKY

SEQ ID NO: 157398 - protein, 9 aa, Homo Sapiens
TAQDLVQHF

SEQ ID NO: 157399 - protein, 9 aa, Homo Sapiens
TARYIYISY

SEQ ID NO: 157400 - protein, 9 aa, Homo Sapiens
TASAVVQHM

SEQ ID NO: 157401 - protein, 9 aa, Homo Sapiens
TASEIGSAF

SEQ ID NO: 157402 - protein, 9 aa, Homo Sapiens
TASGVFSKF

SEQ ID NO: 157403 - protein, 9 aa, Homo Sapiens
TASPVAVSL

SEQ ID NO: 157404 - protein, 9 aa, Homo Sapiens
TASPVIKAV

SEQ ID NO: 157405 - protein, 9 aa, Homo Sapiens
TAVIPTNVF

SEQ ID NO: 157406 - protein, 9 aa, Homo Sapiens
TAVYKVSEY

SEQ ID NO: 157407 - protein, 9 aa, Homo Sapiens
TAYAYATVL

SEQ ID NO: 157408 - protein, 9 aa, Homo Sapiens
TAYPASIVH

SEQ ID NO: 157409 - protein, 9 aa, Homo Sapiens
TAYPGQTQY

SEQ ID NO: 157410 - protein, 9 aa, Homo Sapiens
TGIPGLEQL

SEQ ID NO: 157411 - protein, 9 aa, Homo Sapiens
TGMVPGSEF

SEQ ID NO: 157412 - protein, 9 aa, Homo Sapiens
TIAKPTTHF

SEQ ID NO: 157413 - protein, 9 aa, Homo Sapiens
TIIEATHVL

SEQ ID NO: 157414 - protein, 9 aa, Homo Sapiens
TIINLAQNF

SEQ ID NO: 157415 - protein, 9 aa, Homo Sapiens
TIKDCATVF

SEQ ID NO: 157416 - protein, 9 aa, Homo Sapiens
TIKDPPTSA

SEQ ID NO: 157417 - protein, 9 aa, Homo Sapiens
TIKDVSLCF

SEQ ID NO: 157418 - protein, 9 aa, Homo Sapiens
TIKSATISY

SEQ ID NO: 157419 - protein, 9 aa, Homo Sapiens
TIMAHVTEF

SEQ ID NO: 157420 - protein, 9 aa, Homo Sapiens
TINEIEDTF

SEQ ID NO: 157421 - protein, 9 aa, Homo Sapiens
TINGKIAVL

SEQ ID NO: 157422 - protein, 9 aa, Homo Sapiens
TLITGLEEY

SEQ ID NO: 157423 - protein, 9 aa, Homo Sapiens
TLKDHIMSH

SEQ ID NO: 157424 - protein, 9 aa, Homo Sapiens
TLKEAGTHY

SEQ ID NO: 157425 - protein, 9 aa, Homo Sapiens
TLKTPGKSF

SEQ ID NO: 157426 - protein, 9 aa, Homo Sapiens
TMKDFNHSY

SEQ ID NO: 157427 - protein, 9 aa, Homo Sapiens
TSAPTGHTF

SEQ ID NO: 157428 - protein, 9 aa, Homo Sapiens
TSFPHESTF

SEQ ID NO: 157429 - protein, 9 aa, Homo Sapiens
TSKVPSAPH

SEQ ID NO: 157430 - protein, 9 aa, Homo Sapiens
TTFPRPVTV

SEQ ID NO: 157431 - protein, 9 aa, Homo Sapiens
TTIDVRTTF

SEQ ID NO: 157432 - protein, 9 aa, Homo Sapiens
TTKAPTGPF

SEQ ID NO: 157433 - protein, 9 aa, Homo Sapiens
TTYPNTYIF

SEQ ID NO: 157434 - protein, 9 aa, Homo Sapiens
TVIDKLVVH

SEQ ID NO: 157435 - protein, 9 aa, Homo Sapiens
TVIDSQTHY

SEQ ID NO: 157436 - protein, 9 aa, Homo Sapiens
TVKDSRTVY

SEQ ID NO: 157437 - protein, 9 aa, Homo Sapiens
TVKPPTSVA

SEQ ID NO: 157438 - protein, 9 aa, Homo Sapiens
TVRDFTQVF

SEQ ID NO: 157439 - protein, 9 aa, Homo Sapiens
TVRDHVHCL

SEQ ID NO: 157440 - protein, 9 aa, Homo Sapiens
TVYDKPASF

SEQ ID NO: 157441 - protein, 9 aa, Homo Sapiens
VAAAPGTPA

SEQ ID NO: 157442 - protein, 9 aa, Homo Sapiens
VAAAVSGVY

SEQ ID NO: 157443 - protein, 9 aa, Homo Sapiens
VAADAVASL

SEQ ID NO: 157444 - protein, 9 aa, Homo Sapiens
VAAEAFSEL

SEQ ID NO: 157445 - protein, 9 aa, Homo Sapiens
VAAEWRSTF

SEQ ID NO: 157446 - protein, 9 aa, Homo Sapiens
VAAGGHITF

SEQ ID NO: 157447 - protein, 9 aa, Homo Sapiens
VAALPGIVH

SEQ ID NO: 157448 - protein, 9 aa, Homo Sapiens
VAAPASLSL

SEQ ID NO: 157449 - protein, 9 aa, Homo Sapiens
VAAPLFELY

SEQ ID NO: 157450 - protein, 9 aa, Homo Sapiens
VAASNIVQM

SEQ ID NO: 157451 - protein, 9 aa, Homo Sapiens
VADPYVVIM

SEQ ID NO: 157452 - protein, 9 aa, Homo Sapiens
VAFGHHAKF

SEQ ID NO: 157453 - protein, 9 aa, Homo Sapiens
VAFGSHMSF

SEQ ID NO: 157454 - protein, 9 aa, Homo Sapiens
VAFKKTFSY

SEQ ID NO: 157455 - protein, 9 aa, Homo Sapiens
VAFNWIIVH

SEQ ID NO: 157456 - protein, 9 aa, Homo Sapiens
VAFPSSSVY

SEQ ID NO: 157457 - protein, 9 aa, Homo Sapiens
VAFPVGNAF

SEQ ID NO: 157458 - protein, 9 aa, Homo Sapiens
VAFQNPQTH

SEQ ID NO: 157459 - protein, 9 aa, Homo Sapiens
VAFSPVTEL

SEQ ID NO: 157460 - protein, 9 aa, Homo Sapiens
VAGAHVVIH

SEQ ID NO: 157461 - protein, 9 aa, Homo Sapiens
VAGPVGGSL

SEQ ID NO: 157462 - protein, 9 aa, Homo Sapiens
VAHSPPSTL

SEQ ID NO: 157463 - protein, 9 aa, Homo Sapiens
VAINHIVDF

SEQ ID NO: 157464 - protein, 9 aa, Homo Sapiens
VAINLIVQH

SEQ ID NO: 157465 - protein, 9 aa, Homo Sapiens
VAIPSYICY

SEQ ID NO: 157466 - protein, 9 aa, Homo Sapiens
VAIQSVRCY

SEQ ID NO: 157467 - protein, 9 aa, Homo Sapiens
VAKAPSLTF

SEQ ID NO: 157468 - protein, 9 aa, Homo Sapiens
VAKAPSQAL

SEQ ID NO: 157469 - protein, 9 aa, Homo Sapiens
VAKAVTQAL

SEQ ID NO: 157470 - protein, 9 aa, Homo Sapiens
VAKGPSHSL

SEQ ID NO: 157471 - protein, 9 aa, Homo Sapiens
VAKHPAGSF

SEQ ID NO: 157472 - protein, 9 aa, Homo Sapiens
VAKIVAETM

SEQ ID NO: 157473 - protein, 9 aa, Homo Sapiens
VAKLILVNF

SEQ ID NO: 157474 - protein, 9 aa, Homo Sapiens
VAKLTGHSY

SEQ ID NO: 157475 - protein, 9 aa, Homo Sapiens
VAKMGITEY

SEQ ID NO: 157476 - protein, 9 aa, Homo Sapiens
VAKPPGWSA

SEQ ID NO: 157477 - protein, 9 aa, Homo Sapiens
VAKPPVMSF

SEQ ID NO: 157478 - protein, 9 aa, Homo Sapiens
VAKSKLREL

SEQ ID NO: 157479 - protein, 9 aa, Homo Sapiens
VAKTLGREF

SEQ ID NO: 157480 - protein, 9 aa, Homo Sapiens
VAKTNTVSY

SEQ ID NO: 157481 - protein, 9 aa, Homo Sapiens
VAKTPRNTY

SEQ ID NO: 157482 - protein, 9 aa, Homo Sapiens
VAKWATVTF

SEQ ID NO: 157483 - protein, 9 aa, Homo Sapiens
VAKWTGDFF

SEQ ID NO: 157484 - protein, 9 aa, Homo Sapiens
VALHSAVSA

SEQ ID NO: 157485 - protein, 9 aa, Homo Sapiens
VALLRVTPF

SEQ ID NO: 157486 - protein, 9 aa, Homo Sapiens
VAMKFAQVF

SEQ ID NO: 157487 - protein, 9 aa, Homo Sapiens
VANETGAFF

SEQ ID NO: 157488 - protein, 9 aa, Homo Sapiens
VANPNSAIF

SEQ ID NO: 157489 - protein, 9 aa, Homo Sapiens
VANSIHSLF

SEQ ID NO: 157490 - protein, 9 aa, Homo Sapiens
VANTMRTSL

SEQ ID NO: 157491 - protein, 9 aa, Homo Sapiens
VAPAAASSL

SEQ ID NO: 157492 - protein, 9 aa, Homo Sapiens
VAPPGCSHL

SEQ ID NO: 157493 - protein, 9 aa, Homo Sapiens
VAQELPTTL

SEQ ID NO: 157494 - protein, 9 aa, Homo Sapiens
VAQEPVNTL

SEQ ID NO: 157495 - protein, 9 aa, Homo Sapiens
VAQKPRSHF

SEQ ID NO: 157496 - protein, 9 aa, Homo Sapiens
VARDLRAEF

SEQ ID NO: 157497 - protein, 9 aa, Homo Sapiens
VARGEIARF

SEQ ID NO: 157498 - protein, 9 aa, Homo Sapiens
VARGNLGVY

SEQ ID NO: 157499 - protein, 9 aa, Homo Sapiens
VARLIAIFF

SEQ ID NO: 157500 - protein, 9 aa, Homo Sapiens
VARPDVVEM

SEQ ID NO: 157501 - protein, 9 aa, Homo Sapiens
VARPPGQDF

SEQ ID NO: 157502 - protein, 9 aa, Homo Sapiens
VARSNILTL

SEQ ID NO: 157503 - protein, 9 aa, Homo Sapiens
VASAVFGVI

SEQ ID NO: 157504 - protein, 9 aa, Homo Sapiens
VASEIMAVL

SEQ ID NO: 157505 - protein, 9 aa, Homo Sapiens
VASETGHVY

SEQ ID NO: 157506 - protein, 9 aa, Homo Sapiens
VASEYPVIL

SEQ ID NO: 157507 - protein, 9 aa, Homo Sapiens
VASSILSHI

SEQ ID NO: 157508 - protein, 9 aa, Homo Sapiens
VASSLYDIL

SEQ ID NO: 157509 - protein, 9 aa, Homo Sapiens
VASSVNTEF

SEQ ID NO: 157510 - protein, 9 aa, Homo Sapiens
VASTITGVM

SEQ ID NO: 157511 - protein, 9 aa, Homo Sapiens
VATDFFTVL

SEQ ID NO: 157512 - protein, 9 aa, Homo Sapiens
VATSRIIKY

SEQ ID NO: 157513 - protein, 9 aa, Homo Sapiens
VAVCRIPVL

SEQ ID NO: 157514 - protein, 9 aa, Homo Sapiens
VAVDGINAL

SEQ ID NO: 157515 - protein, 9 aa, Homo Sapiens
VAVDPTEEY

SEQ ID NO: 157516 - protein, 9 aa, Homo Sapiens
VAVEPGAAV

SEQ ID NO: 157517 - protein, 9 aa, Homo Sapiens
VAVEVVTTM

SEQ ID NO: 157518 - protein, 9 aa, Homo Sapiens
VAVHVFSEF

SEQ ID NO: 157519 - protein, 9 aa, Homo Sapiens
VAVHVVDFF

SEQ ID NO: 157520 - protein, 9 aa, Homo Sapiens
VAVNKPAEF

SEQ ID NO: 157521 - protein, 9 aa, Homo Sapiens
VAVPVAVTF

SEQ ID NO: 157522 - protein, 9 aa, Homo Sapiens
VAVSMLNVY

SEQ ID NO: 157523 - protein, 9 aa, Homo Sapiens
VAWVGQQVH

SEQ ID NO: 157524 - protein, 9 aa, Homo Sapiens
VAYDSKQYY

SEQ ID NO: 157525 - protein, 9 aa, Homo Sapiens
VAYGKGTYF

SEQ ID NO: 157526 - protein, 9 aa, Homo Sapiens
VAYMNPIAM

SEQ ID NO: 157527 - protein, 9 aa, Homo Sapiens
VAYPCAILY

SEQ ID NO: 157528 - protein, 9 aa, Homo Sapiens
VAYQHAFLY

SEQ ID NO: 157529 - protein, 9 aa, Homo Sapiens
VAYSHPTTV

SEQ ID NO: 157530 - protein, 9 aa, Homo Sapiens
VAYVSSVAL

SEQ ID NO: 157531 - protein, 9 aa, Homo Sapiens
VGAPVEVTH

SEQ ID NO: 157532 - protein, 9 aa, Homo Sapiens
VGIDLGTTY

SEQ ID NO: 157533 - protein, 9 aa, Homo Sapiens
VGVPSAPVL

SEQ ID NO: 157534 - protein, 9 aa, Homo Sapiens
VIAPIISNF

SEQ ID NO: 157535 - protein, 9 aa, Homo Sapiens
VIFAGGQAY

SEQ ID NO: 157536 - protein, 9 aa, Homo Sapiens
VIGDVIRVY

SEQ ID NO: 157537 - protein, 9 aa, Homo Sapiens
VIIDDRHVY

SEQ ID NO: 157538 - protein, 9 aa, Homo Sapiens
VIIDNLQFM

SEQ ID NO: 157539 - protein, 9 aa, Homo Sapiens
VIIGARAEM

SEQ ID NO: 157540 - protein, 9 aa, Homo Sapiens
VIIKGTQVY

SEQ ID NO: 157541 - protein, 9 aa, Homo Sapiens
VIKDAIASL

SEQ ID NO: 157542 - protein, 9 aa, Homo Sapiens
VIKEITQEM

SEQ ID NO: 157543 - protein, 9 aa, Homo Sapiens
VIKEKGLEH

SEQ ID NO: 157544 - protein, 9 aa, Homo Sapiens
VIKEQNREL

SEQ ID NO: 157545 - protein, 9 aa, Homo Sapiens
VIKESGPPH

SEQ ID NO: 157546 - protein, 9 aa, Homo Sapiens
VIKETQERY

SEQ ID NO: 157547 - protein, 9 aa, Homo Sapiens
VIKETTREM

SEQ ID NO: 157548 - protein, 9 aa, Homo Sapiens
VILPPLSPY

SEQ ID NO: 157549 - protein, 9 aa, Homo Sapiens
VINGNIKTV

SEQ ID NO: 157550 - protein, 9 aa, Homo Sapiens
VIPENTVIY

SEQ ID NO: 157551 - protein, 9 aa, Homo Sapiens
VIRDEVEKY

SEQ ID NO: 157552 - protein, 9 aa, Homo Sapiens
VIRDFAGPY

SEQ ID NO: 157553 - protein, 9 aa, Homo Sapiens
VIRELKEQY

SEQ ID NO: 157554 - protein, 9 aa, Homo Sapiens
VIRGNIVKH

SEQ ID NO: 157555 - protein, 9 aa, Homo Sapiens
VIRHITVVH

SEQ ID NO: 157556 - protein, 9 aa, Homo Sapiens
VIVSTRSPY

SEQ ID NO: 157557 - protein, 9 aa, Homo Sapiens
VLGPAEAHY

SEQ ID NO: 157558 - protein, 9 aa, Homo Sapiens
VLIDVGTGY

SEQ ID NO: 157559 - protein, 9 aa, Homo Sapiens
VLREIAEEY

SEQ ID NO: 157560 - protein, 9 aa, Homo Sapiens
VMINKATPY

SEQ ID NO: 157561 - protein, 9 aa, Homo Sapiens
VQGPVGTDF

SEQ ID NO: 157562 - protein, 9 aa, Homo Sapiens
VSAGIQTSF

SEQ ID NO: 157563 - protein, 9 aa, Homo Sapiens
VSHIMLESY

SEQ ID NO: 157564 - protein, 9 aa, Homo Sapiens
VSHLIATEY

SEQ ID NO: 157565 - protein, 9 aa, Homo Sapiens
VSKPSAPVF

SEQ ID NO: 157566 - protein, 9 aa, Homo Sapiens
VSPDAKTSL

SEQ ID NO: 157567 - protein, 9 aa, Homo Sapiens
VSRDTIAIH

SEQ ID NO: 157568 - protein, 9 aa, Homo Sapiens
VSRVPTRSL

SEQ ID NO: 157569 - protein, 9 aa, Homo Sapiens
VSSDVQSVF

SEQ ID NO: 157570 - protein, 9 aa, Homo Sapiens
VSSPTVQVF

SEQ ID NO: 157571 - protein, 9 aa, Homo Sapiens
VSTEPGKEY

SEQ ID NO: 157572 - protein, 9 aa, Homo Sapiens
VSVPFPVTH

SEQ ID NO: 157573 - protein, 9 aa, Homo Sapiens
VTFEKQWFY

SEQ ID NO: 157574 - protein, 9 aa, Homo Sapiens
VTKDPGVGM

SEQ ID NO: 157575 - protein, 9 aa, Homo Sapiens
VTKGNIAQM

SEQ ID NO: 157576 - protein, 9 aa, Homo Sapiens
VTKPANSVF

SEQ ID NO: 157577 - protein, 9 aa, Homo Sapiens
VTKPVGGNY

SEQ ID NO: 157578 - protein, 9 aa, Homo Sapiens
VTNTIISHY

SEQ ID NO: 157579 - protein, 9 aa, Homo Sapiens
VTQIPQEEH

SEQ ID NO: 157580 - protein, 9 aa, Homo Sapiens
VTRPVPLEH

SEQ ID NO: 157581 - protein, 9 aa, Homo Sapiens
VTSPVLVIH

SEQ ID NO: 157582 - protein, 9 aa, Homo Sapiens
VTYVPVTTF

SEQ ID NO: 157583 - protein, 9 aa, Homo Sapiens
VVAGIKEYF

SEQ ID NO: 157584 - protein, 9 aa, Homo Sapiens
VVAPITTGY

SEQ ID NO: 157585 - protein, 9 aa, Homo Sapiens
VVIRQRKSY

SEQ ID NO: 157586 - protein, 9 aa, Homo Sapiens
VVITKVVTH

SEQ ID NO: 157587 - protein, 9 aa, Homo Sapiens
VVKMPSGEF

SEQ ID NO: 157588 - protein, 9 aa, Homo Sapiens
VVKPPGQDL

SEQ ID NO: 157589 - protein, 9 aa, Homo Sapiens
VVKPPGSSL

SEQ ID NO: 157590 - protein, 9 aa, Homo Sapiens
VVNGKVEYF

SEQ ID NO: 157591 - protein, 9 aa, Homo Sapiens
VVPQFVVFY

SEQ ID NO: 157592 - protein, 9 aa, Homo Sapiens
VVQEPGQVF

SEQ ID NO: 157593 - protein, 9 aa, Homo Sapiens
VVYENVSHF

SEQ ID NO: 157594 - protein, 9 aa, Homo Sapiens
VVYPWTQRF

SEQ ID NO: 157595 - protein, 9 aa, Homo Sapiens
WARPLSVSF

SEQ ID NO: 157596 - protein, 9 aa, Homo Sapiens
YAAASHSYY

SEQ ID NO: 157597 - protein, 9 aa, Homo Sapiens
YAAGALTVH

SEQ ID NO: 157598 - protein, 9 aa, Homo Sapiens
YAAGVHSVL

SEQ ID NO: 157599 - protein, 9 aa, Homo Sapiens
YAALHGEFY

SEQ ID NO: 157600 - protein, 9 aa, Homo Sapiens
YAALPGQQH

SEQ ID NO: 157601 - protein, 9 aa, Homo Sapiens
YAANLKNVM

SEQ ID NO: 157602 - protein, 9 aa, Homo Sapiens
YAANPGQLF

SEQ ID NO: 157603 - protein, 9 aa, Homo Sapiens
YAAQNRQEF

SEQ ID NO: 157604 - protein, 9 aa, Homo Sapiens
YAFDFARQS

SEQ ID NO: 157605 - protein, 9 aa, Homo Sapiens
YAFGGGCEL

SEQ ID NO: 157606 - protein, 9 aa, Homo Sapiens
YAFGSCINH

SEQ ID NO: 157607 - protein, 9 aa, Homo Sapiens
YAFNGTQRF

SEQ ID NO: 157608 - protein, 9 aa, Homo Sapiens
YAFPKAVSV

SEQ ID NO: 157609 - protein, 9 aa, Homo Sapiens
YAFPKAVTV

SEQ ID NO: 157610 - protein, 9 aa, Homo Sapiens
YAFPKSITV

SEQ ID NO: 157611 - protein, 9 aa, Homo Sapiens
YAFPLAHSL

SEQ ID NO: 157612 - protein, 9 aa, Homo Sapiens
YAFPVGLTH

SEQ ID NO: 157613 - protein, 9 aa, Homo Sapiens
YAFVRPVIL

SEQ ID NO: 157614 - protein, 9 aa, Homo Sapiens
YAHFPINVV

SEQ ID NO: 157615 - protein, 9 aa, Homo Sapiens
YAIDNPLHY

SEQ ID NO: 157616 - protein, 9 aa, Homo Sapiens
YAISKPEVL

SEQ ID NO: 157617 - protein, 9 aa, Homo Sapiens
YAKAGCQVV

SEQ ID NO: 157618 - protein, 9 aa, Homo Sapiens
YAKDDPLEF

SEQ ID NO: 157619 - protein, 9 aa, Homo Sapiens
YAKDGRVSY

SEQ ID NO: 157620 - protein, 9 aa, Homo Sapiens
YAKDMLTSL

SEQ ID NO: 157621 - protein, 9 aa, Homo Sapiens
YAKDYTKAL

SEQ ID NO: 157622 - protein, 9 aa, Homo Sapiens
YAKEAQQSL

SEQ ID NO: 157623 - protein, 9 aa, Homo Sapiens
YAKIVEIPF

SEQ ID NO: 157624 - protein, 9 aa, Homo Sapiens
YAKNNIPII

SEQ ID NO: 157625 - protein, 9 aa, Homo Sapiens
YAMDELRSL

SEQ ID NO: 157626 - protein, 9 aa, Homo Sapiens
YANAKIYKL

SEQ ID NO: 157627 - protein, 9 aa, Homo Sapiens
YANDFASEY

SEQ ID NO: 157628 - protein, 9 aa, Homo Sapiens
YANEVGEAF

SEQ ID NO: 157629 - protein, 9 aa, Homo Sapiens
YANSKAVTL

SEQ ID NO: 157630 - protein, 9 aa, Homo Sapiens
YARDETEFY

SEQ ID NO: 157631 - protein, 9 aa, Homo Sapiens
YARTDGKVF

SEQ ID NO: 157632 - protein, 9 aa, Homo Sapiens
YARVVGSEY

SEQ ID NO: 157633 - protein, 9 aa, Homo Sapiens
YASDCASFF

SEQ ID NO: 157634 - protein, 9 aa, Homo Sapiens
YASGAAAYY

SEQ ID NO: 157635 - protein, 9 aa, Homo Sapiens
YASGKISQF

SEQ ID NO: 157636 - protein, 9 aa, Homo Sapiens
YASNITSVL

SEQ ID NO: 157637 - protein, 9 aa, Homo Sapiens
YASSPGGVY

SEQ ID NO: 157638 - protein, 9 aa, Homo Sapiens
YASSPGMSL

SEQ ID NO: 157639 - protein, 9 aa, Homo Sapiens
YATFIVTNY

SEQ ID NO: 157640 - protein, 9 aa, Homo Sapiens
YATIILSKM

SEQ ID NO: 157641 - protein, 9 aa, Homo Sapiens
YAVAHAVTE

SEQ ID NO: 157642 - protein, 9 aa, Homo Sapiens
YAVDRAITH

SEQ ID NO: 157643 - protein, 9 aa, Homo Sapiens
YAVPALEAH

SEQ ID NO: 157644 - protein, 9 aa, Homo Sapiens
YAYEKPHVV

SEQ ID NO: 157645 - protein, 9 aa, Homo Sapiens
YAYPATAAA

SEQ ID NO: 157646 - protein, 9 aa, Homo Sapiens
YGAEALERM

SEQ ID NO: 157647 - protein, 9 aa, Homo Sapiens
YGYEHILTL

SEQ ID NO: 157648 - protein, 9 aa, Homo Sapiens
YGYGHESEL

SEQ ID NO: 157649 - protein, 9 aa, Homo Sapiens
YIAAFLSHF

SEQ ID NO: 157650 - protein, 9 aa, Homo Sapiens
YIISGLTGF

SEQ ID NO: 157651 - protein, 9 aa, Homo Sapiens
YIKDRTLPF

SEQ ID NO: 157652 - protein, 9 aa, Homo Sapiens
YIKEPKSVF

SEQ ID NO: 157653 - protein, 9 aa, Homo Sapiens
YIKEYVTCH

SEQ ID NO: 157654 - protein, 9 aa, Homo Sapiens
YIRDLALEY

SEQ ID NO: 157655 - protein, 9 aa, Homo Sapiens
YIRGGIVSQ

SEQ ID NO: 157656 - protein, 9 aa, Homo Sapiens
YISDHMKVH

SEQ ID NO: 157657 - protein, 9 aa, Homo Sapiens
YLADIFTKL

SEQ ID NO: 157658 - protein, 9 aa, Homo Sapiens
YLAPHVRTL

SEQ ID NO: 157659 - protein, 9 aa, Homo Sapiens
YLLPHILVY

SEQ ID NO: 157660 - protein, 9 aa, Homo Sapiens
YNFEKPVVM

SEQ ID NO: 157661 - protein, 9 aa, Homo Sapiens
YQADIERMY

SEQ ID NO: 157662 - protein, 9 aa, Homo Sapiens
YQFTGIKKY

SEQ ID NO: 157663 - protein, 9 aa, Homo Sapiens
YSADGHSIL

SEQ ID NO: 157664 - protein, 9 aa, Homo Sapiens
YSFDPVGSY

SEQ ID NO: 157665 - protein, 9 aa, Homo Sapiens
YSGARPLSH

SEQ ID NO: 157666 - protein, 9 aa, Homo Sapiens
YSKDQLQTF

SEQ ID NO: 157667 - protein, 9 aa, Homo Sapiens
YSKLPGVSL

SEQ ID NO: 157668 - protein, 9 aa, Homo Sapiens
YSMISVVGF

SEQ ID NO: 157669 - protein, 9 aa, Homo Sapiens
YSNGFCTVY

SEQ ID NO: 157670 - protein, 9 aa, Homo Sapiens
YSRYPPREY

SEQ ID NO: 157671 - protein, 9 aa, Homo Sapiens
YTFGRIVIY

SEQ ID NO: 157672 - protein, 9 aa, Homo Sapiens
YTIENPRHF

SEQ ID NO: 157673 - protein, 9 aa, Homo Sapiens
YTKAWEEYY

SEQ ID NO: 157674 - protein, 9 aa, Homo Sapiens
YTNGKCVIL

SEQ ID NO: 157675 - protein, 9 aa, Homo Sapiens
YTRPAISSF

SEQ ID NO: 157676 - protein, 9 aa, Homo Sapiens
YTRPGLPTF

SEQ ID NO: 157677 - protein, 9 aa, Homo Sapiens
YTVGGLETF

SEQ ID NO: 157678 - protein, 9 aa, Homo Sapiens
YVHETLTVY

SEQ ID NO: 157679 - protein, 9 aa, Homo Sapiens
YVIQHVLEH

SEQ ID NO: 157680 - protein, 9 aa, Homo Sapiens
YVKGGLSTF

SEQ ID NO: 157681 - protein, 9 aa, Homo Sapiens
YVTTSTRTY

SEQ ID NO: 157682 - protein, 10 aa, Homo Sapiens
AAAAAAAAAY

SEQ ID NO: 157683 - protein, 10 aa, Homo Sapiens
AAAAAAAAMS

SEQ ID NO: 157684 - protein, 10 aa, Homo Sapiens
AAAAAAAAQY

SEQ ID NO: 157685 - protein, 10 aa, Homo Sapiens
AAAAAAAATM

SEQ ID NO: 157686 - protein, 10 aa, Homo Sapiens
AAAAAAQSVY

SEQ ID NO: 157687 - protein, 10 aa, Homo Sapiens
AAAEAAAAVV

SEQ ID NO: 157688 - protein, 10 aa, Homo Sapiens
AAAEADRTLF

SEQ ID NO: 157689 - protein, 10 aa, Homo Sapiens
AAAGAAATHL

SEQ ID NO: 157690 - protein, 10 aa, Homo Sapiens
AAFDASRTSF

SEQ ID NO: 157691 - protein, 10 aa, Homo Sapiens
AAFGGHPQCL

SEQ ID NO: 157692 - protein, 10 aa, Homo Sapiens
AAFGGNPKSV

SEQ ID NO: 157693 - protein, 10 aa, Homo Sapiens
AAFKPTSQHY

SEQ ID NO: 157694 - protein, 10 aa, Homo Sapiens
AAIYLSRGFF

SEQ ID NO: 157695 - protein, 10 aa, Homo Sapiens
AAVSPSSVFY

SEQ ID NO: 157696 - protein, 10 aa, Homo Sapiens
AAWEPSKNTL

SEQ ID NO: 157697 - protein, 10 aa, Homo Sapiens
AAYGGYPTAH

SEQ ID NO: 157698 - protein, 10 aa, Homo Sapiens
AAYNGHCEAL

SEQ ID NO: 157699 - protein, 10 aa, Homo Sapiens
AAYYGNISHF

SEQ ID NO: 157700 - protein, 10 aa, Homo Sapiens
AGIEGPLLAS

SEQ ID NO: 157701 - protein, 10 aa, Homo Sapiens
APIRPDIVNF

SEQ ID NO: 157702 - protein, 10 aa, Homo Sapiens
ARAVATATMI

SEQ ID NO: 157703 - protein, 10 aa, Homo Sapiens
ASFDGRISVY

SEQ ID NO: 157704 - protein, 10 aa, Homo Sapiens
ATAAAAAAAF

SEQ ID NO: 157705 - protein, 10 aa, Homo Sapiens
ATFDASRTTF

SEQ ID NO: 157706 - protein, 10 aa, Homo Sapiens
CENVRDIPLL

SEQ ID NO: 157707 - protein, 10 aa, Homo Sapiens
EEQLQQIRAE

SEQ ID NO: 157708 - protein, 10 aa, Homo Sapiens
FAAVAAAAYY

SEQ ID NO: 157709 - protein, 10 aa, Homo Sapiens
FAFADAPNHY

SEQ ID NO: 157710 - protein, 10 aa, Homo Sapiens
FAIDPNEPTY

SEQ ID NO: 157711 - protein, 10 aa, Homo Sapiens
FAIGGIARTY

SEQ ID NO: 157712 - protein, 10 aa, Homo Sapiens
FAIGSQVSEH

SEQ ID NO: 157713 - protein, 10 aa, Homo Sapiens
FAKGPTLTVY

SEQ ID NO: 157714 - protein, 10 aa, Homo Sapiens
FAKTFVGTPY

SEQ ID NO: 157715 - protein, 10 aa, Homo Sapiens
FAVDLEHHSY

SEQ ID NO: 157716 - protein, 10 aa, Homo Sapiens
FAVDPRIITH

SEQ ID NO: 157717 - protein, 10 aa, Homo Sapiens
FAWEPNGSKF

SEQ ID NO: 157718 - protein, 10 aa, Homo Sapiens
FAYDPSNYEY

SEQ ID NO: 157719 - protein, 10 aa, Homo Sapiens
FAYGGHPYPF

SEQ ID NO: 157720 - protein, 10 aa, Homo Sapiens
FAYPNRPDVL

SEQ ID NO: 157721 - protein, 10 aa, Homo Sapiens
FIIDTRDAGY

SEQ ID NO: 157722 - protein, 10 aa, Homo Sapiens
FIMDTGNQRF

SEQ ID NO: 157723 - protein, 10 aa, Homo Sapiens
FIPSSVPATF

SEQ ID NO: 157724 - protein, 10 aa, Homo Sapiens
FIYDSVKVYF

SEQ ID NO: 157725 - protein, 10 aa, Homo Sapiens
FSFGGKLVTF

SEQ ID NO: 157726 - protein, 10 aa, Homo Sapiens
GAFDGRPADY

SEQ ID NO: 157727 - protein, 10 aa, Homo Sapiens
HAFDGRPSVA

SEQ ID NO: 157728 - protein, 10 aa, Homo Sapiens
HAFGGNKASY

SEQ ID NO: 157729 - protein, 10 aa, Homo Sapiens
HAYIFRPEVY

SEQ ID NO: 157730 - protein, 10 aa, Homo Sapiens
HGIDPTGTYH

SEQ ID NO: 157731 - protein, 10 aa, Homo Sapiens
HLPEHEVMPH

SEQ ID NO: 157732 - protein, 10 aa, Homo Sapiens
HVKDANGNSF

SEQ ID NO: 157733 - protein, 10 aa, Homo Sapiens
IAFDPRSAYY

SEQ ID NO: 157734 - protein, 10 aa, Homo Sapiens
IAFIPNDVYF

SEQ ID NO: 157735 - protein, 10 aa, Homo Sapiens
IAPDFPAQVL

SEQ ID NO: 157736 - protein, 10 aa, Homo Sapiens
IIIDGGNSEY

SEQ ID NO: 157737 - protein, 10 aa, Homo Sapiens
ILKSPGSVVF

SEQ ID NO: 157738 - protein, 10 aa, Homo Sapiens
ISFDGSYVNY

SEQ ID NO: 157739 - protein, 10 aa, Homo Sapiens
ITSEAPFLHY

SEQ ID NO: 157740 - protein, 10 aa, Homo Sapiens
IVKKPGNIYY

SEQ ID NO: 157741 - protein, 10 aa, Homo Sapiens
KAADFQLHTH

SEQ ID NO: 157742 - protein, 10 aa, Homo Sapiens
KAFISKVSTH

SEQ ID NO: 157743 - protein, 10 aa, Homo Sapiens
KAYDKAVASF

SEQ ID NO: 157744 - protein, 10 aa, Homo Sapiens
KIIETTGVHF

SEQ ID NO: 157745 - protein, 10 aa, Homo Sapiens
KIPNFWVTTF

SEQ ID NO: 157746 - protein, 10 aa, Homo Sapiens
KLFPGSPAIY

SEQ ID NO: 157747 - protein, 10 aa, Homo Sapiens
KLYEGVPLPF

SEQ ID NO: 157748 - protein, 10 aa, Homo Sapiens
KVADWTGATY

SEQ ID NO: 157749 - protein, 10 aa, Homo Sapiens
KVAEAAIQIF

SEQ ID NO: 157750 - protein, 10 aa, Homo Sapiens
KVFDGIPPPY

SEQ ID NO: 157751 - protein, 10 aa, Homo Sapiens
KVPQLEIVPN

SEQ ID NO: 157752 - protein, 10 aa, Homo Sapiens
LAAADISAYY

SEQ ID NO: 157753 - protein, 10 aa, Homo Sapiens
LAADFEIGHF

SEQ ID NO: 157754 - protein, 10 aa, Homo Sapiens
LPAAAAAGAA

SEQ ID NO: 157755 - protein, 10 aa, Homo Sapiens
LTAAAYRVTL

SEQ ID NO: 157756 - protein, 10 aa, Homo Sapiens
MAYGASFLSF

SEQ ID NO: 157757 - protein, 10 aa, Homo Sapiens
MIKEGDYNPL

SEQ ID NO: 157758 - protein, 10 aa, Homo Sapiens
MSYDRAITVF

SEQ ID NO: 157759 - protein, 10 aa, Homo Sapiens
NGFTGQPATY

SEQ ID NO: 157760 - protein, 10 aa, Homo Sapiens
QTPDFTPTKY

SEQ ID NO: 157761 - protein, 10 aa, Homo Sapiens
RALPFVPMSY

SEQ ID NO: 157762 - protein, 10 aa, Homo Sapiens
RAVDFFGAFY

SEQ ID NO: 157763 - protein, 10 aa, Homo Sapiens
RAWYGLGQTY

SEQ ID NO: 157764 - protein, 10 aa, Homo Sapiens
RIPEFNMAAF

SEQ ID NO: 157765 - protein, 10 aa, Homo Sapiens
RSKNPSKESF

SEQ ID NO: 157766 - protein, 10 aa, Homo Sapiens
RTVDWALAEY

SEQ ID NO: 157767 - protein, 10 aa, Homo Sapiens
RVFDHKQGTY

SEQ ID NO: 157768 - protein, 10 aa, Homo Sapiens
RVKGPGISKF

SEQ ID NO: 157769 - protein, 10 aa, Homo Sapiens
SACRTSGQTF

SEQ ID NO: 157770 - protein, 10 aa, Homo Sapiens
SAYSGHYIAH

SEQ ID NO: 157771 - protein, 10 aa, Homo Sapiens
SGFDGTVQVY

SEQ ID NO: 157772 - protein, 10 aa, Homo Sapiens
TAAETHYTYF

SEQ ID NO: 157773 - protein, 10 aa, Homo Sapiens
TAKRPSDIKF

SEQ ID NO: 157774 - protein, 10 aa, Homo Sapiens
TVKDVNQQEF

SEQ ID NO: 157775 - protein, 10 aa, Homo Sapiens
VAAPPPKNSF

SEQ ID NO: 157776 - protein, 10 aa, Homo Sapiens
VAASAYKALF

SEQ ID NO: 157777 - protein, 10 aa, Homo Sapiens
VAFCPDDTHF

SEQ ID NO: 157778 - protein, 10 aa, Homo Sapiens
VAFHPDGKSY

SEQ ID NO: 157779 - protein, 10 aa, Homo Sapiens
VAFTPDGNHF

SEQ ID NO: 157780 - protein, 10 aa, Homo Sapiens
VAMGKALLEF

SEQ ID NO: 157781 - protein, 10 aa, Homo Sapiens
VAMNPTNTVF

SEQ ID NO: 157782 - protein, 10 aa, Homo Sapiens
VAPVGSGSAL

SEQ ID NO: 157783 - protein, 10 aa, Homo Sapiens
VAYGATRYNY

SEQ ID NO: 157784 - protein, 10 aa, Homo Sapiens
VAYGVRESVF

SEQ ID NO: 157785 - protein, 10 aa, Homo Sapiens
VLPHQPLATY

SEQ ID NO: 157786 - protein, 10 aa, Homo Sapiens
VSKNPSKPHF

SEQ ID NO: 157787 - protein, 10 aa, Homo Sapiens
VSWTGKPVSY

SEQ ID NO: 157788 - protein, 10 aa, Homo Sapiens
VVPPFLQPEV

SEQ ID NO: 157789 - protein, 10 aa, Homo Sapiens
YAAPHPLQSY

SEQ ID NO: 157790 - protein, 10 aa, Homo Sapiens
YAFPKAVSVF

SEQ ID NO: 157791 - protein, 10 aa, Homo Sapiens
YAFPKSITVF

SEQ ID NO: 157792 - protein, 10 aa, Homo Sapiens
YANDFASEYY

SEQ ID NO: 157793 - protein, 10 aa, Homo Sapiens
YAVDRAITHL

SEQ ID NO: 157794 - protein, 10 aa, Homo Sapiens
YINPAKLTPY

SEQ ID NO: 157795 - protein, 10 aa, Homo Sapiens
YIPEHSPEYY

SEQ ID NO: 157796 - protein, 10 aa, Homo Sapiens
YLAPFSLSNY

SEQ ID NO: 157797 - protein, 10 aa, Homo Sapiens
YLPDFRFTPF

SEQ ID NO: 157798 - protein, 10 aa, Homo Sapiens
YLPQHTIETY

SEQ ID NO: 157799 - protein, 10 aa, Homo Sapiens
YMIDPSGVSY

SEQ ID NO: 157800 - protein, 10 aa, Homo Sapiens
YVFDGKPPQL

SEQ ID NO: 157801 - protein, 10 aa, Homo Sapiens
YVIEPHSMEF

SEQ ID NO: 157802 - protein, 10 aa, Homo Sapiens
YVIPHPVHAF

SEQ ID NO: 157803 - protein, 11 aa, Homo Sapiens
AAAQAASQHVF

SEQ ID NO: 157804 - protein, 11 aa, Homo Sapiens
AAFESDKSSYF

SEQ ID NO: 157805 - protein, 11 aa, Homo Sapiens
AAFGSEKPQSM

SEQ ID NO: 157806 - protein, 11 aa, Homo Sapiens
AAINPELLQLL

SEQ ID NO: 157807 - protein, 11 aa, Homo Sapiens
AAKDPANGRQF

SEQ ID NO: 157808 - protein, 11 aa, Homo Sapiens
AAKLPGEGAAL

SEQ ID NO: 157809 - protein, 11 aa, Homo Sapiens
AAQDPEDLCTF

SEQ ID NO: 157810 - protein, 11 aa, Homo Sapiens
AARPGFQQTSH

SEQ ID NO: 157811 - protein, 11 aa, Homo Sapiens
AAVDPDVLLSY

SEQ ID NO: 157812 - protein, 11 aa, Homo Sapiens
AAYYPSDVSSL

SEQ ID NO: 157813 - protein, 11 aa, Homo Sapiens
ASKDPTVSQTF

SEQ ID NO: 157814 - protein, 11 aa, Homo Sapiens
ATIDPDTISAL

SEQ ID NO: 157815 - protein, 11 aa, Homo Sapiens
AVRDISEASVF

SEQ ID NO: 157816 - protein, 11 aa, Homo Sapiens
EGCSSPIVVKF

SEQ ID NO: 157817 - protein, 11 aa, Homo Sapiens
FAKPVYPGQTL

SEQ ID NO: 157818 - protein, 11 aa, Homo Sapiens
FAKSVSFSDVF

SEQ ID NO: 157819 - protein, 11 aa, Homo Sapiens
FAVDPEKIQLY

SEQ ID NO: 157820 - protein, 11 aa, Homo Sapiens
FAYDGKDYLTL

SEQ ID NO: 157821 - protein, 11 aa, Homo Sapiens
FSKAPGSAGHY

SEQ ID NO: 157822 - protein, 11 aa, Homo Sapiens
FSKYPASSSVF

SEQ ID NO: 157823 - protein, 11 aa, Homo Sapiens
GVVDPRAISVL

SEQ ID NO: 157824 - protein, 11 aa, Homo Sapiens
HALDLGAMTPF

SEQ ID NO: 157825 - protein, 11 aa, Homo Sapiens
HAYDGKDYISL

SEQ ID NO: 157826 - protein, 11 aa, Homo Sapiens
IAMENIHSEMY

SEQ ID NO: 157827 - protein, 11 aa, Homo Sapiens
IIHDPGRGAPL

SEQ ID NO: 157828 - protein, 11 aa, Homo Sapiens
IIMEPTECSEL

SEQ ID NO: 157829 - protein, 11 aa, Homo Sapiens
ILQDPRLITPL

SEQ ID NO: 157830 - protein, 11 aa, Homo Sapiens
KAAEAAASAYY

SEQ ID NO: 157831 - protein, 11 aa, Homo Sapiens
KDAGLGQLATM

SEQ ID NO: 157832 - protein, 11 aa, Homo Sapiens
KLIEPGFLTAF

SEQ ID NO: 157833 - protein, 11 aa, Homo Sapiens
KQAEFFEPWVY

SEQ ID NO: 157834 - protein, 11 aa, Homo Sapiens
KQIDPEMLNSF

SEQ ID NO: 157835 - protein, 11 aa, Homo Sapiens
KVFDPSCGLPY

SEQ ID NO: 157836 - protein, 11 aa, Homo Sapiens
LAAAAAASYQV

SEQ ID NO: 157837 - protein, 11 aa, Homo Sapiens
LAVDGGKLTVF

SEQ ID NO: 157838 - protein, 11 aa, Homo Sapiens
LSRDPETLVGY

SEQ ID NO: 157839 - protein, 11 aa, Homo Sapiens
LVAQIAAGMEY

SEQ ID NO: 157840 - protein, 11 aa, Homo Sapiens
MIISPERLDPF

SEQ ID NO: 157841 - protein, 11 aa, Homo Sapiens
NAFDQYRDLYF

SEQ ID NO: 157842 - protein, 11 aa, Homo Sapiens
NSYWVGEDSTY

SEQ ID NO: 157843 - protein, 11 aa, Homo Sapiens
QAFWGTGKGYF

SEQ ID NO: 157844 - protein, 11 aa, Homo Sapiens
RAFDQGADAIY

SEQ ID NO: 157845 - protein, 11 aa, Homo Sapiens
RAFDSQNNTVY

SEQ ID NO: 157846 - protein, 11 aa, Homo Sapiens
RAFGGKDIKVY

SEQ ID NO: 157847 - protein, 11 aa, Homo Sapiens
RAFGNLGNTHY

SEQ ID NO: 157848 - protein, 11 aa, Homo Sapiens
RAVEPALLQRY

SEQ ID NO: 157849 - protein, 11 aa, Homo Sapiens
RIIDPEDLKAL

SEQ ID NO: 157850 - protein, 11 aa, Homo Sapiens
RIMDPDVITGY

SEQ ID NO: 157851 - protein, 11 aa, Homo Sapiens
SAKDARGMTPF

SEQ ID NO: 157852 - protein, 11 aa, Homo Sapiens
SAVNPEHLSYF

SEQ ID NO: 157853 - protein, 11 aa, Homo Sapiens
SAYDGKDYIAL

SEQ ID NO: 157854 - protein, 11 aa, Homo Sapiens
SIKDVLDSEGY

SEQ ID NO: 157855 - protein, 11 aa, Homo Sapiens
SINPLGGFVHY

SEQ ID NO: 157856 - protein, 11 aa, Homo Sapiens
SSINPDHLSYF

SEQ ID NO: 157857 - protein, 11 aa, Homo Sapiens
SSINPDHLTYF

SEQ ID NO: 157858 - protein, 11 aa, Homo Sapiens
STIDASNISCF

SEQ ID NO: 157859 - protein, 11 aa, Homo Sapiens
STINPDHLSYF

SEQ ID NO: 157860 - protein, 11 aa, Homo Sapiens
SVIDSAELQAY

SEQ ID NO: 157861 - protein, 11 aa, Homo Sapiens
SVTDPEKLNNY

SEQ ID NO: 157862 - protein, 11 aa, Homo Sapiens
SVTQAECSGVI

SEQ ID NO: 157863 - protein, 11 aa, Homo Sapiens
TAIPSELFSSF

SEQ ID NO: 157864 - protein, 11 aa, Homo Sapiens
TAQDPKLLVHL

SEQ ID NO: 157865 - protein, 11 aa, Homo Sapiens
TAVDPTLLKTF

SEQ ID NO: 157866 - protein, 11 aa, Homo Sapiens
TIFEGGKATCF

SEQ ID NO: 157867 - protein, 11 aa, Homo Sapiens
TIIDSDKIMVL

SEQ ID NO: 157868 - protein, 11 aa, Homo Sapiens
TTIDPRWLVEF

SEQ ID NO: 157869 - protein, 11 aa, Homo Sapiens
VAFEVYDDFLH

SEQ ID NO: 157870 - protein, 11 aa, Homo Sapiens
VAIQPDVFSHY

SEQ ID NO: 157871 - protein, 11 aa, Homo Sapiens
VAMSPELIQQF

SEQ ID NO: 157872 - protein, 11 aa, Homo Sapiens
VAQGVRVGGVF

SEQ ID NO: 157873 - protein, 11 aa, Homo Sapiens
VAQNPANMSKY

SEQ ID NO: 157874 - protein, 11 aa, Homo Sapiens
VAVDPSILARL

SEQ ID NO: 157875 - protein, 11 aa, Homo Sapiens
VAYPHDGKIFF

SEQ ID NO: 157876 - protein, 11 aa, Homo Sapiens
VIRDAVTYTEH

SEQ ID NO: 157877 - protein, 11 aa, Homo Sapiens
VLRPPGGGSNF

SEQ ID NO: 157878 - protein, 11 aa, Homo Sapiens
VMMDPNSTQRY

SEQ ID NO: 157879 - protein, 11 aa, Homo Sapiens
VSIEPNFHSLY

SEQ ID NO: 157880 - protein, 11 aa, Homo Sapiens
YAKDTRYSSSF

SEQ ID NO: 157881 - protein, 11 aa, Homo Sapiens
YAKPLAALVTY

SEQ ID NO: 157882 - protein, 11 aa, Homo Sapiens
YAVDPAQLQAL

SEQ ID NO: 157883 - protein, 11 aa, Homo Sapiens
YAWESSAGGSF

SEQ ID NO: 157884 - protein, 11 aa, Homo Sapiens
YAYDGKDYIAL

SEQ ID NO: 157885 - protein, 11 aa, Homo Sapiens
YAYDIEDGKFY

SEQ ID NO: 157886 - protein, 11 aa, Homo Sapiens
YIAGHPAFVNY

SEQ ID NO: 157887 - protein, 11 aa, Homo Sapiens
YLFEPHSGEEY

SEQ ID NO: 157888 - protein, 11 aa, Homo Sapiens
YSLDGRLLSTY

SEQ ID NO: 157889 - protein, 11 aa, Homo Sapiens
YVIDQGETDVY

SEQ ID NO: 157890 - protein, 8 aa, Homo Sapiens
AAFPIAVV

SEQ ID NO: 157891 - protein, 8 aa, Homo Sapiens
AAFRIVVM

SEQ ID NO: 157892 - protein, 8 aa, Homo Sapiens
AAGPPLVA

SEQ ID NO: 157893 - protein, 8 aa, Homo Sapiens
AFAEALLL

SEQ ID NO: 157894 - protein, 8 aa, Homo Sapiens
ASFNRMVM

SEQ ID NO: 157895 - protein, 8 aa, Homo Sapiens
ASGLIHRV

SEQ ID NO: 157896 - protein, 8 aa, Homo Sapiens
ASNYHLEV

SEQ ID NO: 157897 - protein, 8 aa, Homo Sapiens
AVGPASIL

SEQ ID NO: 157898 - protein, 8 aa, Homo Sapiens
CAFRVIQV

SEQ ID NO: 157899 - protein, 8 aa, Homo Sapiens
CSFRVLVV

SEQ ID NO: 157900 - protein, 8 aa, Homo Sapiens
ESLIACKA

SEQ ID NO: 157901 - protein, 8 aa, Homo Sapiens
FAAEAIAM

SEQ ID NO: 157902 - protein, 8 aa, Homo Sapiens
FAFVEFEL

SEQ ID NO: 157903 - protein, 8 aa, Homo Sapiens
FAFVEGTL

SEQ ID NO: 157904 - protein, 8 aa, Homo Sapiens
FAFVEYEV

SEQ ID NO: 157905 - protein, 8 aa, Homo Sapiens
FAFVHISF

SEQ ID NO: 157906 - protein, 8 aa, Homo Sapiens
FAGGMLRV

SEQ ID NO: 157907 - protein, 8 aa, Homo Sapiens
FAGLVQEI

SEQ ID NO: 157908 - protein, 8 aa, Homo Sapiens
FAGPCKVI

SEQ ID NO: 157909 - protein, 8 aa, Homo Sapiens
FAGPHSTL

SEQ ID NO: 157910 - protein, 8 aa, Homo Sapiens
FAHGFHEL

SEQ ID NO: 157911 - protein, 8 aa, Homo Sapiens
FAHIQAVF

SEQ ID NO: 157912 - protein, 8 aa, Homo Sapiens
FAHSFIEL

SEQ ID NO: 157913 - protein, 8 aa, Homo Sapiens
FAKCIEVM

SEQ ID NO: 157914 - protein, 8 aa, Homo Sapiens
FAKLVREV

SEQ ID NO: 157915 - protein, 8 aa, Homo Sapiens
FAMPHSIM

SEQ ID NO: 157916 - protein, 8 aa, Homo Sapiens
FANYIDKV

SEQ ID NO: 157917 - protein, 8 aa, Homo Sapiens
FFKMREMF

SEQ ID NO: 157918 - protein, 8 aa, Homo Sapiens
FGFHKPKM

SEQ ID NO: 157919 - protein, 8 aa, Homo Sapiens
FGNVHAYL

SEQ ID NO: 157920 - protein, 8 aa, Homo Sapiens
FNHINVEL

SEQ ID NO: 157921 - protein, 8 aa, Homo Sapiens
FQQPVMAL

SEQ ID NO: 157922 - protein, 8 aa, Homo Sapiens
FSFCREEM

SEQ ID NO: 157923 - protein, 8 aa, Homo Sapiens
FSFQEPIM

SEQ ID NO: 157924 - protein, 8 aa, Homo Sapiens
FSGPAITL

SEQ ID NO: 157925 - protein, 8 aa, Homo Sapiens
FSHLQPTL

SEQ ID NO: 157926 - protein, 8 aa, Homo Sapiens
FSKTWIEV

SEQ ID NO: 157927 - protein, 8 aa, Homo Sapiens
FSKVTKIL

SEQ ID NO: 157928 - protein, 8 aa, Homo Sapiens
FVNVQKEL

SEQ ID NO: 157929 - protein, 8 aa, Homo Sapiens
FWFFREAF

SEQ ID NO: 157930 - protein, 8 aa, Homo Sapiens
FWMTRQEY

SEQ ID NO: 157931 - protein, 8 aa, Homo Sapiens
HAGVISVL

SEQ ID NO: 157932 - protein, 8 aa, Homo Sapiens
HFNTRLSF

SEQ ID NO: 157933 - protein, 8 aa, Homo Sapiens
HSGPIHVL

SEQ ID NO: 157934 - protein, 8 aa, Homo Sapiens
IAGPVVEI

SEQ ID NO: 157935 - protein, 8 aa, Homo Sapiens
IANAISVV

SEQ ID NO: 157936 - protein, 8 aa, Homo Sapiens
IANINNCL

SEQ ID NO: 157937 - protein, 8 aa, Homo Sapiens
IEFIRSEY

SEQ ID NO: 157938 - protein, 8 aa, Homo Sapiens
IFKERESF

SEQ ID NO: 157939 - protein, 8 aa, Homo Sapiens
IIHEIAVL

SEQ ID NO: 157940 - protein, 8 aa, Homo Sapiens
ITGPLIRI

SEQ ID NO: 157941 - protein, 8 aa, Homo Sapiens
ITNIRPSF

SEQ ID NO: 157942 - protein, 8 aa, Homo Sapiens
IVGPQLTV

SEQ ID NO: 157943 - protein, 8 aa, Homo Sapiens
KAFFIESV

SEQ ID NO: 157944 - protein, 8 aa, Homo Sapiens
KAFLNAIM

SEQ ID NO: 157945 - protein, 8 aa, Homo Sapiens
KAFLNAVM

SEQ ID NO: 157946 - protein, 8 aa, Homo Sapiens
KAKFISSV

SEQ ID NO: 157947 - protein, 8 aa, Homo Sapiens
LAFLTCLL

SEQ ID NO: 157948 - protein, 8 aa, Homo Sapiens
LAGPALEL

SEQ ID NO: 157949 - protein, 8 aa, Homo Sapiens
LAGPVQEV

SEQ ID NO: 157950 - protein, 8 aa, Homo Sapiens
LANFCRIL

SEQ ID NO: 157951 - protein, 8 aa, Homo Sapiens
LAWINESL

SEQ ID NO: 157952 - protein, 8 aa, Homo Sapiens
LFFERSVY

SEQ ID NO: 157953 - protein, 8 aa, Homo Sapiens
LFYFRVPF

SEQ ID NO: 157954 - protein, 8 aa, Homo Sapiens
LQAFVPLR

SEQ ID NO: 157955 - protein, 8 aa, Homo Sapiens
LSKIIAVL

SEQ ID NO: 157956 - protein, 8 aa, Homo Sapiens
LTGPIQVI

SEQ ID NO: 157957 - protein, 8 aa, Homo Sapiens
LTGPVNVL

SEQ ID NO: 157958 - protein, 8 aa, Homo Sapiens
MFHIRAVI

SEQ ID NO: 157959 - protein, 8 aa, Homo Sapiens
MFHNRHLF

SEQ ID NO: 157960 - protein, 8 aa, Homo Sapiens
MSGKVKVW

SEQ ID NO: 157961 - protein, 8 aa, Homo Sapiens
MSGLLKVW

SEQ ID NO: 157962 - protein, 8 aa, Homo Sapiens
MSKLISEM

SEQ ID NO: 157963 - protein, 8 aa, Homo Sapiens
MSYVHTTV

SEQ ID NO: 157964 - protein, 8 aa, Homo Sapiens
NAASPLIV

SEQ ID NO: 157965 - protein, 8 aa, Homo Sapiens
NAFFNNTI

SEQ ID NO: 157966 - protein, 8 aa, Homo Sapiens
NAGPAIVI

SEQ ID NO: 157967 - protein, 8 aa, Homo Sapiens
NIFRNVEV

SEQ ID NO: 157968 - protein, 8 aa, Homo Sapiens
NSFVSLSV

SEQ ID NO: 157969 - protein, 8 aa, Homo Sapiens
NSMLVSIV

SEQ ID NO: 157970 - protein, 8 aa, Homo Sapiens
QAFIHNSL

SEQ ID NO: 157971 - protein, 8 aa, Homo Sapiens
RAFLQAIL

SEQ ID NO: 157972 - protein, 8 aa, Homo Sapiens
RAFREIQL

SEQ ID NO: 157973 - protein, 8 aa, Homo Sapiens
RTFSWASV

SEQ ID NO: 157974 - protein, 8 aa, Homo Sapiens
SAFAGWEV

SEQ ID NO: 157975 - protein, 8 aa, Homo Sapiens
SAGPMRLY

SEQ ID NO: 157976 - protein, 8 aa, Homo Sapiens
SAYEVIKL

SEQ ID NO: 157977 - protein, 8 aa, Homo Sapiens
SGFRNIAV

SEQ ID NO: 157978 - protein, 8 aa, Homo Sapiens
TFPHPVYY

SEQ ID NO: 157979 - protein, 8 aa, Homo Sapiens
TIFRTISV

SEQ ID NO: 157980 - protein, 8 aa, Homo Sapiens
TQMVRMIL

SEQ ID NO: 157981 - protein, 8 aa, Homo Sapiens
VAFFNNFL

SEQ ID NO: 157982 - protein, 8 aa, Homo Sapiens
VAFRICAV

SEQ ID NO: 157983 - protein, 8 aa, Homo Sapiens
VAGFNPAL

SEQ ID NO: 157984 - protein, 8 aa, Homo Sapiens
VAGPVGLL

SEQ ID NO: 157985 - protein, 8 aa, Homo Sapiens
VAKVEPAV

SEQ ID NO: 157986 - protein, 8 aa, Homo Sapiens
VAMQVPVV

SEQ ID NO: 157987 - protein, 8 aa, Homo Sapiens
VAMVHPLL

SEQ ID NO: 157988 - protein, 8 aa, Homo Sapiens
VANVEHIL

SEQ ID NO: 157989 - protein, 8 aa, Homo Sapiens
VINYAMFL

SEQ ID NO: 157990 - protein, 8 aa, Homo Sapiens
VPCILVGP

SEQ ID NO: 157991 - protein, 8 aa, Homo Sapiens
VTHLHRVV

SEQ ID NO: 157992 - protein, 8 aa, Homo Sapiens
VTHVIPVA

SEQ ID NO: 157993 - protein, 8 aa, Homo Sapiens
VTKLRMEL

SEQ ID NO: 157994 - protein, 8 aa, Homo Sapiens
VVGPSSVL

SEQ ID NO: 157995 - protein, 8 aa, Homo Sapiens
YAFLHRTL

SEQ ID NO: 157996 - protein, 8 aa, Homo Sapiens
YAFLREAL

SEQ ID NO: 157997 - protein, 8 aa, Homo Sapiens
YAFNRDII

SEQ ID NO: 157998 - protein, 8 aa, Homo Sapiens
YAGAILEV

SEQ ID NO: 157999 - protein, 8 aa, Homo Sapiens
YAKLHPEM

SEQ ID NO: 158000 - protein, 8 aa, Homo Sapiens
YAKLIAEL

SEQ ID NO: 158001 - protein, 8 aa, Homo Sapiens
YGMPRQIL

SEQ ID NO: 158002 - protein, 8 aa, Homo Sapiens
YIQVEPVL

SEQ ID NO: 158003 - protein, 8 aa, Homo Sapiens
YQFFREAL

SEQ ID NO: 158004 - protein, 8 aa, Homo Sapiens
YVFIWRTV

SEQ ID NO: 158005 - protein, 9 aa, Homo Sapiens
AAAALHPAL

SEQ ID NO: 158006 - protein, 9 aa, Homo Sapiens
AAAALVLKA

SEQ ID NO: 158007 - protein, 9 aa, Homo Sapiens
AAAAVIPTV

SEQ ID NO: 158008 - protein, 9 aa, Homo Sapiens
AAADIFKHY

SEQ ID NO: 158009 - protein, 9 aa, Homo Sapiens
AAADIVNFL

SEQ ID NO: 158010 - protein, 9 aa, Homo Sapiens
AAADSIKIW

SEQ ID NO: 158011 - protein, 9 aa, Homo Sapiens
AAAFQPLII

SEQ ID NO: 158012 - protein, 9 aa, Homo Sapiens
AAAGLHRYL

SEQ ID NO: 158013 - protein, 9 aa, Homo Sapiens
AAAGWLLRL

SEQ ID NO: 158014 - protein, 9 aa, Homo Sapiens
AAAHFYFEL

SEQ ID NO: 158015 - protein, 9 aa, Homo Sapiens
AAAIGLVIY

SEQ ID NO: 158016 - protein, 9 aa, Homo Sapiens
AAAKALRIL

SEQ ID NO: 158017 - protein, 9 aa, Homo Sapiens
AAAKNIRVW

SEQ ID NO: 158018 - protein, 9 aa, Homo Sapiens
AAANAIRVY

SEQ ID NO: 158019 - protein, 9 aa, Homo Sapiens
AAANLTKIV

SEQ ID NO: 158020 - protein, 9 aa, Homo Sapiens
AAAPHLLLL

SEQ ID NO: 158021 - protein, 9 aa, Homo Sapiens
AAAPIISSV

SEQ ID NO: 158022 - protein, 9 aa, Homo Sapiens
AAAPLRLIA

SEQ ID NO: 158023 - protein, 9 aa, Homo Sapiens
AAAPQLLIV

SEQ ID NO: 158024 - protein, 9 aa, Homo Sapiens
AAAPSLLIL

SEQ ID NO: 158025 - protein, 9 aa, Homo Sapiens
AAAPVIKAY

SEQ ID NO: 158026 - protein, 9 aa, Homo Sapiens
AAASFPWSA

SEQ ID NO: 158027 - protein, 9 aa, Homo Sapiens
AAASIANIV

SEQ ID NO: 158028 - protein, 9 aa, Homo Sapiens
AAASLIRLV

SEQ ID NO: 158029 - protein, 9 aa, Homo Sapiens
AAASLVPVV

SEQ ID NO: 158030 - protein, 9 aa, Homo Sapiens
AAATSVHVV

SEQ ID NO: 158031 - protein, 9 aa, Homo Sapiens
AAFADALEF

SEQ ID NO: 158032 - protein, 9 aa, Homo Sapiens
AAFAYTVKY

SEQ ID NO: 158033 - protein, 9 aa, Homo Sapiens
AAFCKLIVY

SEQ ID NO: 158034 - protein, 9 aa, Homo Sapiens
AAFDAAWMV

SEQ ID NO: 158035 - protein, 9 aa, Homo Sapiens
AAFDGGFTV

SEQ ID NO: 158036 - protein, 9 aa, Homo Sapiens
AAFDHICTF

SEQ ID NO: 158037 - protein, 9 aa, Homo Sapiens
AAFDKIQQL

SEQ ID NO: 158038 - protein, 9 aa, Homo Sapiens
AAFDQWREW

SEQ ID NO: 158039 - protein, 9 aa, Homo Sapiens
AAFEGTVFF

SEQ ID NO: 158040 - protein, 9 aa, Homo Sapiens
AAFEKALEV

SEQ ID NO: 158041 - protein, 9 aa, Homo Sapiens
AAFGAPGII

SEQ ID NO: 158042 - protein, 9 aa, Homo Sapiens
AAFGDKIFY

SEQ ID NO: 158043 - protein, 9 aa, Homo Sapiens
AAFGGFLYF

SEQ ID NO: 158044 - protein, 9 aa, Homo Sapiens
AAFGRDLFL

SEQ ID NO: 158045 - protein, 9 aa, Homo Sapiens
AAFHEEFVV

SEQ ID NO: 158046 - protein, 9 aa, Homo Sapiens
AAFHLALYT

SEQ ID NO: 158047 - protein, 9 aa, Homo Sapiens
AAFHNFIKV

SEQ ID NO: 158048 - protein, 9 aa, Homo Sapiens
AAFIWPMLI

SEQ ID NO: 158049 - protein, 9 aa, Homo Sapiens
AAFLGERVF

SEQ ID NO: 158050 - protein, 9 aa, Homo Sapiens
AAFLKAIGY

SEQ ID NO: 158051 - protein, 9 aa, Homo Sapiens
AAFLLPVIM

SEQ ID NO: 158052 - protein, 9 aa, Homo Sapiens
AAFNALVTF

SEQ ID NO: 158053 - protein, 9 aa, Homo Sapiens
AAFPGASLY

SEQ ID NO: 158054 - protein, 9 aa, Homo Sapiens
AAFPGENAL

SEQ ID NO: 158055 - protein, 9 aa, Homo Sapiens
AAFPIAVVA

SEQ ID NO: 158056 - protein, 9 aa, Homo Sapiens
AAFPLAPLL

SEQ ID NO: 158057 - protein, 9 aa, Homo Sapiens
AAFPLPVVV

SEQ ID NO: 158058 - protein, 9 aa, Homo Sapiens
AAFPYGGVL

SEQ ID NO: 158059 - protein, 9 aa, Homo Sapiens
AAFPYPMMH

SEQ ID NO: 158060 - protein, 9 aa, Homo Sapiens
AAFQEAFYV

SEQ ID NO: 158061 - protein, 9 aa, Homo Sapiens
AAFQHLLLL

SEQ ID NO: 158062 - protein, 9 aa, Homo Sapiens
AAFQYGIKM

SEQ ID NO: 158063 - protein, 9 aa, Homo Sapiens
AAFSKLIIY

SEQ ID NO: 158064 - protein, 9 aa, Homo Sapiens
AAFSKYLTA

SEQ ID NO: 158065 - protein, 9 aa, Homo Sapiens
AAFTLRTQY

SEQ ID NO: 158066 - protein, 9 aa, Homo Sapiens
AAFTRALEY

SEQ ID NO: 158067 - protein, 9 aa, Homo Sapiens
AAFVKAVGF

SEQ ID NO: 158068 - protein, 9 aa, Homo Sapiens
AAFVKKLVY

SEQ ID NO: 158069 - protein, 9 aa, Homo Sapiens
AAFWGQMQM

SEQ ID NO: 158070 - protein, 9 aa, Homo Sapiens
AAFYGCLYA

SEQ ID NO: 158071 - protein, 9 aa, Homo Sapiens
AAFYHPVRY

SEQ ID NO: 158072 - protein, 9 aa, Homo Sapiens
AAGTTVKVW

SEQ ID NO: 158073 - protein, 9 aa, Homo Sapiens
AAIASLLYL

SEQ ID NO: 158074 - protein, 9 aa, Homo Sapiens
AAIDHQIEV

SEQ ID NO: 158075 - protein, 9 aa, Homo Sapiens
AAIEFISKM

SEQ ID NO: 158076 - protein, 9 aa, Homo Sapiens
AAIEHTIQW

SEQ ID NO: 158077 - protein, 9 aa, Homo Sapiens
AAIEWIIEH

SEQ ID NO: 158078 - protein, 9 aa, Homo Sapiens
AAIGLVIYY

SEQ ID NO: 158079 - protein, 9 aa, Homo Sapiens
AAIKAIKFY

SEQ ID NO: 158080 - protein, 9 aa, Homo Sapiens
AAIKIIRQL

SEQ ID NO: 158081 - protein, 9 aa, Homo Sapiens
AAILEHSLF

SEQ ID NO: 158082 - protein, 9 aa, Homo Sapiens
AAINFQPKM

SEQ ID NO: 158083 - protein, 9 aa, Homo Sapiens
AAISEVLYV

SEQ ID NO: 158084 - protein, 9 aa, Homo Sapiens
AAIYHVLHF

SEQ ID NO: 158085 - protein, 9 aa, Homo Sapiens
AAKDLISKL

SEQ ID NO: 158086 - protein, 9 aa, Homo Sapiens
AAKEQWKEL

SEQ ID NO: 158087 - protein, 9 aa, Homo Sapiens
AAKEYPFIL

SEQ ID NO: 158088 - protein, 9 aa, Homo Sapiens
AAKNFITKM

SEQ ID NO: 158089 - protein, 9 aa, Homo Sapiens
AAKPFFCEL

SEQ ID NO: 158090 - protein, 9 aa, Homo Sapiens
AALMRPLVV

SEQ ID NO: 158091 - protein, 9 aa, Homo Sapiens
AALPKATIL

SEQ ID NO: 158092 - protein, 9 aa, Homo Sapiens
AALTFPVLF

SEQ ID NO: 158093 - protein, 9 aa, Homo Sapiens
AALTIIRYY

SEQ ID NO: 158094 - protein, 9 aa, Homo Sapiens
AAMDSAWMV

SEQ ID NO: 158095 - protein, 9 aa, Homo Sapiens
AAMELAQMV

SEQ ID NO: 158096 - protein, 9 aa, Homo Sapiens
AAMLDTVVF

SEQ ID NO: 158097 - protein, 9 aa, Homo Sapiens
AAMPRIYEL

SEQ ID NO: 158098 - protein, 9 aa, Homo Sapiens
AAMPRPVSY

SEQ ID NO: 158099 - protein, 9 aa, Homo Sapiens
AAMPVAQHL

SEQ ID NO: 158100 - protein, 9 aa, Homo Sapiens
AAMSHLLEM

SEQ ID NO: 158101 - protein, 9 aa, Homo Sapiens
AAMWALQTV

SEQ ID NO: 158102 - protein, 9 aa, Homo Sapiens
AANPHSFVF

SEQ ID NO: 158103 - protein, 9 aa, Homo Sapiens
AAPALPFYY

SEQ ID NO: 158104 - protein, 9 aa, Homo Sapiens
AAQAIFPSM

SEQ ID NO: 158105 - protein, 9 aa, Homo Sapiens
AAQEAVKLY

SEQ ID NO: 158106 - protein, 9 aa, Homo Sapiens
AAQETVRLL

SEQ ID NO: 158107 - protein, 9 aa, Homo Sapiens
AAQFIPKFF

SEQ ID NO: 158108 - protein, 9 aa, Homo Sapiens
AAQSLVQLL

SEQ ID NO: 158109 - protein, 9 aa, Homo Sapiens
AAQVRIKIL

SEQ ID NO: 158110 - protein, 9 aa, Homo Sapiens
AARFGISSV

SEQ ID NO: 158111 - protein, 9 aa, Homo Sapiens
AARLRAVDF

SEQ ID NO: 158112 - protein, 9 aa, Homo Sapiens
AARPVPWNA

SEQ ID NO: 158113 - protein, 9 aa, Homo Sapiens
AASDFIFLV

SEQ ID NO: 158114 - protein, 9 aa, Homo Sapiens
AASGHFICV

SEQ ID NO: 158115 - protein, 9 aa, Homo Sapiens
AASGLPLMV

SEQ ID NO: 158116 - protein, 9 aa, Homo Sapiens
AASMRALVL

SEQ ID NO: 158117 - protein, 9 aa, Homo Sapiens
AASPIITLV

SEQ ID NO: 158118 - protein, 9 aa, Homo Sapiens
AASSIQRVL

SEQ ID NO: 158119 - protein, 9 aa, Homo Sapiens
AATEIVERV

SEQ ID NO: 158120 - protein, 9 aa, Homo Sapiens
AATEVVNIL

SEQ ID NO: 158121 - protein, 9 aa, Homo Sapiens
AATPAVRTV

SEQ ID NO: 158122 - protein, 9 aa, Homo Sapiens
AATQLVNQL

SEQ ID NO: 158123 - protein, 9 aa, Homo Sapiens
AATTVLQEL

SEQ ID NO: 158124 - protein, 9 aa, Homo Sapiens
AAVAAVLYV

SEQ ID NO: 158125 - protein, 9 aa, Homo Sapiens
AAVAIACVV

SEQ ID NO: 158126 - protein, 9 aa, Homo Sapiens
AAVALLLQV

SEQ ID NO: 158127 - protein, 9 aa, Homo Sapiens
AAVDLIIKS

SEQ ID NO: 158128 - protein, 9 aa, Homo Sapiens
AAVDNPIFY

SEQ ID NO: 158129 - protein, 9 aa, Homo Sapiens
AAVGHVLVV

SEQ ID NO: 158130 - protein, 9 aa, Homo Sapiens
AAVHIILVI

SEQ ID NO: 158131 - protein, 9 aa, Homo Sapiens
AAVLRIPIL

SEQ ID NO: 158132 - protein, 9 aa, Homo Sapiens
AAVNVICEL

SEQ ID NO: 158133 - protein, 9 aa, Homo Sapiens
AAVPAVIQF

SEQ ID NO: 158134 - protein, 9 aa, Homo Sapiens
AAVPLVRLF

SEQ ID NO: 158135 - protein, 9 aa, Homo Sapiens
AAVPLYRLY

SEQ ID NO: 158136 - protein, 9 aa, Homo Sapiens
AAVQLIWVV

SEQ ID NO: 158137 - protein, 9 aa, Homo Sapiens
AAVSFISKF

SEQ ID NO: 158138 - protein, 9 aa, Homo Sapiens
AAVSFPYVI

SEQ ID NO: 158139 - protein, 9 aa, Homo Sapiens
AAVVFPMMV

SEQ ID NO: 158140 - protein, 9 aa, Homo Sapiens
AAYAGGLVL

SEQ ID NO: 158141 - protein, 9 aa, Homo Sapiens
AAYFYGPIF

SEQ ID NO: 158142 - protein, 9 aa, Homo Sapiens
AAYGLVVVT

SEQ ID NO: 158143 - protein, 9 aa, Homo Sapiens
AAYGWPLYI

SEQ ID NO: 158144 - protein, 9 aa, Homo Sapiens
AAYGYGIRY

SEQ ID NO: 158145 - protein, 9 aa, Homo Sapiens
AAYHLIIEL

SEQ ID NO: 158146 - protein, 9 aa, Homo Sapiens
AAYHVEVTF

SEQ ID NO: 158147 - protein, 9 aa, Homo Sapiens
AAYKEAFEI

SEQ ID NO: 158148 - protein, 9 aa, Homo Sapiens
AAYKWLVCY

SEQ ID NO: 158149 - protein, 9 aa, Homo Sapiens
AAYLRALSL

SEQ ID NO: 158150 - protein, 9 aa, Homo Sapiens
AAYPEIVAV

SEQ ID NO: 158151 - protein, 9 aa, Homo Sapiens
AAYPQVRCY

SEQ ID NO: 158152 - protein, 9 aa, Homo Sapiens
AAYQSVRIL

SEQ ID NO: 158153 - protein, 9 aa, Homo Sapiens
AAYYHPSYL

SEQ ID NO: 158154 - protein, 9 aa, Homo Sapiens
AAYYLPRHL

SEQ ID NO: 158155 - protein, 9 aa, Homo Sapiens
AAYYPPSQI

SEQ ID NO: 158156 - protein, 9 aa, Homo Sapiens
AGIAFAPVY

SEQ ID NO: 158157 - protein, 9 aa, Homo Sapiens
AGIDHLVSY

SEQ ID NO: 158158 - protein, 9 aa, Homo Sapiens
AGIGWLITF

SEQ ID NO: 158159 - protein, 9 aa, Homo Sapiens
AGVGWRVDY

SEQ ID NO: 158160 - protein, 9 aa, Homo Sapiens
AGYEAPVLF

SEQ ID NO: 158161 - protein, 9 aa, Homo Sapiens
AGYPNVNIH

SEQ ID NO: 158162 - protein, 9 aa, Homo Sapiens
AGYQHIRMY

SEQ ID NO: 158163 - protein, 9 aa, Homo Sapiens
AGYSDPILV

SEQ ID NO: 158164 - protein, 9 aa, Homo Sapiens
AGYYLVVYY

SEQ ID NO: 158165 - protein, 9 aa, Homo Sapiens
AIIDTVINY

SEQ ID NO: 158166 - protein, 9 aa, Homo Sapiens
AIYDVTVVY

SEQ ID NO: 158167 - protein, 9 aa, Homo Sapiens
ALFPSVRIL

SEQ ID NO: 158168 - protein, 9 aa, Homo Sapiens
ALLNFVVKY

SEQ ID NO: 158169 - protein, 9 aa, Homo Sapiens
ALYPNVVQV

SEQ ID NO: 158170 - protein, 9 aa, Homo Sapiens
AMASIINRL

SEQ ID NO: 158171 - protein, 9 aa, Homo Sapiens
AMMANRLSF

SEQ ID NO: 158172 - protein, 9 aa, Homo Sapiens
AMPYFIQVM

SEQ ID NO: 158173 - protein, 9 aa, Homo Sapiens
AMYGGLVLF

SEQ ID NO: 158174 - protein, 9 aa, Homo Sapiens
AMYPGTFYF

SEQ ID NO: 158175 - protein, 9 aa, Homo Sapiens
AMYPHIFYF

SEQ ID NO: 158176 - protein, 9 aa, Homo Sapiens
AMYPIRSAY

SEQ ID NO: 158177 - protein, 9 aa, Homo Sapiens
AQGPTPRYF

SEQ ID NO: 158178 - protein, 9 aa, Homo Sapiens
AQISWVTVF

SEQ ID NO: 158179 - protein, 9 aa, Homo Sapiens
AQKNHIPVF

SEQ ID NO: 158180 - protein, 9 aa, Homo Sapiens
AQVPFEQIL

SEQ ID NO: 158181 - protein, 9 aa, Homo Sapiens
ASAAVFSRL

SEQ ID NO: 158182 - protein, 9 aa, Homo Sapiens
ASFDGTIKV

SEQ ID NO: 158183 - protein, 9 aa, Homo Sapiens
ASFLGLPRV

SEQ ID NO: 158184 - protein, 9 aa, Homo Sapiens
ASFPGANII

SEQ ID NO: 158185 - protein, 9 aa, Homo Sapiens
ASFPHLRIL

SEQ ID NO: 158186 - protein, 9 aa, Homo Sapiens
ASIYFCIHF

SEQ ID NO: 158187 - protein, 9 aa, Homo Sapiens
ASSPLITVF

SEQ ID NO: 158188 - protein, 9 aa, Homo Sapiens
ASTALVWVV

SEQ ID NO: 158189 - protein, 9 aa, Homo Sapiens
ASVDKVLEL

SEQ ID NO: 158190 - protein, 9 aa, Homo Sapiens
ASYPHCLQF

SEQ ID NO: 158191 - protein, 9 aa, Homo Sapiens
ASYSGLMRI

SEQ ID NO: 158192 - protein, 9 aa, Homo Sapiens
ATADTVIIY

SEQ ID NO: 158193 - protein, 9 aa, Homo Sapiens
ATFAAVVLY

SEQ ID NO: 158194 - protein, 9 aa, Homo Sapiens
ATFPKEIQM

SEQ ID NO: 158195 - protein, 9 aa, Homo Sapiens
ATFPVAIVM

SEQ ID NO: 158196 - protein, 9 aa, Homo Sapiens
ATIEKIIRF

SEQ ID NO: 158197 - protein, 9 aa, Homo Sapiens
ATIPLLVFY

SEQ ID NO: 158198 - protein, 9 aa, Homo Sapiens
ATIQLIRIL

SEQ ID NO: 158199 - protein, 9 aa, Homo Sapiens
ATSPTVLYV

SEQ ID NO: 158200 - protein, 9 aa, Homo Sapiens
ATVNFITSY

SEQ ID NO: 158201 - protein, 9 aa, Homo Sapiens
ATVPFLLQL

SEQ ID NO: 158202 - protein, 9 aa, Homo Sapiens
ATYHRAIKV

SEQ ID NO: 158203 - protein, 9 aa, Homo Sapiens
ATYNEIVTF

SEQ ID NO: 158204 - protein, 9 aa, Homo Sapiens
ATYPYQVVR

SEQ ID NO: 158205 - protein, 9 aa, Homo Sapiens
CAIPQVMAI

SEQ ID NO: 158206 - protein, 9 aa, Homo Sapiens
CAYDRIVVA

SEQ ID NO: 158207 - protein, 9 aa, Homo Sapiens
CAYPRLEIY

SEQ ID NO: 158208 - protein, 9 aa, Homo Sapiens
CLADIFRIY

SEQ ID NO: 158209 - protein, 9 aa, Homo Sapiens
CLYPDGVFY

SEQ ID NO: 158210 - protein, 9 aa, Homo Sapiens
CMVEIVQKY

SEQ ID NO: 158211 - protein, 9 aa, Homo Sapiens
CQWDQPVRY

SEQ ID NO: 158212 - protein, 9 aa, Homo Sapiens
CSFSWTVTY

SEQ ID NO: 158213 - protein, 9 aa, Homo Sapiens
CSIGFAVRY

SEQ ID NO: 158214 - protein, 9 aa, Homo Sapiens
CSRAYFLVL

SEQ ID NO: 158215 - protein, 9 aa, Homo Sapiens
CSSDFIRIL

SEQ ID NO: 158216 - protein, 9 aa, Homo Sapiens
CSSGLVKLW

SEQ ID NO: 158217 - protein, 9 aa, Homo Sapiens
CSSPHALVL

SEQ ID NO: 158218 - protein, 9 aa, Homo Sapiens
CSSPIVVKF

SEQ ID NO: 158219 - protein, 9 aa, Homo Sapiens
CSSPMVVKF

SEQ ID NO: 158220 - protein, 9 aa, Homo Sapiens
CSVPFENKL

SEQ ID NO: 158221 - protein, 9 aa, Homo Sapiens
CSYPHIIRL

SEQ ID NO: 158222 - protein, 9 aa, Homo Sapiens
CTYGKPVTF

SEQ ID NO: 158223 - protein, 9 aa, Homo Sapiens
EAADIIQKL

SEQ ID NO: 158224 - protein, 9 aa, Homo Sapiens
EAAEVILRV

SEQ ID NO: 158225 - protein, 9 aa, Homo Sapiens
EAANFIMKV

SEQ ID NO: 158226 - protein, 9 aa, Homo Sapiens
EAFQGTKVF

SEQ ID NO: 158227 - protein, 9 aa, Homo Sapiens
EAFYNVITV

SEQ ID NO: 158228 - protein, 9 aa, Homo Sapiens
EAIGAVIHY

SEQ ID NO: 158229 - protein, 9 aa, Homo Sapiens
EAVDWLHEL

SEQ ID NO: 158230 - protein, 9 aa, Homo Sapiens
EAVKWMVVF

SEQ ID NO: 158231 - protein, 9 aa, Homo Sapiens
EAVPHVLQI

SEQ ID NO: 158232 - protein, 9 aa, Homo Sapiens
EAYNAVVRY

SEQ ID NO: 158233 - protein, 9 aa, Homo Sapiens
ESYGNPLRV

SEQ ID NO: 158234 - protein, 9 aa, Homo Sapiens
ETISLIIHY

SEQ ID NO: 158235 - protein, 9 aa, Homo Sapiens
ETLALLEVK

SEQ ID NO: 158236 - protein, 9 aa, Homo Sapiens
FAADIISVL

SEQ ID NO: 158237 - protein, 9 aa, Homo Sapiens
FAADLAEEL

SEQ ID NO: 158238 - protein, 9 aa, Homo Sapiens
FAAFLASRL

SEQ ID NO: 158239 - protein, 9 aa, Homo Sapiens
FAAGIIAHL

SEQ ID NO: 158240 - protein, 9 aa, Homo Sapiens
FAAHLRCTY

SEQ ID NO: 158241 - protein, 9 aa, Homo Sapiens
FAASFAHLL

SEQ ID NO: 158242 - protein, 9 aa, Homo Sapiens
FAATVITTI

SEQ ID NO: 158243 - protein, 9 aa, Homo Sapiens
FADSTVRVW

SEQ ID NO: 158244 - protein, 9 aa, Homo Sapiens
FAFCYPFSY

SEQ ID NO: 158245 - protein, 9 aa, Homo Sapiens
FAFDEIVAL

SEQ ID NO: 158246 - protein, 9 aa, Homo Sapiens
FAFDPSVNY

SEQ ID NO: 158247 - protein, 9 aa, Homo Sapiens
FAFEEAIGY

SEQ ID NO: 158248 - protein, 9 aa, Homo Sapiens
FAFEGILIK

SEQ ID NO: 158249 - protein, 9 aa, Homo Sapiens
FAFEHSEEY

SEQ ID NO: 158250 - protein, 9 aa, Homo Sapiens
FAFESVVAI

SEQ ID NO: 158251 - protein, 9 aa, Homo Sapiens
FAFFDPVMY

SEQ ID NO: 158252 - protein, 9 aa, Homo Sapiens
FAFGGLCER

SEQ ID NO: 158253 - protein, 9 aa, Homo Sapiens
FAFGSPIGM

SEQ ID NO: 158254 - protein, 9 aa, Homo Sapiens
FAFMVVNNL

SEQ ID NO: 158255 - protein, 9 aa, Homo Sapiens
FAFPGEILM

SEQ ID NO: 158256 - protein, 9 aa, Homo Sapiens
FAFPLHVDY

SEQ ID NO: 158257 - protein, 9 aa, Homo Sapiens
FAFRHVLKL

SEQ ID NO: 158258 - protein, 9 aa, Homo Sapiens
FAFRNFLYL

SEQ ID NO: 158259 - protein, 9 aa, Homo Sapiens
FAFRYVTTI

SEQ ID NO: 158260 - protein, 9 aa, Homo Sapiens
FAFSCLLTL

SEQ ID NO: 158261 - protein, 9 aa, Homo Sapiens
FAFSGVLRA

SEQ ID NO: 158262 - protein, 9 aa, Homo Sapiens
FAFTPSRIY

SEQ ID NO: 158263 - protein, 9 aa, Homo Sapiens
FAFVTDNTY

SEQ ID NO: 158264 - protein, 9 aa, Homo Sapiens
FAGASIKIA

SEQ ID NO: 158265 - protein, 9 aa, Homo Sapiens
FAGFLPRII

SEQ ID NO: 158266 - protein, 9 aa, Homo Sapiens
FAGWLCKTL

SEQ ID NO: 158267 - protein, 9 aa, Homo Sapiens
FAHDSTRVI

SEQ ID NO: 158268 - protein, 9 aa, Homo Sapiens
FAHHLPVWL

SEQ ID NO: 158269 - protein, 9 aa, Homo Sapiens
FAHLPKSTF

SEQ ID NO: 158270 - protein, 9 aa, Homo Sapiens
FAHPYQYEL

SEQ ID NO: 158271 - protein, 9 aa, Homo Sapiens
FAHVIFQNV

SEQ ID NO: 158272 - protein, 9 aa, Homo Sapiens
FAIEREFFF

SEQ ID NO: 158273 - protein, 9 aa, Homo Sapiens
FAIHKKIVL

SEQ ID NO: 158274 - protein, 9 aa, Homo Sapiens
FAIPLIEKL

SEQ ID NO: 158275 - protein, 9 aa, Homo Sapiens
FAIPMIHAV

SEQ ID NO: 158276 - protein, 9 aa, Homo Sapiens
FAISILQQI

SEQ ID NO: 158277 - protein, 9 aa, Homo Sapiens
FAIWHIIAF

SEQ ID NO: 158278 - protein, 9 aa, Homo Sapiens
FAKDFMTYL

SEQ ID NO: 158279 - protein, 9 aa, Homo Sapiens
FAKPFLASL

SEQ ID NO: 158280 - protein, 9 aa, Homo Sapiens
FAKVHILYV

SEQ ID NO: 158281 - protein, 9 aa, Homo Sapiens
FALPFGRTA

SEQ ID NO: 158282 - protein, 9 aa, Homo Sapiens
FALPYPRFR

SEQ ID NO: 158283 - protein, 9 aa, Homo Sapiens
FALPYVIVL

SEQ ID NO: 158284 - protein, 9 aa, Homo Sapiens
FALVFPLMY

SEQ ID NO: 158285 - protein, 9 aa, Homo Sapiens
FAMEFVKYY

SEQ ID NO: 158286 - protein, 9 aa, Homo Sapiens
FAMFSGTHV

SEQ ID NO: 158287 - protein, 9 aa, Homo Sapiens
FAMPYFIQV

SEQ ID NO: 158288 - protein, 9 aa, Homo Sapiens
FAMYPPSMI

SEQ ID NO: 158289 - protein, 9 aa, Homo Sapiens
FANERCLQL

SEQ ID NO: 158290 - protein, 9 aa, Homo Sapiens
FANLGRTTL

SEQ ID NO: 158291 - protein, 9 aa, Homo Sapiens
FAQAMMSVL

SEQ ID NO: 158292 - protein, 9 aa, Homo Sapiens
FAQEAISVL

SEQ ID NO: 158293 - protein, 9 aa, Homo Sapiens
FAQEALTVL

SEQ ID NO: 158294 - protein, 9 aa, Homo Sapiens
FAQHGGIYV

SEQ ID NO: 158295 - protein, 9 aa, Homo Sapiens
FAQQQPPVV

SEQ ID NO: 158296 - protein, 9 aa, Homo Sapiens
FAQYLISEL

SEQ ID NO: 158297 - protein, 9 aa, Homo Sapiens
FASEVSNVL

SEQ ID NO: 158298 - protein, 9 aa, Homo Sapiens
FASEYPLIL

SEQ ID NO: 158299 - protein, 9 aa, Homo Sapiens
FASFIVQYY

SEQ ID NO: 158300 - protein, 9 aa, Homo Sapiens
FASFPHMVL

SEQ ID NO: 158301 - protein, 9 aa, Homo Sapiens
FASGLIHRV

SEQ ID NO: 158302 - protein, 9 aa, Homo Sapiens
FASHVSPEV

SEQ ID NO: 158303 - protein, 9 aa, Homo Sapiens
FASKLVLKA

SEQ ID NO: 158304 - protein, 9 aa, Homo Sapiens
FASPKIDSV

SEQ ID NO: 158305 - protein, 9 aa, Homo Sapiens
FASPMKSVV

SEQ ID NO: 158306 - protein, 9 aa, Homo Sapiens
FASPTQVFF

SEQ ID NO: 158307 - protein, 9 aa, Homo Sapiens
FASQVEQLI

SEQ ID NO: 158308 - protein, 9 aa, Homo Sapiens
FASTILHLV

SEQ ID NO: 158309 - protein, 9 aa, Homo Sapiens
FASVFEKYF

SEQ ID NO: 158310 - protein, 9 aa, Homo Sapiens
FASVLIRRI

SEQ ID NO: 158311 - protein, 9 aa, Homo Sapiens
FASYATIIL

SEQ ID NO: 158312 - protein, 9 aa, Homo Sapiens
FASYMEQHL

SEQ ID NO: 158313 - protein, 9 aa, Homo Sapiens
FATEGLRTL

SEQ ID NO: 158314 - protein, 9 aa, Homo Sapiens
FATLRWIDY

SEQ ID NO: 158315 - protein, 9 aa, Homo Sapiens
FATPFLVVR

SEQ ID NO: 158316 - protein, 9 aa, Homo Sapiens
FAVAIYAVY

SEQ ID NO: 158317 - protein, 9 aa, Homo Sapiens
FAVALPQLL

SEQ ID NO: 158318 - protein, 9 aa, Homo Sapiens
FAVGICNKI

SEQ ID NO: 158319 - protein, 9 aa, Homo Sapiens
FAVGVEKNW

SEQ ID NO: 158320 - protein, 9 aa, Homo Sapiens
FAVNKKIEF

SEQ ID NO: 158321 - protein, 9 aa, Homo Sapiens
FAVNMFRTL

SEQ ID NO: 158322 - protein, 9 aa, Homo Sapiens
FAVSRLIYW

SEQ ID NO: 158323 - protein, 9 aa, Homo Sapiens
FAVSVPLRV

SEQ ID NO: 158324 - protein, 9 aa, Homo Sapiens
FAVYIHALL

SEQ ID NO: 158325 - protein, 9 aa, Homo Sapiens
FAWPKILKI

SEQ ID NO: 158326 - protein, 9 aa, Homo Sapiens
FAYEGPMYL

SEQ ID NO: 158327 - protein, 9 aa, Homo Sapiens
FAYEQCLLV

SEQ ID NO: 158328 - protein, 9 aa, Homo Sapiens
FAYGLLMEL

SEQ ID NO: 158329 - protein, 9 aa, Homo Sapiens
FAYHMIETY

SEQ ID NO: 158330 - protein, 9 aa, Homo Sapiens
FAYHYPYTY

SEQ ID NO: 158331 - protein, 9 aa, Homo Sapiens
FAYLRDLLI

SEQ ID NO: 158332 - protein, 9 aa, Homo Sapiens
FAYMPNNSL

SEQ ID NO: 158333 - protein, 9 aa, Homo Sapiens
FAYPAIRYL

SEQ ID NO: 158334 - protein, 9 aa, Homo Sapiens
FAYPAPLEV

SEQ ID NO: 158335 - protein, 9 aa, Homo Sapiens
FAYPIPHTT

SEQ ID NO: 158336 - protein, 9 aa, Homo Sapiens
FAYPSELKA

SEQ ID NO: 158337 - protein, 9 aa, Homo Sapiens
FAYSMVIVP

SEQ ID NO: 158338 - protein, 9 aa, Homo Sapiens
FAYSSRIAI

SEQ ID NO: 158339 - protein, 9 aa, Homo Sapiens
FAYTAKLIL

SEQ ID NO: 158340 - protein, 9 aa, Homo Sapiens
FAYTARISV

SEQ ID NO: 158341 - protein, 9 aa, Homo Sapiens
FAYTRLQLL

SEQ ID NO: 158342 - protein, 9 aa, Homo Sapiens
FAYTSRHEI

SEQ ID NO: 158343 - protein, 9 aa, Homo Sapiens
FAYTSRIVV

SEQ ID NO: 158344 - protein, 9 aa, Homo Sapiens
FAYTVKYVL

SEQ ID NO: 158345 - protein, 9 aa, Homo Sapiens
FAYVQERRF

SEQ ID NO: 158346 - protein, 9 aa, Homo Sapiens
FAYYKLNDL

SEQ ID NO: 158347 - protein, 9 aa, Homo Sapiens
FAYYRDLVF

SEQ ID NO: 158348 - protein, 9 aa, Homo Sapiens
FAYYRVGEY

SEQ ID NO: 158349 - protein, 9 aa, Homo Sapiens
FFAGLVPRL

SEQ ID NO: 158350 - protein, 9 aa, Homo Sapiens
FFALPFSSM

SEQ ID NO: 158351 - protein, 9 aa, Homo Sapiens
FFFTARTSF

SEQ ID NO: 158352 - protein, 9 aa, Homo Sapiens
FFIAGRYEF

SEQ ID NO: 158353 - protein, 9 aa, Homo Sapiens
FFMEKRAKY

SEQ ID NO: 158354 - protein, 9 aa, Homo Sapiens
FFPDFIWTV

SEQ ID NO: 158355 - protein, 9 aa, Homo Sapiens
FFYQRLVEF

SEQ ID NO: 158356 - protein, 9 aa, Homo Sapiens
FFYTHLINF

SEQ ID NO: 158357 - protein, 9 aa, Homo Sapiens
FGAQSVRVL

SEQ ID NO: 158358 - protein, 9 aa, Homo Sapiens
FGFHKPKMY

SEQ ID NO: 158359 - protein, 9 aa, Homo Sapiens
FGIPFLLRI

SEQ ID NO: 158360 - protein, 9 aa, Homo Sapiens
FGITFPLLL

SEQ ID NO: 158361 - protein, 9 aa, Homo Sapiens
FGSEFSPEL

SEQ ID NO: 158362 - protein, 9 aa, Homo Sapiens
FGTFLVQEL

SEQ ID NO: 158363 - protein, 9 aa, Homo Sapiens
FGVDRAILY

SEQ ID NO: 158364 - protein, 9 aa, Homo Sapiens
FGVPLIVHV

SEQ ID NO: 158365 - protein, 9 aa, Homo Sapiens
FGYDKPHVL

SEQ ID NO: 158366 - protein, 9 aa, Homo Sapiens
FGYDYPSVL

SEQ ID NO: 158367 - protein, 9 aa, Homo Sapiens
FGYEPTIYY

SEQ ID NO: 158368 - protein, 9 aa, Homo Sapiens
FGYGLPMLV

SEQ ID NO: 158369 - protein, 9 aa, Homo Sapiens
FGYPDPTYL

SEQ ID NO: 158370 - protein, 9 aa, Homo Sapiens
FGYPKRLIM

SEQ ID NO: 158371 - protein, 9 aa, Homo Sapiens
FIADHCPTL

SEQ ID NO: 158372 - protein, 9 aa, Homo Sapiens
FIAPTGHSL

SEQ ID NO: 158373 - protein, 9 aa, Homo Sapiens
FICDHPQIM

SEQ ID NO: 158374 - protein, 9 aa, Homo Sapiens
FIHNFVEVL

SEQ ID NO: 158375 - protein, 9 aa, Homo Sapiens
FIIDDKGIL

SEQ ID NO: 158376 - protein, 9 aa, Homo Sapiens
FIIPNVVKY

SEQ ID NO: 158377 - protein, 9 aa, Homo Sapiens
FIIPQIVKY

SEQ ID NO: 158378 - protein, 9 aa, Homo Sapiens
FIIQGLRSV

SEQ ID NO: 158379 - protein, 9 aa, Homo Sapiens
FILHFEPVL

SEQ ID NO: 158380 - protein, 9 aa, Homo Sapiens
FINGDISSL

SEQ ID NO: 158381 - protein, 9 aa, Homo Sapiens
FINNINSVL

SEQ ID NO: 158382 - protein, 9 aa, Homo Sapiens
FINPKPITY

SEQ ID NO: 158383 - protein, 9 aa, Homo Sapiens
FINSRIITV

SEQ ID NO: 158384 - protein, 9 aa, Homo Sapiens
FIQSIISTV

SEQ ID NO: 158385 - protein, 9 aa, Homo Sapiens
FIRPWCTSL

SEQ ID NO: 158386 - protein, 9 aa, Homo Sapiens
FITGLIRIM

SEQ ID NO: 158387 - protein, 9 aa, Homo Sapiens
FIYHLPQEF

SEQ ID NO: 158388 - protein, 9 aa, Homo Sapiens
FLADIVQKL

SEQ ID NO: 158389 - protein, 9 aa, Homo Sapiens
FLANVSTVL

SEQ ID NO: 158390 - protein, 9 aa, Homo Sapiens
FLAPLVTEY

SEQ ID NO: 158391 - protein, 9 aa, Homo Sapiens
FLAPWATIA

SEQ ID NO: 158392 - protein, 9 aa, Homo Sapiens
FLCPFHLSV

SEQ ID NO: 158393 - protein, 9 aa, Homo Sapiens
FLFDGSPTY

SEQ ID NO: 158394 - protein, 9 aa, Homo Sapiens
FLFDHLLTL

SEQ ID NO: 158395 - protein, 9 aa, Homo Sapiens
FLFDKVVIV

SEQ ID NO: 158396 - protein, 9 aa, Homo Sapiens
FLFDRPMHV

SEQ ID NO: 158397 - protein, 9 aa, Homo Sapiens
FLIPFVITV

SEQ ID NO: 158398 - protein, 9 aa, Homo Sapiens
FLKDLVASV

SEQ ID NO: 158399 - protein, 9 aa, Homo Sapiens
FLLPIVVRY

SEQ ID NO: 158400 - protein, 9 aa, Homo Sapiens
FLNQPHMVL

SEQ ID NO: 158401 - protein, 9 aa, Homo Sapiens
FLPDHPIVL

SEQ ID NO: 158402 - protein, 9 aa, Homo Sapiens
FLPPYTFQI

SEQ ID NO: 158403 - protein, 9 aa, Homo Sapiens
FLREWVESM

SEQ ID NO: 158404 - protein, 9 aa, Homo Sapiens
FLVEHVLTL

SEQ ID NO: 158405 - protein, 9 aa, Homo Sapiens
FLYDNLIIF

SEQ ID NO: 158406 - protein, 9 aa, Homo Sapiens
FLYPFFGVL

SEQ ID NO: 158407 - protein, 9 aa, Homo Sapiens
FLYPFPLAL

SEQ ID NO: 158408 - protein, 9 aa, Homo Sapiens
FLYPWKKEF

SEQ ID NO: 158409 - protein, 9 aa, Homo Sapiens
FMKPGTLYV

SEQ ID NO: 158410 - protein, 9 aa, Homo Sapiens
FNFWRAPIA

SEQ ID NO: 158411 - protein, 9 aa, Homo Sapiens
FPYPFQVVY

SEQ ID NO: 158412 - protein, 9 aa, Homo Sapiens
FQAEIAQLM

SEQ ID NO: 158413 - protein, 9 aa, Homo Sapiens
FQAFLRTEF

SEQ ID NO: 158414 - protein, 9 aa, Homo Sapiens
FQIGKMRYV

SEQ ID NO: 158415 - protein, 9 aa, Homo Sapiens
FQIMNEIVY

SEQ ID NO: 158416 - protein, 9 aa, Homo Sapiens
FQKPFQTLM

SEQ ID NO: 158417 - protein, 9 aa, Homo Sapiens
FQNIRPLFI

SEQ ID NO: 158418 - protein, 9 aa, Homo Sapiens
FQNPQTHVI

SEQ ID NO: 158419 - protein, 9 aa, Homo Sapiens
FQSMLHPVM

SEQ ID NO: 158420 - protein, 9 aa, Homo Sapiens
FQYESKVFY

SEQ ID NO: 158421 - protein, 9 aa, Homo Sapiens
FQYPDTRYL

SEQ ID NO: 158422 - protein, 9 aa, Homo Sapiens
FSAEFLKVF

SEQ ID NO: 158423 - protein, 9 aa, Homo Sapiens
FSAFLEKEY

SEQ ID NO: 158424 - protein, 9 aa, Homo Sapiens
FSALLIKCL

SEQ ID NO: 158425 - protein, 9 aa, Homo Sapiens
FSATLPKLL

SEQ ID NO: 158426 - protein, 9 aa, Homo Sapiens
FSAVMVRLM

SEQ ID NO: 158427 - protein, 9 aa, Homo Sapiens
FSAYNYRTY

SEQ ID NO: 158428 - protein, 9 aa, Homo Sapiens
FSEPFHLIV

SEQ ID NO: 158429 - protein, 9 aa, Homo Sapiens
FSFDGPEIM

SEQ ID NO: 158430 - protein, 9 aa, Homo Sapiens
FSFDYIVKW

SEQ ID NO: 158431 - protein, 9 aa, Homo Sapiens
FSFFDLIRY

SEQ ID NO: 158432 - protein, 9 aa, Homo Sapiens
FSFGYALVY

SEQ ID NO: 158433 - protein, 9 aa, Homo Sapiens
FSFHFPVCV

SEQ ID NO: 158434 - protein, 9 aa, Homo Sapiens
FSFHHVLSL

SEQ ID NO: 158435 - protein, 9 aa, Homo Sapiens
FSFHVVKVY

SEQ ID NO: 158436 - protein, 9 aa, Homo Sapiens
FSFKKPFKL

SEQ ID NO: 158437 - protein, 9 aa, Homo Sapiens
FSFPFQTYY

SEQ ID NO: 158438 - protein, 9 aa, Homo Sapiens
FSFPGELLM

SEQ ID NO: 158439 - protein, 9 aa, Homo Sapiens
FSFPHKFEI

SEQ ID NO: 158440 - protein, 9 aa, Homo Sapiens
FSFQRPLLV

SEQ ID NO: 158441 - protein, 9 aa, Homo Sapiens
FSFSGVNRL

SEQ ID NO: 158442 - protein, 9 aa, Homo Sapiens
FSFVRVISL

SEQ ID NO: 158443 - protein, 9 aa, Homo Sapiens
FSGPPEPVL

SEQ ID NO: 158444 - protein, 9 aa, Homo Sapiens
FSHAQTVVL

SEQ ID NO: 158445 - protein, 9 aa, Homo Sapiens
FSIDRALNV

SEQ ID NO: 158446 - protein, 9 aa, Homo Sapiens
FSIEPWLKV

SEQ ID NO: 158447 - protein, 9 aa, Homo Sapiens
FSIPFAPHI

SEQ ID NO: 158448 - protein, 9 aa, Homo Sapiens
FSIPYIISY

SEQ ID NO: 158449 - protein, 9 aa, Homo Sapiens
FSKAKPSVL

SEQ ID NO: 158450 - protein, 9 aa, Homo Sapiens
FSKDIFSVI

SEQ ID NO: 158451 - protein, 9 aa, Homo Sapiens
FSMYKPITY

SEQ ID NO: 158452 - protein, 9 aa, Homo Sapiens
FSNDIPHVV

SEQ ID NO: 158453 - protein, 9 aa, Homo Sapiens
FSNGHIKVL

SEQ ID NO: 158454 - protein, 9 aa, Homo Sapiens
FSNPNIQKI

SEQ ID NO: 158455 - protein, 9 aa, Homo Sapiens
FSNPYSIEY

SEQ ID NO: 158456 - protein, 9 aa, Homo Sapiens
FSQDHLVIY

SEQ ID NO: 158457 - protein, 9 aa, Homo Sapiens
FSSCLHQVL

SEQ ID NO: 158458 - protein, 9 aa, Homo Sapiens
FSSDLISIH

SEQ ID NO: 158459 - protein, 9 aa, Homo Sapiens
FSSENVKVF

SEQ ID NO: 158460 - protein, 9 aa, Homo Sapiens
FSSFVFSTV

SEQ ID NO: 158461 - protein, 9 aa, Homo Sapiens
FSSGAIQVV

SEQ ID NO: 158462 - protein, 9 aa, Homo Sapiens
FSSHILVVV

SEQ ID NO: 158463 - protein, 9 aa, Homo Sapiens
FSSHLINLL

SEQ ID NO: 158464 - protein, 9 aa, Homo Sapiens
FSSPHLLEA

SEQ ID NO: 158465 - protein, 9 aa, Homo Sapiens
FSSPHLQML

SEQ ID NO: 158466 - protein, 9 aa, Homo Sapiens
FSSPHLVQV

SEQ ID NO: 158467 - protein, 9 aa, Homo Sapiens
FSSSSHLII

SEQ ID NO: 158468 - protein, 9 aa, Homo Sapiens
FSTPLLLEA

SEQ ID NO: 158469 - protein, 9 aa, Homo Sapiens
FSVCHILLL

SEQ ID NO: 158470 - protein, 9 aa, Homo Sapiens
FSYAFPKAV

SEQ ID NO: 158471 - protein, 9 aa, Homo Sapiens
FSYAFPKEF

SEQ ID NO: 158472 - protein, 9 aa, Homo Sapiens
FSYGTKILY

SEQ ID NO: 158473 - protein, 9 aa, Homo Sapiens
FTADFVRQL

SEQ ID NO: 158474 - protein, 9 aa, Homo Sapiens
FTADVRSVL

SEQ ID NO: 158475 - protein, 9 aa, Homo Sapiens
FTANQVKIY

SEQ ID NO: 158476 - protein, 9 aa, Homo Sapiens
FTAWRILEV

SEQ ID NO: 158477 - protein, 9 aa, Homo Sapiens
FTFGFIQVM

SEQ ID NO: 158478 - protein, 9 aa, Homo Sapiens
FTFPGCRAL

SEQ ID NO: 158479 - protein, 9 aa, Homo Sapiens
FTFPGNLVT

SEQ ID NO: 158480 - protein, 9 aa, Homo Sapiens
FTFTPTVTY

SEQ ID NO: 158481 - protein, 9 aa, Homo Sapiens
FTGPLRPFF

SEQ ID NO: 158482 - protein, 9 aa, Homo Sapiens
FTHSQFIVV

SEQ ID NO: 158483 - protein, 9 aa, Homo Sapiens
FTIFRTISV

SEQ ID NO: 158484 - protein, 9 aa, Homo Sapiens
FTIPHTQEA

SEQ ID NO: 158485 - protein, 9 aa, Homo Sapiens
FTKWVNSHL

SEQ ID NO: 158486 - protein, 9 aa, Homo Sapiens
FTLPFRIFY

SEQ ID NO: 158487 - protein, 9 aa, Homo Sapiens
FTLWWSPTI

SEQ ID NO: 158488 - protein, 9 aa, Homo Sapiens
FTMEMVRQY

SEQ ID NO: 158489 - protein, 9 aa, Homo Sapiens
FTNPKVREW

SEQ ID NO: 158490 - protein, 9 aa, Homo Sapiens
FTPNNIKQV

SEQ ID NO: 158491 - protein, 9 aa, Homo Sapiens
FTPPVVKRL

SEQ ID NO: 158492 - protein, 9 aa, Homo Sapiens
FTRPEIVVF

SEQ ID NO: 158493 - protein, 9 aa, Homo Sapiens
FTSEKFLVM

SEQ ID NO: 158494 - protein, 9 aa, Homo Sapiens
FTSPAVKRL

SEQ ID NO: 158495 - protein, 9 aa, Homo Sapiens
FTSPFCLQV

SEQ ID NO: 158496 - protein, 9 aa, Homo Sapiens
FTVDQIRAI

SEQ ID NO: 158497 - protein, 9 aa, Homo Sapiens
FTVEQQRIL

SEQ ID NO: 158498 - protein, 9 aa, Homo Sapiens
FTVPHTHVF

SEQ ID NO: 158499 - protein, 9 aa, Homo Sapiens
FTVTFNPKY

SEQ ID NO: 158500 - protein, 9 aa, Homo Sapiens
FTYDQRTEF

SEQ ID NO: 158501 - protein, 9 aa, Homo Sapiens
FTYHHIQEI

SEQ ID NO: 158502 - protein, 9 aa, Homo Sapiens
FTYPYLLAI

SEQ ID NO: 158503 - protein, 9 aa, Homo Sapiens
FVADLQRVI

SEQ ID NO: 158504 - protein, 9 aa, Homo Sapiens
FVFETPFTL

SEQ ID NO: 158505 - protein, 9 aa, Homo Sapiens
FVFPGELLL

SEQ ID NO: 158506 - protein, 9 aa, Homo Sapiens
FVFSTVVIH

SEQ ID NO: 158507 - protein, 9 aa, Homo Sapiens
FVHDLVLYL

SEQ ID NO: 158508 - protein, 9 aa, Homo Sapiens
FVHPDPLWI

SEQ ID NO: 158509 - protein, 9 aa, Homo Sapiens
FVKDSIRLV

SEQ ID NO: 158510 - protein, 9 aa, Homo Sapiens
FVKPAVVTV

SEQ ID NO: 158511 - protein, 9 aa, Homo Sapiens
FVLMASYLI

SEQ ID NO: 158512 - protein, 9 aa, Homo Sapiens
FVNEIISRI

SEQ ID NO: 158513 - protein, 9 aa, Homo Sapiens
FVNPHVSSF

SEQ ID NO: 158514 - protein, 9 aa, Homo Sapiens
FVPVFVAVL

SEQ ID NO: 158515 - protein, 9 aa, Homo Sapiens
FVRDMIREV

SEQ ID NO: 158516 - protein, 9 aa, Homo Sapiens
FVSPLVKYL

SEQ ID NO: 158517 - protein, 9 aa, Homo Sapiens
FVVDHCPYM

SEQ ID NO: 158518 - protein, 9 aa, Homo Sapiens
FVVDHVIKI

SEQ ID NO: 158519 - protein, 9 aa, Homo Sapiens
FVVEHDFIM

SEQ ID NO: 158520 - protein, 9 aa, Homo Sapiens
FVVERQPCM

SEQ ID NO: 158521 - protein, 9 aa, Homo Sapiens
FVYENPISL

SEQ ID NO: 158522 - protein, 9 aa, Homo Sapiens
FVYLRQPYY

SEQ ID NO: 158523 - protein, 9 aa, Homo Sapiens
FWVPFNVVL

SEQ ID NO: 158524 - protein, 9 aa, Homo Sapiens
GAAEIISRI

SEQ ID NO: 158525 - protein, 9 aa, Homo Sapiens
GAFGLPITV

SEQ ID NO: 158526 - protein, 9 aa, Homo Sapiens
GAFSGIQQM

SEQ ID NO: 158527 - protein, 9 aa, Homo Sapiens
GAISKIFVL

SEQ ID NO: 158528 - protein, 9 aa, Homo Sapiens
GASFLLKVW

SEQ ID NO: 158529 - protein, 9 aa, Homo Sapiens
GASQLFRIW

SEQ ID NO: 158530 - protein, 9 aa, Homo Sapiens
GAVDRVLQV

SEQ ID NO: 158531 - protein, 9 aa, Homo Sapiens
GAYEQVIKY

SEQ ID NO: 158532 - protein, 9 aa, Homo Sapiens
GAYGKVFLV

SEQ ID NO: 158533 - protein, 9 aa, Homo Sapiens
GAYGQAVRY

SEQ ID NO: 158534 - protein, 9 aa, Homo Sapiens
GAYKYIQEL

SEQ ID NO: 158535 - protein, 9 aa, Homo Sapiens
GAYTVTIKY

SEQ ID NO: 158536 - protein, 9 aa, Homo Sapiens
GIPEFWLTV

SEQ ID NO: 158537 - protein, 9 aa, Homo Sapiens
GSFGRVMLV

SEQ ID NO: 158538 - protein, 9 aa, Homo Sapiens
GTPPWVKRY

SEQ ID NO: 158539 - protein, 9 aa, Homo Sapiens
GTVQILIKV

SEQ ID NO: 158540 - protein, 9 aa, Homo Sapiens
GVISKIIIF

SEQ ID NO: 158541 - protein, 9 aa, Homo Sapiens
HAAELIKTV

SEQ ID NO: 158542 - protein, 9 aa, Homo Sapiens
HAAHIISEL

SEQ ID NO: 158543 - protein, 9 aa, Homo Sapiens
HAAKVILQV

SEQ ID NO: 158544 - protein, 9 aa, Homo Sapiens
HAAPCMLFM

SEQ ID NO: 158545 - protein, 9 aa, Homo Sapiens
HAAPFQNIL

SEQ ID NO: 158546 - protein, 9 aa, Homo Sapiens
HAAPFSKVL

SEQ ID NO: 158547 - protein, 9 aa, Homo Sapiens
HAASTVQIL

SEQ ID NO: 158548 - protein, 9 aa, Homo Sapiens
HAASVFLTL

SEQ ID NO: 158549 - protein, 9 aa, Homo Sapiens
HACGVIATI

SEQ ID NO: 158550 - protein, 9 aa, Homo Sapiens
HAFPYIKTR

SEQ ID NO: 158551 - protein, 9 aa, Homo Sapiens
HAFSFPLLI

SEQ ID NO: 158552 - protein, 9 aa, Homo Sapiens
HAFWGGSVV

SEQ ID NO: 158553 - protein, 9 aa, Homo Sapiens
HAIDHRLSI

SEQ ID NO: 158554 - protein, 9 aa, Homo Sapiens
HAIKSVKIY

SEQ ID NO: 158555 - protein, 9 aa, Homo Sapiens
HAMQFPAEL

SEQ ID NO: 158556 - protein, 9 aa, Homo Sapiens
HATIIPKVL

SEQ ID NO: 158557 - protein, 9 aa, Homo Sapiens
HAVEWPVVM

SEQ ID NO: 158558 - protein, 9 aa, Homo Sapiens
HAVHVALVL

SEQ ID NO: 158559 - protein, 9 aa, Homo Sapiens
HAYIHSVQF

SEQ ID NO: 158560 - protein, 9 aa, Homo Sapiens
HAYPLIQEA

SEQ ID NO: 158561 - protein, 9 aa, Homo Sapiens
HAYPYPQMY

SEQ ID NO: 158562 - protein, 9 aa, Homo Sapiens
HFIFFVQEF

SEQ ID NO: 158563 - protein, 9 aa, Homo Sapiens
HFSIAFIIY

SEQ ID NO: 158564 - protein, 9 aa, Homo Sapiens
HGFAGVILI

SEQ ID NO: 158565 - protein, 9 aa, Homo Sapiens
HGLIRKYGL

SEQ ID NO: 158566 - protein, 9 aa, Homo Sapiens
HIISFTVKY

SEQ ID NO: 158567 - protein, 9 aa, Homo Sapiens
HLPDFCMLM

SEQ ID NO: 158568 - protein, 9 aa, Homo Sapiens
HQIDLIVQL

SEQ ID NO: 158569 - protein, 9 aa, Homo Sapiens
HQSGIVQLL

SEQ ID NO: 158570 - protein, 9 aa, Homo Sapiens
HQSTVDWIV

SEQ ID NO: 158571 - protein, 9 aa, Homo Sapiens
HSAPFSWET

SEQ ID NO: 158572 - protein, 9 aa, Homo Sapiens
HSFLKALYY

SEQ ID NO: 158573 - protein, 9 aa, Homo Sapiens
HSFNIPMQL

SEQ ID NO: 158574 - protein, 9 aa, Homo Sapiens
HSFSGVQRF

SEQ ID NO: 158575 - protein, 9 aa, Homo Sapiens
HSYELLVEY

SEQ ID NO: 158576 - protein, 9 aa, Homo Sapiens
HTFWGVVFF

SEQ ID NO: 158577 - protein, 9 aa, Homo Sapiens
HTFYEAVGY

SEQ ID NO: 158578 - protein, 9 aa, Homo Sapiens
HTFYNELRV

SEQ ID NO: 158579 - protein, 9 aa, Homo Sapiens
HTIDTILTV

SEQ ID NO: 158580 - protein, 9 aa, Homo Sapiens
HTQGFIITF

SEQ ID NO: 158581 - protein, 9 aa, Homo Sapiens
HTVGFILQL

SEQ ID NO: 158582 - protein, 9 aa, Homo Sapiens
HTWNGIRHL

SEQ ID NO: 158583 - protein, 9 aa, Homo Sapiens
HVFDHPWET

SEQ ID NO: 158584 - protein, 9 aa, Homo Sapiens
HVFWGIVFF

SEQ ID NO: 158585 - protein, 9 aa, Homo Sapiens
HVINHILKA

SEQ ID NO: 158586 - protein, 9 aa, Homo Sapiens
HVPDWVWIV

SEQ ID NO: 158587 - protein, 9 aa, Homo Sapiens
HVYEIPVEY

SEQ ID NO: 158588 - protein, 9 aa, Homo Sapiens
IAAGIFNDL

SEQ ID NO: 158589 - protein, 9 aa, Homo Sapiens
IAAGLYLLL

SEQ ID NO: 158590 - protein, 9 aa, Homo Sapiens
IAAKKVLRL

SEQ ID NO: 158591 - protein, 9 aa, Homo Sapiens
IAAMPLISL

SEQ ID NO: 158592 - protein, 9 aa, Homo Sapiens
IAAPFTSKL

SEQ ID NO: 158593 - protein, 9 aa, Homo Sapiens
IAASYVKYL

SEQ ID NO: 158594 - protein, 9 aa, Homo Sapiens
IAFEFPVLV

SEQ ID NO: 158595 - protein, 9 aa, Homo Sapiens
IAFFDVRTF

SEQ ID NO: 158596 - protein, 9 aa, Homo Sapiens
IAFFTTASV

SEQ ID NO: 158597 - protein, 9 aa, Homo Sapiens
IAFGFHQLY

SEQ ID NO: 158598 - protein, 9 aa, Homo Sapiens
IAFHFRVYF

SEQ ID NO: 158599 - protein, 9 aa, Homo Sapiens
IAFHSAVSL

SEQ ID NO: 158600 - protein, 9 aa, Homo Sapiens
IAFPFRHDL

SEQ ID NO: 158601 - protein, 9 aa, Homo Sapiens
IAFPKAEEL

SEQ ID NO: 158602 - protein, 9 aa, Homo Sapiens
IAFPSANEV

SEQ ID NO: 158603 - protein, 9 aa, Homo Sapiens
IAFPTSISV

SEQ ID NO: 158604 - protein, 9 aa, Homo Sapiens
IAFQQAQYI

SEQ ID NO: 158605 - protein, 9 aa, Homo Sapiens
IAFSRPVKY

SEQ ID NO: 158606 - protein, 9 aa, Homo Sapiens
IAFWGVRSM

SEQ ID NO: 158607 - protein, 9 aa, Homo Sapiens
IAHVKPSIM

SEQ ID NO: 158608 - protein, 9 aa, Homo Sapiens
IAIDWEPEM

SEQ ID NO: 158609 - protein, 9 aa, Homo Sapiens
IAIEKIRLL

SEQ ID NO: 158610 - protein, 9 aa, Homo Sapiens
IAIGKVLKL

SEQ ID NO: 158611 - protein, 9 aa, Homo Sapiens
IAIIRPSIV

SEQ ID NO: 158612 - protein, 9 aa, Homo Sapiens
IAILIPVVF

SEQ ID NO: 158613 - protein, 9 aa, Homo Sapiens
IAINHTIIT

SEQ ID NO: 158614 - protein, 9 aa, Homo Sapiens
IAIPFLIKL

SEQ ID NO: 158615 - protein, 9 aa, Homo Sapiens
IAIPVTVAF

SEQ ID NO: 158616 - protein, 9 aa, Homo Sapiens
IAISRTPVL

SEQ ID NO: 158617 - protein, 9 aa, Homo Sapiens
IAKDVCTFL

SEQ ID NO: 158618 - protein, 9 aa, Homo Sapiens
IALQYPVYW

SEQ ID NO: 158619 - protein, 9 aa, Homo Sapiens
IAMDLILKM

SEQ ID NO: 158620 - protein, 9 aa, Homo Sapiens
IARLPSSTL

SEQ ID NO: 158621 - protein, 9 aa, Homo Sapiens
IASAIVNEL

SEQ ID NO: 158622 - protein, 9 aa, Homo Sapiens
IASDIVSRF

SEQ ID NO: 158623 - protein, 9 aa, Homo Sapiens
IASFILLRL

SEQ ID NO: 158624 - protein, 9 aa, Homo Sapiens
IASHLHIHV

SEQ ID NO: 158625 - protein, 9 aa, Homo Sapiens
IASPQLLRV

SEQ ID NO: 158626 - protein, 9 aa, Homo Sapiens
IASPVIAAV

SEQ ID NO: 158627 - protein, 9 aa, Homo Sapiens
IASPVQPVL

SEQ ID NO: 158628 - protein, 9 aa, Homo Sapiens
IASTILRLI

SEQ ID NO: 158629 - protein, 9 aa, Homo Sapiens
IASWLVVTV

SEQ ID NO: 158630 - protein, 9 aa, Homo Sapiens
IATEIILEI

SEQ ID NO: 158631 - protein, 9 aa, Homo Sapiens
IATGHLMSV

SEQ ID NO: 158632 - protein, 9 aa, Homo Sapiens
IATPFIKLF

SEQ ID NO: 158633 - protein, 9 aa, Homo Sapiens
IAVALPVVY

SEQ ID NO: 158634 - protein, 9 aa, Homo Sapiens
IAVDMTQHL

SEQ ID NO: 158635 - protein, 9 aa, Homo Sapiens
IAVEFCHVT

SEQ ID NO: 158636 - protein, 9 aa, Homo Sapiens
IAVGLVPQY

SEQ ID NO: 158637 - protein, 9 aa, Homo Sapiens
IAVGTVIRY

SEQ ID NO: 158638 - protein, 9 aa, Homo Sapiens
IAVHVVRVL

SEQ ID NO: 158639 - protein, 9 aa, Homo Sapiens
IAVNAVLTV

SEQ ID NO: 158640 - protein, 9 aa, Homo Sapiens
IAVSIVRAL

SEQ ID NO: 158641 - protein, 9 aa, Homo Sapiens
IAYDNIKVV

SEQ ID NO: 158642 - protein, 9 aa, Homo Sapiens
IAYDVTYSL

SEQ ID NO: 158643 - protein, 9 aa, Homo Sapiens
IAYFHPQKL

SEQ ID NO: 158644 - protein, 9 aa, Homo Sapiens
IAYPHLRIR

SEQ ID NO: 158645 - protein, 9 aa, Homo Sapiens
IAYPKAVTM

SEQ ID NO: 158646 - protein, 9 aa, Homo Sapiens
IAYQKQVIR

SEQ ID NO: 158647 - protein, 9 aa, Homo Sapiens
IAYSRPVYF

SEQ ID NO: 158648 - protein, 9 aa, Homo Sapiens
IFYEFRSYY

SEQ ID NO: 158649 - protein, 9 aa, Homo Sapiens
IGMPVEKRY

SEQ ID NO: 158650 - protein, 9 aa, Homo Sapiens
IGVDFALKV

SEQ ID NO: 158651 - protein, 9 aa, Homo Sapiens
IGVEHVVVY

SEQ ID NO: 158652 - protein, 9 aa, Homo Sapiens
IGYPITLYL

SEQ ID NO: 158653 - protein, 9 aa, Homo Sapiens
IGYPMPTGY

SEQ ID NO: 158654 - protein, 9 aa, Homo Sapiens
IGYSSPLTL

SEQ ID NO: 158655 - protein, 9 aa, Homo Sapiens
IIFETPLRV

SEQ ID NO: 158656 - protein, 9 aa, Homo Sapiens
IIPSWPLKV

SEQ ID NO: 158657 - protein, 9 aa, Homo Sapiens
IIQSIRMGM

SEQ ID NO: 158658 - protein, 9 aa, Homo Sapiens
IIYGDPVTF

SEQ ID NO: 158659 - protein, 9 aa, Homo Sapiens
IIYPTPKVV

SEQ ID NO: 158660 - protein, 9 aa, Homo Sapiens
ILFSGVHFY

SEQ ID NO: 158661 - protein, 9 aa, Homo Sapiens
ILPPFIWTL

SEQ ID NO: 158662 - protein, 9 aa, Homo Sapiens
IQAAIVRIM

SEQ ID NO: 158663 - protein, 9 aa, Homo Sapiens
IQFKKPIIV

SEQ ID NO: 158664 - protein, 9 aa, Homo Sapiens
IQYIRPVFV

SEQ ID NO: 158665 - protein, 9 aa, Homo Sapiens
ISAELIRSL

SEQ ID NO: 158666 - protein, 9 aa, Homo Sapiens
ISAPLVKTL

SEQ ID NO: 158667 - protein, 9 aa, Homo Sapiens
ISCPKPSII

SEQ ID NO: 158668 - protein, 9 aa, Homo Sapiens
ISFPAPLYI

SEQ ID NO: 158669 - protein, 9 aa, Homo Sapiens
ISFPDPKML

SEQ ID NO: 158670 - protein, 9 aa, Homo Sapiens
ISKSPWTCL

SEQ ID NO: 158671 - protein, 9 aa, Homo Sapiens
ISRDKPITF

SEQ ID NO: 158672 - protein, 9 aa, Homo Sapiens
ISREHPWEV

SEQ ID NO: 158673 - protein, 9 aa, Homo Sapiens
ISSGLILSV

SEQ ID NO: 158674 - protein, 9 aa, Homo Sapiens
ISSHIPLII

SEQ ID NO: 158675 - protein, 9 aa, Homo Sapiens
ISSPVVTSL

SEQ ID NO: 158676 - protein, 9 aa, Homo Sapiens
ISTPVIRTF

SEQ ID NO: 158677 - protein, 9 aa, Homo Sapiens
ISVDGVVYY

SEQ ID NO: 158678 - protein, 9 aa, Homo Sapiens
ISVERVIEY

SEQ ID NO: 158679 - protein, 9 aa, Homo Sapiens
ITAEILREL

SEQ ID NO: 158680 - protein, 9 aa, Homo Sapiens
ITFPGIKLI

SEQ ID NO: 158681 - protein, 9 aa, Homo Sapiens
ITFPGLHEL

SEQ ID NO: 158682 - protein, 9 aa, Homo Sapiens
ITFPIIVHF

SEQ ID NO: 158683 - protein, 9 aa, Homo Sapiens
ITGPLIRIL

SEQ ID NO: 158684 - protein, 9 aa, Homo Sapiens
ITTDCLQIL

SEQ ID NO: 158685 - protein, 9 aa, Homo Sapiens
ITTTINPRF

SEQ ID NO: 158686 - protein, 9 aa, Homo Sapiens
ITTTVTRVL

SEQ ID NO: 158687 - protein, 9 aa, Homo Sapiens
ITYGLPIMV

SEQ ID NO: 158688 - protein, 9 aa, Homo Sapiens
IVADILLYV

SEQ ID NO: 158689 - protein, 9 aa, Homo Sapiens
IVATKPLYV

SEQ ID NO: 158690 - protein, 9 aa, Homo Sapiens
IVIGIIKTV

SEQ ID NO: 158691 - protein, 9 aa, Homo Sapiens
IVINHVISV

SEQ ID NO: 158692 - protein, 9 aa, Homo Sapiens
IVYPGIAVF

SEQ ID NO: 158693 - protein, 9 aa, Homo Sapiens
KAADFVKAF

SEQ ID NO: 158694 - protein, 9 aa, Homo Sapiens
KAAGFISVL

SEQ ID NO: 158695 - protein, 9 aa, Homo Sapiens
KAAHFFSTL

SEQ ID NO: 158696 - protein, 9 aa, Homo Sapiens
KAASQILIL

SEQ ID NO: 158697 - protein, 9 aa, Homo Sapiens
KAASVRPVL

SEQ ID NO: 158698 - protein, 9 aa, Homo Sapiens
KAAVMVHQL

SEQ ID NO: 158699 - protein, 9 aa, Homo Sapiens
KACDYIQEL

SEQ ID NO: 158700 - protein, 9 aa, Homo Sapiens
KACDYIREL

SEQ ID NO: 158701 - protein, 9 aa, Homo Sapiens
KAFAEQIFY

SEQ ID NO: 158702 - protein, 9 aa, Homo Sapiens
KAFAQLFIL

SEQ ID NO: 158703 - protein, 9 aa, Homo Sapiens
KAFARPWSL

SEQ ID NO: 158704 - protein, 9 aa, Homo Sapiens
KAFDRPSLF

SEQ ID NO: 158705 - protein, 9 aa, Homo Sapiens
KAFEHLQQL

SEQ ID NO: 158706 - protein, 9 aa, Homo Sapiens
KAFEYNMQI

SEQ ID NO: 158707 - protein, 9 aa, Homo Sapiens
KAFFAKMVV

SEQ ID NO: 158708 - protein, 9 aa, Homo Sapiens
KAFFRWLYV

SEQ ID NO: 158709 - protein, 9 aa, Homo Sapiens
KAFGKQSIL

SEQ ID NO: 158710 - protein, 9 aa, Homo Sapiens
KAFKGSIFV

SEQ ID NO: 158711 - protein, 9 aa, Homo Sapiens
KAFLTIIIL

SEQ ID NO: 158712 - protein, 9 aa, Homo Sapiens
KAFMYPYTL

SEQ ID NO: 158713 - protein, 9 aa, Homo Sapiens
KAFNHPATL

SEQ ID NO: 158714 - protein, 9 aa, Homo Sapiens
KAFNLRISF

SEQ ID NO: 158715 - protein, 9 aa, Homo Sapiens
KAFPEHFTY

SEQ ID NO: 158716 - protein, 9 aa, Homo Sapiens
KAFPFHIIF

SEQ ID NO: 158717 - protein, 9 aa, Homo Sapiens
KAFPKAYLL

SEQ ID NO: 158718 - protein, 9 aa, Homo Sapiens
KAFQKIVVL

SEQ ID NO: 158719 - protein, 9 aa, Homo Sapiens
KAFQKLITV

SEQ ID NO: 158720 - protein, 9 aa, Homo Sapiens
KAFSVVIQA

SEQ ID NO: 158721 - protein, 9 aa, Homo Sapiens
KAIDFAASL

SEQ ID NO: 158722 - protein, 9 aa, Homo Sapiens
KAIDVVVMV

SEQ ID NO: 158723 - protein, 9 aa, Homo Sapiens
KAIDYIKYL

SEQ ID NO: 158724 - protein, 9 aa, Homo Sapiens
KAIDYIRFL

SEQ ID NO: 158725 - protein, 9 aa, Homo Sapiens
KAIEKNVLF

SEQ ID NO: 158726 - protein, 9 aa, Homo Sapiens
KAIELLQEF

SEQ ID NO: 158727 - protein, 9 aa, Homo Sapiens
KAIELQLQV

SEQ ID NO: 158728 - protein, 9 aa, Homo Sapiens
KAIEVLLTL

SEQ ID NO: 158729 - protein, 9 aa, Homo Sapiens
KAISGVHTV

SEQ ID NO: 158730 - protein, 9 aa, Homo Sapiens
KAITFVTQY

SEQ ID NO: 158731 - protein, 9 aa, Homo Sapiens
KAKDPFAHL

SEQ ID NO: 158732 - protein, 9 aa, Homo Sapiens
KAMELIREL

SEQ ID NO: 158733 - protein, 9 aa, Homo Sapiens
KANITFEYM

SEQ ID NO: 158734 - protein, 9 aa, Homo Sapiens
KAPDFVFYA

SEQ ID NO: 158735 - protein, 9 aa, Homo Sapiens
KAQNKPFYV

SEQ ID NO: 158736 - protein, 9 aa, Homo Sapiens
KASEKILQV

SEQ ID NO: 158737 - protein, 9 aa, Homo Sapiens
KASHILISV

SEQ ID NO: 158738 - protein, 9 aa, Homo Sapiens
KASPLTFTV

SEQ ID NO: 158739 - protein, 9 aa, Homo Sapiens
KATAYILSV

SEQ ID NO: 158740 - protein, 9 aa, Homo Sapiens
KATEYIQYM

SEQ ID NO: 158741 - protein, 9 aa, Homo Sapiens
KATFIIKII

SEQ ID NO: 158742 - protein, 9 aa, Homo Sapiens
KATNVVRLL

SEQ ID NO: 158743 - protein, 9 aa, Homo Sapiens
KATPLVLKA

SEQ ID NO: 158744 - protein, 9 aa, Homo Sapiens
KAVDIVKQV

SEQ ID NO: 158745 - protein, 9 aa, Homo Sapiens
KAVEIYASV

SEQ ID NO: 158746 - protein, 9 aa, Homo Sapiens
KAVELLVEL

SEQ ID NO: 158747 - protein, 9 aa, Homo Sapiens
KAVGWRLIA

SEQ ID NO: 158748 - protein, 9 aa, Homo Sapiens
KAVHVIYTV

SEQ ID NO: 158749 - protein, 9 aa, Homo Sapiens
KAVSFHLVH

SEQ ID NO: 158750 - protein, 9 aa, Homo Sapiens
KAVSLFLCY

SEQ ID NO: 158751 - protein, 9 aa, Homo Sapiens
KAVSLINAI

SEQ ID NO: 158752 - protein, 9 aa, Homo Sapiens
KAVTHQVKF

SEQ ID NO: 158753 - protein, 9 aa, Homo Sapiens
KAVVFFVFY

SEQ ID NO: 158754 - protein, 9 aa, Homo Sapiens
KAWFLPIMY

SEQ ID NO: 158755 - protein, 9 aa, Homo Sapiens
KAWPLLLVV

SEQ ID NO: 158756 - protein, 9 aa, Homo Sapiens
KAYEKILFT

SEQ ID NO: 158757 - protein, 9 aa, Homo Sapiens
KAYEKLQIL

SEQ ID NO: 158758 - protein, 9 aa, Homo Sapiens
KAYELALYL

SEQ ID NO: 158759 - protein, 9 aa, Homo Sapiens
KAYFDVKEY

SEQ ID NO: 158760 - protein, 9 aa, Homo Sapiens
KAYGKDFHL

SEQ ID NO: 158761 - protein, 9 aa, Homo Sapiens
KAYHEQLSV

SEQ ID NO: 158762 - protein, 9 aa, Homo Sapiens
KAYHEQLTV

SEQ ID NO: 158763 - protein, 9 aa, Homo Sapiens
KAYNRVIYV

SEQ ID NO: 158764 - protein, 9 aa, Homo Sapiens
KAYNYIRIM

SEQ ID NO: 158765 - protein, 9 aa, Homo Sapiens
KAYPFPLSH

SEQ ID NO: 158766 - protein, 9 aa, Homo Sapiens
KGFDWPLLV

SEQ ID NO: 158767 - protein, 9 aa, Homo Sapiens
KGIGHVIKV

SEQ ID NO: 158768 - protein, 9 aa, Homo Sapiens
KGIPHLVTH

SEQ ID NO: 158769 - protein, 9 aa, Homo Sapiens
KGSGVVIIM

SEQ ID NO: 158770 - protein, 9 aa, Homo Sapiens
KIADFGWSV

SEQ ID NO: 158771 - protein, 9 aa, Homo Sapiens
KIFPSVIKY

SEQ ID NO: 158772 - protein, 9 aa, Homo Sapiens
KIIPLVVKF

SEQ ID NO: 158773 - protein, 9 aa, Homo Sapiens
KIPNFCVLL

SEQ ID NO: 158774 - protein, 9 aa, Homo Sapiens
KIPNFWVTT

SEQ ID NO: 158775 - protein, 9 aa, Homo Sapiens
KISNIIKQF

SEQ ID NO: 158776 - protein, 9 aa, Homo Sapiens
KIVDWAIQV

SEQ ID NO: 158777 - protein, 9 aa, Homo Sapiens
KIVKWDRDM

SEQ ID NO: 158778 - protein, 9 aa, Homo Sapiens
KIYEEPIIL

SEQ ID NO: 158779 - protein, 9 aa, Homo Sapiens
KLASYVKFY

SEQ ID NO: 158780 - protein, 9 aa, Homo Sapiens
KLSDLLKYY

SEQ ID NO: 158781 - protein, 9 aa, Homo Sapiens
KLVDFVIHF

SEQ ID NO: 158782 - protein, 9 aa, Homo Sapiens
KLYGKPIRV

SEQ ID NO: 158783 - protein, 9 aa, Homo Sapiens
KNFDMVIVY

SEQ ID NO: 158784 - protein, 9 aa, Homo Sapiens
KQAEIVKRL

SEQ ID NO: 158785 - protein, 9 aa, Homo Sapiens
KQFEGTVEI

SEQ ID NO: 158786 - protein, 9 aa, Homo Sapiens
KQFGNILIL

SEQ ID NO: 158787 - protein, 9 aa, Homo Sapiens
KQFHLTPVM

SEQ ID NO: 158788 - protein, 9 aa, Homo Sapiens
KQFHRIVTY

SEQ ID NO: 158789 - protein, 9 aa, Homo Sapiens
KQFPEVIKY

SEQ ID NO: 158790 - protein, 9 aa, Homo Sapiens
KQIFETIYY

SEQ ID NO: 158791 - protein, 9 aa, Homo Sapiens
KQYGNEVFL

SEQ ID NO: 158792 - protein, 9 aa, Homo Sapiens
KSFEAPIKL

SEQ ID NO: 158793 - protein, 9 aa, Homo Sapiens
KSFEGLFYF

SEQ ID NO: 158794 - protein, 9 aa, Homo Sapiens
KSFEKLMKI

SEQ ID NO: 158795 - protein, 9 aa, Homo Sapiens
KSFFRRLSF

SEQ ID NO: 158796 - protein, 9 aa, Homo Sapiens
KSIARVLTV

SEQ ID NO: 158797 - protein, 9 aa, Homo Sapiens
KSIDLIQKW

SEQ ID NO: 158798 - protein, 9 aa, Homo Sapiens
KSIHIVVTM

SEQ ID NO: 158799 - protein, 9 aa, Homo Sapiens
KSKDFVQVM

SEQ ID NO: 158800 - protein, 9 aa, Homo Sapiens
KSVDWLLVF

SEQ ID NO: 158801 - protein, 9 aa, Homo Sapiens
KSYLRCITF

SEQ ID NO: 158802 - protein, 9 aa, Homo Sapiens
KSYSKAFTL

SEQ ID NO: 158803 - protein, 9 aa, Homo Sapiens
KTADICQML

SEQ ID NO: 158804 - protein, 9 aa, Homo Sapiens
KTFPEIIDY

SEQ ID NO: 158805 - protein, 9 aa, Homo Sapiens
KTFPYQHRY

SEQ ID NO: 158806 - protein, 9 aa, Homo Sapiens
KTIDYIQFL

SEQ ID NO: 158807 - protein, 9 aa, Homo Sapiens
KTPDFILQV

SEQ ID NO: 158808 - protein, 9 aa, Homo Sapiens
KTTELIRRI

SEQ ID NO: 158809 - protein, 9 aa, Homo Sapiens
KTVNKILQI

SEQ ID NO: 158810 - protein, 9 aa, Homo Sapiens
KTYPCKISY

SEQ ID NO: 158811 - protein, 9 aa, Homo Sapiens
KVANLVKAY

SEQ ID NO: 158812 - protein, 9 aa, Homo Sapiens
KVFGHIRVY

SEQ ID NO: 158813 - protein, 9 aa, Homo Sapiens
KVIELVKKY

SEQ ID NO: 158814 - protein, 9 aa, Homo Sapiens
LAAAMVRVL

SEQ ID NO: 158815 - protein, 9 aa, Homo Sapiens
LAAAVPKIM

SEQ ID NO: 158816 - protein, 9 aa, Homo Sapiens
LAADIFAIA

SEQ ID NO: 158817 - protein, 9 aa, Homo Sapiens
LAADIHQAL

SEQ ID NO: 158818 - protein, 9 aa, Homo Sapiens
LAAEFLKQV

SEQ ID NO: 158819 - protein, 9 aa, Homo Sapiens
LAAIWFRTY

SEQ ID NO: 158820 - protein, 9 aa, Homo Sapiens
LAAPICLLY

SEQ ID NO: 158821 - protein, 9 aa, Homo Sapiens
LAAPLLKRL

SEQ ID NO: 158822 - protein, 9 aa, Homo Sapiens
LAAPMILSL

SEQ ID NO: 158823 - protein, 9 aa, Homo Sapiens
LAAPVISVL

SEQ ID NO: 158824 - protein, 9 aa, Homo Sapiens
LAAQFVKLL

SEQ ID NO: 158825 - protein, 9 aa, Homo Sapiens
LAATFIRSL

SEQ ID NO: 158826 - protein, 9 aa, Homo Sapiens
LAAYHPWVV

SEQ ID NO: 158827 - protein, 9 aa, Homo Sapiens
LACGVAKVL

SEQ ID NO: 158828 - protein, 9 aa, Homo Sapiens
LACPLLRQL

SEQ ID NO: 158829 - protein, 9 aa, Homo Sapiens
LAFAREFMA

SEQ ID NO: 158830 - protein, 9 aa, Homo Sapiens
LAFEGPILL

SEQ ID NO: 158831 - protein, 9 aa, Homo Sapiens
LAFESIQKI

SEQ ID NO: 158832 - protein, 9 aa, Homo Sapiens
LAFLRFVVY

SEQ ID NO: 158833 - protein, 9 aa, Homo Sapiens
LAFPAPLYY

SEQ ID NO: 158834 - protein, 9 aa, Homo Sapiens
LAFPGEMLL

SEQ ID NO: 158835 - protein, 9 aa, Homo Sapiens
LAFPVGVFV

SEQ ID NO: 158836 - protein, 9 aa, Homo Sapiens
LAFSRALEL

SEQ ID NO: 158837 - protein, 9 aa, Homo Sapiens
LAGPAEPEL

SEQ ID NO: 158838 - protein, 9 aa, Homo Sapiens
LAIDAIHQL

SEQ ID NO: 158839 - protein, 9 aa, Homo Sapiens
LAIEHVRFF

SEQ ID NO: 158840 - protein, 9 aa, Homo Sapiens
LAIGLLHIV

SEQ ID NO: 158841 - protein, 9 aa, Homo Sapiens
LAINHKLEI

SEQ ID NO: 158842 - protein, 9 aa, Homo Sapiens
LAIPFAITI

SEQ ID NO: 158843 - protein, 9 aa, Homo Sapiens
LAIPNLVIF

SEQ ID NO: 158844 - protein, 9 aa, Homo Sapiens
LAKAWPTVL

SEQ ID NO: 158845 - protein, 9 aa, Homo Sapiens
LAKDGVLTL

SEQ ID NO: 158846 - protein, 9 aa, Homo Sapiens
LAKEFAEIL

SEQ ID NO: 158847 - protein, 9 aa, Homo Sapiens
LALNFSVFY

SEQ ID NO: 158848 - protein, 9 aa, Homo Sapiens
LANGDVWKV

SEQ ID NO: 158849 - protein, 9 aa, Homo Sapiens
LAPGFVIKV

SEQ ID NO: 158850 - protein, 9 aa, Homo Sapiens
LAPNFRWAI

SEQ ID NO: 158851 - protein, 9 aa, Homo Sapiens
LAQAHIQQL

SEQ ID NO: 158852 - protein, 9 aa, Homo Sapiens
LAQPQMMVV

SEQ ID NO: 158853 - protein, 9 aa, Homo Sapiens
LAQQIHPVV

SEQ ID NO: 158854 - protein, 9 aa, Homo Sapiens
LARLFTAYL

SEQ ID NO: 158855 - protein, 9 aa, Homo Sapiens
LASAFFLVV

SEQ ID NO: 158856 - protein, 9 aa, Homo Sapiens
LASAIINTL

SEQ ID NO: 158857 - protein, 9 aa, Homo Sapiens
LASANLRVL

SEQ ID NO: 158858 - protein, 9 aa, Homo Sapiens
LASGLVVFF

SEQ ID NO: 158859 - protein, 9 aa, Homo Sapiens
LASHYIHIV

SEQ ID NO: 158860 - protein, 9 aa, Homo Sapiens
LASLIRSVV

SEQ ID NO: 158861 - protein, 9 aa, Homo Sapiens
LASPPWRVL

SEQ ID NO: 158862 - protein, 9 aa, Homo Sapiens
LASPVSPEL

SEQ ID NO: 158863 - protein, 9 aa, Homo Sapiens
LASQIIKTL

SEQ ID NO: 158864 - protein, 9 aa, Homo Sapiens
LATDFIQSL

SEQ ID NO: 158865 - protein, 9 aa, Homo Sapiens
LATEVVTVF

SEQ ID NO: 158866 - protein, 9 aa, Homo Sapiens
LATLITQFL

SEQ ID NO: 158867 - protein, 9 aa, Homo Sapiens
LATPVVSVA

SEQ ID NO: 158868 - protein, 9 aa, Homo Sapiens
LAVAHPLLL

SEQ ID NO: 158869 - protein, 9 aa, Homo Sapiens
LAVDKIIFV

SEQ ID NO: 158870 - protein, 9 aa, Homo Sapiens
LAVDNILYI

SEQ ID NO: 158871 - protein, 9 aa, Homo Sapiens
LAVEAVLRL

SEQ ID NO: 158872 - protein, 9 aa, Homo Sapiens
LAVNHVFEI

SEQ ID NO: 158873 - protein, 9 aa, Homo Sapiens
LAVNKIKEI

SEQ ID NO: 158874 - protein, 9 aa, Homo Sapiens
LAVNLTRVL

SEQ ID NO: 158875 - protein, 9 aa, Homo Sapiens
LAVPFCVNF

SEQ ID NO: 158876 - protein, 9 aa, Homo Sapiens
LAVPIILRV

SEQ ID NO: 158877 - protein, 9 aa, Homo Sapiens
LAVSLVKVF

SEQ ID NO: 158878 - protein, 9 aa, Homo Sapiens
LAVSRIITW

SEQ ID NO: 158879 - protein, 9 aa, Homo Sapiens
LAVSRVITW

SEQ ID NO: 158880 - protein, 9 aa, Homo Sapiens
LAWQNPHML

SEQ ID NO: 158881 - protein, 9 aa, Homo Sapiens
LAYAEYVIY

SEQ ID NO: 158882 - protein, 9 aa, Homo Sapiens
LAYANLMLL

SEQ ID NO: 158883 - protein, 9 aa, Homo Sapiens
LAYHLAVVL

SEQ ID NO: 158884 - protein, 9 aa, Homo Sapiens
LAYHRLHQL

SEQ ID NO: 158885 - protein, 9 aa, Homo Sapiens
LAYIHLIEF

SEQ ID NO: 158886 - protein, 9 aa, Homo Sapiens
LAYLRTECY

SEQ ID NO: 158887 - protein, 9 aa, Homo Sapiens
LAYMNHIMV

SEQ ID NO: 158888 - protein, 9 aa, Homo Sapiens
LAYNEIITI

SEQ ID NO: 158889 - protein, 9 aa, Homo Sapiens
LAYPDKLVM

SEQ ID NO: 158890 - protein, 9 aa, Homo Sapiens
LAYPNGHYF

SEQ ID NO: 158891 - protein, 9 aa, Homo Sapiens
LAYPNPIDP

SEQ ID NO: 158892 - protein, 9 aa, Homo Sapiens
LAYPTAVNW

SEQ ID NO: 158893 - protein, 9 aa, Homo Sapiens
LAYQKQWEV

SEQ ID NO: 158894 - protein, 9 aa, Homo Sapiens
LAYSGVHLY

SEQ ID NO: 158895 - protein, 9 aa, Homo Sapiens
LAYSGYKYV

SEQ ID NO: 158896 - protein, 9 aa, Homo Sapiens
LFAPFIVYY

SEQ ID NO: 158897 - protein, 9 aa, Homo Sapiens
LGRGKFAVV

SEQ ID NO: 158898 - protein, 9 aa, Homo Sapiens
LGYEEVVLY

SEQ ID NO: 158899 - protein, 9 aa, Homo Sapiens
LGYPWVEYW

SEQ ID NO: 158900 - protein, 9 aa, Homo Sapiens
LIFSVPIVY

SEQ ID NO: 158901 - protein, 9 aa, Homo Sapiens
LIPKFVSFL

SEQ ID NO: 158902 - protein, 9 aa, Homo Sapiens
LIPYWTVYF

SEQ ID NO: 158903 - protein, 9 aa, Homo Sapiens
LIYGRPVYV

SEQ ID NO: 158904 - protein, 9 aa, Homo Sapiens
LIYGTPRAA

SEQ ID NO: 158905 - protein, 9 aa, Homo Sapiens
LLKNPFLSV

SEQ ID NO: 158906 - protein, 9 aa, Homo Sapiens
LMSGKVKVW

SEQ ID NO: 158907 - protein, 9 aa, Homo Sapiens
LMVPVTVVF

SEQ ID NO: 158908 - protein, 9 aa, Homo Sapiens
LMYPYIFHV

SEQ ID NO: 158909 - protein, 9 aa, Homo Sapiens
LQETATWLL

SEQ ID NO: 158910 - protein, 9 aa, Homo Sapiens
LQGPLRDVF

SEQ ID NO: 158911 - protein, 9 aa, Homo Sapiens
LQIGVIRVY

SEQ ID NO: 158912 - protein, 9 aa, Homo Sapiens
LQKEFITTY

SEQ ID NO: 158913 - protein, 9 aa, Homo Sapiens
LSADIFQQV

SEQ ID NO: 158914 - protein, 9 aa, Homo Sapiens
LSAEVYRIL

SEQ ID NO: 158915 - protein, 9 aa, Homo Sapiens
LSAGATKVY

SEQ ID NO: 158916 - protein, 9 aa, Homo Sapiens
LSAPIHTQM

SEQ ID NO: 158917 - protein, 9 aa, Homo Sapiens
LSFFYPVLF

SEQ ID NO: 158918 - protein, 9 aa, Homo Sapiens
LSFPHLLQT

SEQ ID NO: 158919 - protein, 9 aa, Homo Sapiens
LSFPTTKTY

SEQ ID NO: 158920 - protein, 9 aa, Homo Sapiens
LSFPYSYEV

SEQ ID NO: 158921 - protein, 9 aa, Homo Sapiens
LSFQEVREY

SEQ ID NO: 158922 - protein, 9 aa, Homo Sapiens
LSFTHPISF

SEQ ID NO: 158923 - protein, 9 aa, Homo Sapiens
LSHSLLVTL

SEQ ID NO: 158924 - protein, 9 aa, Homo Sapiens
LSIPRVFYV

SEQ ID NO: 158925 - protein, 9 aa, Homo Sapiens
LSIPYRLIF

SEQ ID NO: 158926 - protein, 9 aa, Homo Sapiens
LSKDGVLYV

SEQ ID NO: 158927 - protein, 9 aa, Homo Sapiens
LSKDSILSL

SEQ ID NO: 158928 - protein, 9 aa, Homo Sapiens
LSKGPGLEV

SEQ ID NO: 158929 - protein, 9 aa, Homo Sapiens
LSPDFTFTA

SEQ ID NO: 158930 - protein, 9 aa, Homo Sapiens
LSSNVILHV

SEQ ID NO: 158931 - protein, 9 aa, Homo Sapiens
LSSPWYHTY

SEQ ID NO: 158932 - protein, 9 aa, Homo Sapiens
LSSSVIREL

SEQ ID NO: 158933 - protein, 9 aa, Homo Sapiens
LSTHLLILY

SEQ ID NO: 158934 - protein, 9 aa, Homo Sapiens
LSVDLIKTY

SEQ ID NO: 158935 - protein, 9 aa, Homo Sapiens
LSVEIVHEL

SEQ ID NO: 158936 - protein, 9 aa, Homo Sapiens
LSVPIIIKY

SEQ ID NO: 158937 - protein, 9 aa, Homo Sapiens
LSVYLVRQL

SEQ ID NO: 158938 - protein, 9 aa, Homo Sapiens
LSYTEILKI

SEQ ID NO: 158939 - protein, 9 aa, Homo Sapiens
LSYWKPFLV

SEQ ID NO: 158940 - protein, 9 aa, Homo Sapiens
LTFAGVKMY

SEQ ID NO: 158941 - protein, 9 aa, Homo Sapiens
LTFPHPVYY

SEQ ID NO: 158942 - protein, 9 aa, Homo Sapiens
LTIDHVPIW

SEQ ID NO: 158943 - protein, 9 aa, Homo Sapiens
LTINTAIVY

SEQ ID NO: 158944 - protein, 9 aa, Homo Sapiens
LTPSHIKAY

SEQ ID NO: 158945 - protein, 9 aa, Homo Sapiens
LTVPFARYL

SEQ ID NO: 158946 - protein, 9 aa, Homo Sapiens
LTVPWLVEF

SEQ ID NO: 158947 - protein, 9 aa, Homo Sapiens
LTYENVERW

SEQ ID NO: 158948 - protein, 9 aa, Homo Sapiens
LTYPRAVVF

SEQ ID NO: 158949 - protein, 9 aa, Homo Sapiens
LVIDAVREI

SEQ ID NO: 158950 - protein, 9 aa, Homo Sapiens
LVSQYFQTV

SEQ ID NO: 158951 - protein, 9 aa, Homo Sapiens
LVYDGIRDI

SEQ ID NO: 158952 - protein, 9 aa, Homo Sapiens
MAAAWPLLL

SEQ ID NO: 158953 - protein, 9 aa, Homo Sapiens
MAAERVKAW

SEQ ID NO: 158954 - protein, 9 aa, Homo Sapiens
MAAGLNSIL

SEQ ID NO: 158955 - protein, 9 aa, Homo Sapiens
MAANVIPVL

SEQ ID NO: 158956 - protein, 9 aa, Homo Sapiens
MAAPKVRFM

SEQ ID NO: 158957 - protein, 9 aa, Homo Sapiens
MAAPLVLVL

SEQ ID NO: 158958 - protein, 9 aa, Homo Sapiens
MAAPQIRKM

SEQ ID NO: 158959 - protein, 9 aa, Homo Sapiens
MAAPSWKCL

SEQ ID NO: 158960 - protein, 9 aa, Homo Sapiens
MAARIIAKL

SEQ ID NO: 158961 - protein, 9 aa, Homo Sapiens
MAFDPTSTL

SEQ ID NO: 158962 - protein, 9 aa, Homo Sapiens
MAFLLPLII

SEQ ID NO: 158963 - protein, 9 aa, Homo Sapiens
MAFPKPFES

SEQ ID NO: 158964 - protein, 9 aa, Homo Sapiens
MAFYVVKMY

SEQ ID NO: 158965 - protein, 9 aa, Homo Sapiens
MAGPLRAPL

SEQ ID NO: 158966 - protein, 9 aa, Homo Sapiens
MAHTGVIFF

SEQ ID NO: 158967 - protein, 9 aa, Homo Sapiens
MAINSISKL

SEQ ID NO: 158968 - protein, 9 aa, Homo Sapiens
MAIPLVFQI

SEQ ID NO: 158969 - protein, 9 aa, Homo Sapiens
MALAVRVVY

SEQ ID NO: 158970 - protein, 9 aa, Homo Sapiens
MALEHLVVW

SEQ ID NO: 158971 - protein, 9 aa, Homo Sapiens
MALGHVIVL

SEQ ID NO: 158972 - protein, 9 aa, Homo Sapiens
MANGEIHIY

SEQ ID NO: 158973 - protein, 9 aa, Homo Sapiens
MANPRELRI

SEQ ID NO: 158974 - protein, 9 aa, Homo Sapiens
MAPLKMLAL

SEQ ID NO: 158975 - protein, 9 aa, Homo Sapiens
MAQNIFAVL

SEQ ID NO: 158976 - protein, 9 aa, Homo Sapiens
MAQRLVRVL

SEQ ID NO: 158977 - protein, 9 aa, Homo Sapiens
MARETWEVL

SEQ ID NO: 158978 - protein, 9 aa, Homo Sapiens
MASKILKSY

SEQ ID NO: 158979 - protein, 9 aa, Homo Sapiens
MATPLLMQA

SEQ ID NO: 158980 - protein, 9 aa, Homo Sapiens
MAVAFVLSL

SEQ ID NO: 158981 - protein, 9 aa, Homo Sapiens
MAVEFLHEL

SEQ ID NO: 158982 - protein, 9 aa, Homo Sapiens
MAVEFPLVL

SEQ ID NO: 158983 - protein, 9 aa, Homo Sapiens
MAVPATVIY

SEQ ID NO: 158984 - protein, 9 aa, Homo Sapiens
MAVYLVKQL

SEQ ID NO: 158985 - protein, 9 aa, Homo Sapiens
MAWDLPSVL

SEQ ID NO: 158986 - protein, 9 aa, Homo Sapiens
MAYAGARFV

SEQ ID NO: 158987 - protein, 9 aa, Homo Sapiens
MAYARQIYI

SEQ ID NO: 158988 - protein, 9 aa, Homo Sapiens
MAYLKIQKY

SEQ ID NO: 158989 - protein, 9 aa, Homo Sapiens
MAYLYPLQW

SEQ ID NO: 158990 - protein, 9 aa, Homo Sapiens
MAYPDLNEI

SEQ ID NO: 158991 - protein, 9 aa, Homo Sapiens
MAYPSLVAM

SEQ ID NO: 158992 - protein, 9 aa, Homo Sapiens
MAYSNLLRA

SEQ ID NO: 158993 - protein, 9 aa, Homo Sapiens
MAYWKSVIL

SEQ ID NO: 158994 - protein, 9 aa, Homo Sapiens
MGFSGIVVH

SEQ ID NO: 158995 - protein, 9 aa, Homo Sapiens
MLFGHPLLV

SEQ ID NO: 158996 - protein, 9 aa, Homo Sapiens
MQFSKPRKL

SEQ ID NO: 158997 - protein, 9 aa, Homo Sapiens
MQISFIHQL

SEQ ID NO: 158998 - protein, 9 aa, Homo Sapiens
MSADVPLVV

SEQ ID NO: 158999 - protein, 9 aa, Homo Sapiens
MSCEVLRVL

SEQ ID NO: 159000 - protein, 9 aa, Homo Sapiens
MSFENQVKY

SEQ ID NO: 159001 - protein, 9 aa, Homo Sapiens
MSFGNVVEL

SEQ ID NO: 159002 - protein, 9 aa, Homo Sapiens
MSIPFRSAY

SEQ ID NO: 159003 - protein, 9 aa, Homo Sapiens
MSLHFLILY

SEQ ID NO: 159004 - protein, 9 aa, Homo Sapiens
MSVEVRQTL

SEQ ID NO: 159005 - protein, 9 aa, Homo Sapiens
MSVTKVVVH

SEQ ID NO: 159006 - protein, 9 aa, Homo Sapiens
MSVYLVRQL

SEQ ID NO: 159007 - protein, 9 aa, Homo Sapiens
MSYAEVMRL

SEQ ID NO: 159008 - protein, 9 aa, Homo Sapiens
MSYEQLMQL

SEQ ID NO: 159009 - protein, 9 aa, Homo Sapiens
MSYPAKVTL

SEQ ID NO: 159010 - protein, 9 aa, Homo Sapiens
MTFPGERIY

SEQ ID NO: 159011 - protein, 9 aa, Homo Sapiens
MTKDFEPIL

SEQ ID NO: 159012 - protein, 9 aa, Homo Sapiens
MTPEIIQKL

SEQ ID NO: 159013 - protein, 9 aa, Homo Sapiens
MTSNIVQCL

SEQ ID NO: 159014 - protein, 9 aa, Homo Sapiens
MTTEILRSM

SEQ ID NO: 159015 - protein, 9 aa, Homo Sapiens
MTYERILYI

SEQ ID NO: 159016 - protein, 9 aa, Homo Sapiens
MVFPKPVTA

SEQ ID NO: 159017 - protein, 9 aa, Homo Sapiens
MVVDIVQEL

SEQ ID NO: 159018 - protein, 9 aa, Homo Sapiens
MVYGGVRIV

SEQ ID NO: 159019 - protein, 9 aa, Homo Sapiens
NAAFALKQY

SEQ ID NO: 159020 - protein, 9 aa, Homo Sapiens
NAAKILPIM

SEQ ID NO: 159021 - protein, 9 aa, Homo Sapiens
NAAKVHLMV

SEQ ID NO: 159022 - protein, 9 aa, Homo Sapiens
NAARWPWVL

SEQ ID NO: 159023 - protein, 9 aa, Homo Sapiens
NAATILVFF

SEQ ID NO: 159024 - protein, 9 aa, Homo Sapiens
NAAVTVLRV

SEQ ID NO: 159025 - protein, 9 aa, Homo Sapiens
NAFAGLLKL

SEQ ID NO: 159026 - protein, 9 aa, Homo Sapiens
NAFASVILF

SEQ ID NO: 159027 - protein, 9 aa, Homo Sapiens
NAFEAPLTF

SEQ ID NO: 159028 - protein, 9 aa, Homo Sapiens
NAFEELVAF

SEQ ID NO: 159029 - protein, 9 aa, Homo Sapiens
NAFKEITTM

SEQ ID NO: 159030 - protein, 9 aa, Homo Sapiens
NAFLLPIKT

SEQ ID NO: 159031 - protein, 9 aa, Homo Sapiens
NAFMKAVEL

SEQ ID NO: 159032 - protein, 9 aa, Homo Sapiens
NAFNNSIIP

SEQ ID NO: 159033 - protein, 9 aa, Homo Sapiens
NAFPEIFYT

SEQ ID NO: 159034 - protein, 9 aa, Homo Sapiens
NAFQWAIKA

SEQ ID NO: 159035 - protein, 9 aa, Homo Sapiens
NAFRIIKEV

SEQ ID NO: 159036 - protein, 9 aa, Homo Sapiens
NAFSFPSEI

SEQ ID NO: 159037 - protein, 9 aa, Homo Sapiens
NAFSGVMML

SEQ ID NO: 159038 - protein, 9 aa, Homo Sapiens
NAFTMPLHM

SEQ ID NO: 159039 - protein, 9 aa, Homo Sapiens
NAFWKCVQA

SEQ ID NO: 159040 - protein, 9 aa, Homo Sapiens
NAIEDTIFY

SEQ ID NO: 159041 - protein, 9 aa, Homo Sapiens
NAIEHVIIP

SEQ ID NO: 159042 - protein, 9 aa, Homo Sapiens
NAIEKVFKV

SEQ ID NO: 159043 - protein, 9 aa, Homo Sapiens
NAIETMPCV

SEQ ID NO: 159044 - protein, 9 aa, Homo Sapiens
NAIGVLIYM

SEQ ID NO: 159045 - protein, 9 aa, Homo Sapiens
NAKDFFRVL

SEQ ID NO: 159046 - protein, 9 aa, Homo Sapiens
NALDKVLSV

SEQ ID NO: 159047 - protein, 9 aa, Homo Sapiens
NAMDVVVQF

SEQ ID NO: 159048 - protein, 9 aa, Homo Sapiens
NAMGKQWHV

SEQ ID NO: 159049 - protein, 9 aa, Homo Sapiens
NAMGYVRMI

SEQ ID NO: 159050 - protein, 9 aa, Homo Sapiens
NAMPHIKTY

SEQ ID NO: 159051 - protein, 9 aa, Homo Sapiens
NASPINRIV

SEQ ID NO: 159052 - protein, 9 aa, Homo Sapiens
NASPVISSV

SEQ ID NO: 159053 - protein, 9 aa, Homo Sapiens
NAVGVPIKV

SEQ ID NO: 159054 - protein, 9 aa, Homo Sapiens
NAVHWQPVF

SEQ ID NO: 159055 - protein, 9 aa, Homo Sapiens
NAVNLAIKY

SEQ ID NO: 159056 - protein, 9 aa, Homo Sapiens
NAYAFLTLY

SEQ ID NO: 159057 - protein, 9 aa, Homo Sapiens
NAYEFIMKL

SEQ ID NO: 159058 - protein, 9 aa, Homo Sapiens
NAYPSPLGY

SEQ ID NO: 159059 - protein, 9 aa, Homo Sapiens
NAYPSPQLL

SEQ ID NO: 159060 - protein, 9 aa, Homo Sapiens
NAYPYCRTI

SEQ ID NO: 159061 - protein, 9 aa, Homo Sapiens
NAYQRAILL

SEQ ID NO: 159062 - protein, 9 aa, Homo Sapiens
NAYTGIVLL

SEQ ID NO: 159063 - protein, 9 aa, Homo Sapiens
NFFPGVFEY

SEQ ID NO: 159064 - protein, 9 aa, Homo Sapiens
NIFSEVRVY

SEQ ID NO: 159065 - protein, 9 aa, Homo Sapiens
NIICGITSV

SEQ ID NO: 159066 - protein, 9 aa, Homo Sapiens
NIIDLVKKY

SEQ ID NO: 159067 - protein, 9 aa, Homo Sapiens
NIKAPKISM

SEQ ID NO: 159068 - protein, 9 aa, Homo Sapiens
NIPSFAPVL

SEQ ID NO: 159069 - protein, 9 aa, Homo Sapiens
NIRLRLEEY

SEQ ID NO: 159070 - protein, 9 aa, Homo Sapiens
NIYAANPVI

SEQ ID NO: 159071 - protein, 9 aa, Homo Sapiens
NMYGKVVTV

SEQ ID NO: 159072 - protein, 9 aa, Homo Sapiens
NMYIFPVHW

SEQ ID NO: 159073 - protein, 9 aa, Homo Sapiens
NNPQFVWVV

SEQ ID NO: 159074 - protein, 9 aa, Homo Sapiens
NQIPFIIQY

SEQ ID NO: 159075 - protein, 9 aa, Homo Sapiens
NSFGFPQYV

SEQ ID NO: 159076 - protein, 9 aa, Homo Sapiens
NSFGQRVYF

SEQ ID NO: 159077 - protein, 9 aa, Homo Sapiens
NSFIHVIMY

SEQ ID NO: 159078 - protein, 9 aa, Homo Sapiens
NSFPQKISY

SEQ ID NO: 159079 - protein, 9 aa, Homo Sapiens
NSFPQVILL

SEQ ID NO: 159080 - protein, 9 aa, Homo Sapiens
NSIGIIRCY

SEQ ID NO: 159081 - protein, 9 aa, Homo Sapiens
NSSPVINHL

SEQ ID NO: 159082 - protein, 9 aa, Homo Sapiens
NSSSIIQVM

SEQ ID NO: 159083 - protein, 9 aa, Homo Sapiens
NSTYIMRVL

SEQ ID NO: 159084 - protein, 9 aa, Homo Sapiens
NSYPHQLYT

SEQ ID NO: 159085 - protein, 9 aa, Homo Sapiens
NTINLIHTF

SEQ ID NO: 159086 - protein, 9 aa, Homo Sapiens
NTIPFIIRY

SEQ ID NO: 159087 - protein, 9 aa, Homo Sapiens
NTIPLAVVL

SEQ ID NO: 159088 - protein, 9 aa, Homo Sapiens
NTKEPPLSL

SEQ ID NO: 159089 - protein, 9 aa, Homo Sapiens
NTMHLLIKY

SEQ ID NO: 159090 - protein, 9 aa, Homo Sapiens
NTSEIILIL

SEQ ID NO: 159091 - protein, 9 aa, Homo Sapiens
NVKEMWTEV

SEQ ID NO: 159092 - protein, 9 aa, Homo Sapiens
NVPVFWPIL

SEQ ID NO: 159093 - protein, 9 aa, Homo Sapiens
NVYPEEMIV

SEQ ID NO: 159094 - protein, 9 aa, Homo Sapiens
PHFSFSTLP

SEQ ID NO: 159095 - protein, 9 aa, Homo Sapiens
PIRLLAAAA

SEQ ID NO: 159096 - protein, 9 aa, Homo Sapiens
PSIVHRKCF

SEQ ID NO: 159097 - protein, 9 aa, Homo Sapiens
QAADFALKV

SEQ ID NO: 159098 - protein, 9 aa, Homo Sapiens
QAADSILVL

SEQ ID NO: 159099 - protein, 9 aa, Homo Sapiens
QAADTVVIF

SEQ ID NO: 159100 - protein, 9 aa, Homo Sapiens
QAAGILLRL

SEQ ID NO: 159101 - protein, 9 aa, Homo Sapiens
QACGITAVL

SEQ ID NO: 159102 - protein, 9 aa, Homo Sapiens
QAFGGLLVA

SEQ ID NO: 159103 - protein, 9 aa, Homo Sapiens
QAFHEQIVI

SEQ ID NO: 159104 - protein, 9 aa, Homo Sapiens
QAFLEAVQF

SEQ ID NO: 159105 - protein, 9 aa, Homo Sapiens
QAFLIAIVV

SEQ ID NO: 159106 - protein, 9 aa, Homo Sapiens
QAFPGLLQL

SEQ ID NO: 159107 - protein, 9 aa, Homo Sapiens
QAFPLIIKL

SEQ ID NO: 159108 - protein, 9 aa, Homo Sapiens
QAFSRVQIY

SEQ ID NO: 159109 - protein, 9 aa, Homo Sapiens
QAGPINREM

SEQ ID NO: 159110 - protein, 9 aa, Homo Sapiens
QAIAIPVTV

SEQ ID NO: 159111 - protein, 9 aa, Homo Sapiens
QAIENAHVL

SEQ ID NO: 159112 - protein, 9 aa, Homo Sapiens
QAIERYLVV

SEQ ID NO: 159113 - protein, 9 aa, Homo Sapiens
QAIGAIRTL

SEQ ID NO: 159114 - protein, 9 aa, Homo Sapiens
QAINNAITY

SEQ ID NO: 159115 - protein, 9 aa, Homo Sapiens
QAIQWILHY

SEQ ID NO: 159116 - protein, 9 aa, Homo Sapiens
QAITLVTQY

SEQ ID NO: 159117 - protein, 9 aa, Homo Sapiens
QALPQVRLY

SEQ ID NO: 159118 - protein, 9 aa, Homo Sapiens
QALPWVRYI

SEQ ID NO: 159119 - protein, 9 aa, Homo Sapiens
QAMGSFLSV

SEQ ID NO: 159120 - protein, 9 aa, Homo Sapiens
QASEEILKV

SEQ ID NO: 159121 - protein, 9 aa, Homo Sapiens
QASPFVLRA

SEQ ID NO: 159122 - protein, 9 aa, Homo Sapiens
QASPLQILV

SEQ ID NO: 159123 - protein, 9 aa, Homo Sapiens
QATELVHQL

SEQ ID NO: 159124 - protein, 9 aa, Homo Sapiens
QATPLLHAL

SEQ ID NO: 159125 - protein, 9 aa, Homo Sapiens
QAVAIFTVY

SEQ ID NO: 159126 - protein, 9 aa, Homo Sapiens
QAVDYIKKL

SEQ ID NO: 159127 - protein, 9 aa, Homo Sapiens
QAVGAVLSL

SEQ ID NO: 159128 - protein, 9 aa, Homo Sapiens
QAVGIILHY

SEQ ID NO: 159129 - protein, 9 aa, Homo Sapiens
QAVNFPFLV

SEQ ID NO: 159130 - protein, 9 aa, Homo Sapiens
QAVQIINYI

SEQ ID NO: 159131 - protein, 9 aa, Homo Sapiens
QAYPEVRIV

SEQ ID NO: 159132 - protein, 9 aa, Homo Sapiens
QAYPTTVVF

SEQ ID NO: 159133 - protein, 9 aa, Homo Sapiens
QAYQEAFEI

SEQ ID NO: 159134 - protein, 9 aa, Homo Sapiens
QAYSGIQQY

SEQ ID NO: 159135 - protein, 9 aa, Homo Sapiens
QGFPNRVVF

SEQ ID NO: 159136 - protein, 9 aa, Homo Sapiens
QLLPFLVRY

SEQ ID NO: 159137 - protein, 9 aa, Homo Sapiens
QLPNFAFSV

SEQ ID NO: 159138 - protein, 9 aa, Homo Sapiens
QMFQGIILF

SEQ ID NO: 159139 - protein, 9 aa, Homo Sapiens
QMSNITVTY

SEQ ID NO: 159140 - protein, 9 aa, Homo Sapiens
QSFNAVVNY

SEQ ID NO: 159141 - protein, 9 aa, Homo Sapiens
QSFPEPLII

SEQ ID NO: 159142 - protein, 9 aa, Homo Sapiens
QSFPGILKA

SEQ ID NO: 159143 - protein, 9 aa, Homo Sapiens
QSSELTKWY

SEQ ID NO: 159144 - protein, 9 aa, Homo Sapiens
QSSGLVRHW

SEQ ID NO: 159145 - protein, 9 aa, Homo Sapiens
QSTDIIRYL

SEQ ID NO: 159146 - protein, 9 aa, Homo Sapiens
QSVSMVILY

SEQ ID NO: 159147 - protein, 9 aa, Homo Sapiens
QSYGNVVEL

SEQ ID NO: 159148 - protein, 9 aa, Homo Sapiens
QSYPTPVTV

SEQ ID NO: 159149 - protein, 9 aa, Homo Sapiens
QTFIRAIFY

SEQ ID NO: 159150 - protein, 9 aa, Homo Sapiens
QTIDNIVFY

SEQ ID NO: 159151 - protein, 9 aa, Homo Sapiens
QTYFFPIHL

SEQ ID NO: 159152 - protein, 9 aa, Homo Sapiens
QTYGYEHIL

SEQ ID NO: 159153 - protein, 9 aa, Homo Sapiens
QTYPEVVRM

SEQ ID NO: 159154 - protein, 9 aa, Homo Sapiens
RAADVLVYL

SEQ ID NO: 159155 - protein, 9 aa, Homo Sapiens
RAAEFIKNY

SEQ ID NO: 159156 - protein, 9 aa, Homo Sapiens
RAALPLQLL

SEQ ID NO: 159157 - protein, 9 aa, Homo Sapiens
RAAPFSLEY

SEQ ID NO: 159158 - protein, 9 aa, Homo Sapiens
RAASFVSVL

SEQ ID NO: 159159 - protein, 9 aa, Homo Sapiens
RAATFPLQV

SEQ ID NO: 159160 - protein, 9 aa, Homo Sapiens
RAFCGILYM

SEQ ID NO: 159161 - protein, 9 aa, Homo Sapiens
RAFDHVLHL

SEQ ID NO: 159162 - protein, 9 aa, Homo Sapiens
RAFEYEIRF

SEQ ID NO: 159163 - protein, 9 aa, Homo Sapiens
RAFGIPIRV

SEQ ID NO: 159164 - protein, 9 aa, Homo Sapiens
RAFHGWNEF

SEQ ID NO: 159165 - protein, 9 aa, Homo Sapiens
RAFKKPVFY

SEQ ID NO: 159166 - protein, 9 aa, Homo Sapiens
RAFNRIYVA

SEQ ID NO: 159167 - protein, 9 aa, Homo Sapiens
RAFPGLRYV

SEQ ID NO: 159168 - protein, 9 aa, Homo Sapiens
RAFPLPMSF

SEQ ID NO: 159169 - protein, 9 aa, Homo Sapiens
RAFPYGNVA

SEQ ID NO: 159170 - protein, 9 aa, Homo Sapiens
RAIAKIKML

SEQ ID NO: 159171 - protein, 9 aa, Homo Sapiens
RAIDFSPYL

SEQ ID NO: 159172 - protein, 9 aa, Homo Sapiens
RAIDKCWKI

SEQ ID NO: 159173 - protein, 9 aa, Homo Sapiens
RAIDSIHQL

SEQ ID NO: 159174 - protein, 9 aa, Homo Sapiens
RAIELATTL

SEQ ID NO: 159175 - protein, 9 aa, Homo Sapiens
RAIELFHSY

SEQ ID NO: 159176 - protein, 9 aa, Homo Sapiens
RAIENIDTL

SEQ ID NO: 159177 - protein, 9 aa, Homo Sapiens
RAILRIIYF

SEQ ID NO: 159178 - protein, 9 aa, Homo Sapiens
RAIQFYLEF

SEQ ID NO: 159179 - protein, 9 aa, Homo Sapiens
RALNFAYTV

SEQ ID NO: 159180 - protein, 9 aa, Homo Sapiens
RASFIFISV

SEQ ID NO: 159181 - protein, 9 aa, Homo Sapiens
RASGIFLRL

SEQ ID NO: 159182 - protein, 9 aa, Homo Sapiens
RASLLLKTY

SEQ ID NO: 159183 - protein, 9 aa, Homo Sapiens
RASNITMIL

SEQ ID NO: 159184 - protein, 9 aa, Homo Sapiens
RASPIKMDL

SEQ ID NO: 159185 - protein, 9 aa, Homo Sapiens
RASWIAQVF

SEQ ID NO: 159186 - protein, 9 aa, Homo Sapiens
RATALDNVV

SEQ ID NO: 159187 - protein, 9 aa, Homo Sapiens
RAVELVKSW

SEQ ID NO: 159188 - protein, 9 aa, Homo Sapiens
RAWFPPAIM

SEQ ID NO: 159189 - protein, 9 aa, Homo Sapiens
RAWGHPCEM

SEQ ID NO: 159190 - protein, 9 aa, Homo Sapiens
RAYAKALHY

SEQ ID NO: 159191 - protein, 9 aa, Homo Sapiens
RAYAKDVKF

SEQ ID NO: 159192 - protein, 9 aa, Homo Sapiens
RAYALCVLY

SEQ ID NO: 159193 - protein, 9 aa, Homo Sapiens
RAYDGTTYL

SEQ ID NO: 159194 - protein, 9 aa, Homo Sapiens
RAYELTQYY

SEQ ID NO: 159195 - protein, 9 aa, Homo Sapiens
RAYIFAMKV

SEQ ID NO: 159196 - protein, 9 aa, Homo Sapiens
RAYPAAITI

SEQ ID NO: 159197 - protein, 9 aa, Homo Sapiens
RAYPAQITP

SEQ ID NO: 159198 - protein, 9 aa, Homo Sapiens
RAYPHVFTK

SEQ ID NO: 159199 - protein, 9 aa, Homo Sapiens
RAYPSMMGL

SEQ ID NO: 159200 - protein, 9 aa, Homo Sapiens
RAYPTVKFY

SEQ ID NO: 159201 - protein, 9 aa, Homo Sapiens
RAYQRQLVM

SEQ ID NO: 159202 - protein, 9 aa, Homo Sapiens
RAYSFKVVL

SEQ ID NO: 159203 - protein, 9 aa, Homo Sapiens
RFFEAIVWY

SEQ ID NO: 159204 - protein, 9 aa, Homo Sapiens
RGFDKAYVV

SEQ ID NO: 159205 - protein, 9 aa, Homo Sapiens
RGYDFCQVL

SEQ ID NO: 159206 - protein, 9 aa, Homo Sapiens
RIIDCAFTV

SEQ ID NO: 159207 - protein, 9 aa, Homo Sapiens
RIYPFLLMV

SEQ ID NO: 159208 - protein, 9 aa, Homo Sapiens
RLFGAVVRW

SEQ ID NO: 159209 - protein, 9 aa, Homo Sapiens
RLGPPEPMM

SEQ ID NO: 159210 - protein, 9 aa, Homo Sapiens
RLPAWQPIL

SEQ ID NO: 159211 - protein, 9 aa, Homo Sapiens
RLPEFIVQT

SEQ ID NO: 159212 - protein, 9 aa, Homo Sapiens
RLPVFNWTA

SEQ ID NO: 159213 - protein, 9 aa, Homo Sapiens
RMYPGLQVY

SEQ ID NO: 159214 - protein, 9 aa, Homo Sapiens
RQADCILIV

SEQ ID NO: 159215 - protein, 9 aa, Homo Sapiens
RQADFVQVL

SEQ ID NO: 159216 - protein, 9 aa, Homo Sapiens
RQFDHPHIV

SEQ ID NO: 159217 - protein, 9 aa, Homo Sapiens
RQFPVTVHF

SEQ ID NO: 159218 - protein, 9 aa, Homo Sapiens
RQIDFVLSY

SEQ ID NO: 159219 - protein, 9 aa, Homo Sapiens
RQIGVEHVV

SEQ ID NO: 159220 - protein, 9 aa, Homo Sapiens
RQINWTVLY

SEQ ID NO: 159221 - protein, 9 aa, Homo Sapiens
RQYPEVIKY

SEQ ID NO: 159222 - protein, 9 aa, Homo Sapiens
RSAEVTLEV

SEQ ID NO: 159223 - protein, 9 aa, Homo Sapiens
RSFEAEINY

SEQ ID NO: 159224 - protein, 9 aa, Homo Sapiens
RSFPSVREL

SEQ ID NO: 159225 - protein, 9 aa, Homo Sapiens
RSIDLTVKL

SEQ ID NO: 159226 - protein, 9 aa, Homo Sapiens
RSLEFSVSY

SEQ ID NO: 159227 - protein, 9 aa, Homo Sapiens
RSLHFFVEW

SEQ ID NO: 159228 - protein, 9 aa, Homo Sapiens
RSSENILTV

SEQ ID NO: 159229 - protein, 9 aa, Homo Sapiens
RSTDSIRLL

SEQ ID NO: 159230 - protein, 9 aa, Homo Sapiens
RSVDIINML

SEQ ID NO: 159231 - protein, 9 aa, Homo Sapiens
RSYPYAFSV

SEQ ID NO: 159232 - protein, 9 aa, Homo Sapiens
RTADVIIMM

SEQ ID NO: 159233 - protein, 9 aa, Homo Sapiens
RTAGIFSLI

SEQ ID NO: 159234 - protein, 9 aa, Homo Sapiens
RTFPWIIEV

SEQ ID NO: 159235 - protein, 9 aa, Homo Sapiens
RTIAKRLVL

SEQ ID NO: 159236 - protein, 9 aa, Homo Sapiens
RTIDFVHQV

SEQ ID NO: 159237 - protein, 9 aa, Homo Sapiens
RTKDTPLSL

SEQ ID NO: 159238 - protein, 9 aa, Homo Sapiens
RTTDIVIRI

SEQ ID NO: 159239 - protein, 9 aa, Homo Sapiens
RTVDLFPVL

SEQ ID NO: 159240 - protein, 9 aa, Homo Sapiens
RTYDLYITY

SEQ ID NO: 159241 - protein, 9 aa, Homo Sapiens
RTYDMIQYY

SEQ ID NO: 159242 - protein, 9 aa, Homo Sapiens
RTYPSIQIM

SEQ ID NO: 159243 - protein, 9 aa, Homo Sapiens
RTYPVEILY

SEQ ID NO: 159244 - protein, 9 aa, Homo Sapiens
RVFPHEVNW

SEQ ID NO: 159245 - protein, 9 aa, Homo Sapiens
RVFPSPMRI

SEQ ID NO: 159246 - protein, 9 aa, Homo Sapiens
RVFPYISVM

SEQ ID NO: 159247 - protein, 9 aa, Homo Sapiens
RVFPYSVFY

SEQ ID NO: 159248 - protein, 9 aa, Homo Sapiens
RVIELAVKY

SEQ ID NO: 159249 - protein, 9 aa, Homo Sapiens
RVKKTWTVV

SEQ ID NO: 159250 - protein, 9 aa, Homo Sapiens
RVPNSVLWL

SEQ ID NO: 159251 - protein, 9 aa, Homo Sapiens
RVSELHLEV

SEQ ID NO: 159252 - protein, 9 aa, Homo Sapiens
RVYERLLYV

SEQ ID NO: 159253 - protein, 9 aa, Homo Sapiens
RVYPQAVYF

SEQ ID NO: 159254 - protein, 9 aa, Homo Sapiens
RWYNHIKSY

SEQ ID NO: 159255 - protein, 9 aa, Homo Sapiens
SAAAAPHLL

SEQ ID NO: 159256 - protein, 9 aa, Homo Sapiens
SAAAIFKIY

SEQ ID NO: 159257 - protein, 9 aa, Homo Sapiens
SAADIPINI

SEQ ID NO: 159258 - protein, 9 aa, Homo Sapiens
SAADLVHFL

SEQ ID NO: 159259 - protein, 9 aa, Homo Sapiens
SAADVVVVH

SEQ ID NO: 159260 - protein, 9 aa, Homo Sapiens
SAAEHFSII

SEQ ID NO: 159261 - protein, 9 aa, Homo Sapiens
SAAEHFSMI

SEQ ID NO: 159262 - protein, 9 aa, Homo Sapiens
SAAEIMAVL

SEQ ID NO: 159263 - protein, 9 aa, Homo Sapiens
SAAENFLVL

SEQ ID NO: 159264 - protein, 9 aa, Homo Sapiens
SAAFAVKLF

SEQ ID NO: 159265 - protein, 9 aa, Homo Sapiens
SAAFIFSYI

SEQ ID NO: 159266 - protein, 9 aa, Homo Sapiens
SAAFPGASL

SEQ ID NO: 159267 - protein, 9 aa, Homo Sapiens
SAAGFPIRV

SEQ ID NO: 159268 - protein, 9 aa, Homo Sapiens
SAAGLKLYL

SEQ ID NO: 159269 - protein, 9 aa, Homo Sapiens
SAAHAIVSV

SEQ ID NO: 159270 - protein, 9 aa, Homo Sapiens
SAAHFVMFF

SEQ ID NO: 159271 - protein, 9 aa, Homo Sapiens
SAAMVFSAL

SEQ ID NO: 159272 - protein, 9 aa, Homo Sapiens
SAANIQPIF

SEQ ID NO: 159273 - protein, 9 aa, Homo Sapiens
SAAPFAQRY

SEQ ID NO: 159274 - protein, 9 aa, Homo Sapiens
SAAPFFVLF

SEQ ID NO: 159275 - protein, 9 aa, Homo Sapiens
SAAPLPLYT

SEQ ID NO: 159276 - protein, 9 aa, Homo Sapiens
SAAPLQPVL

SEQ ID NO: 159277 - protein, 9 aa, Homo Sapiens
SAAPVAHLL

SEQ ID NO: 159278 - protein, 9 aa, Homo Sapiens
SAASICAKV

SEQ ID NO: 159279 - protein, 9 aa, Homo Sapiens
SAASLYPVL

SEQ ID NO: 159280 - protein, 9 aa, Homo Sapiens
SAAYLPRMW

SEQ ID NO: 159281 - protein, 9 aa, Homo Sapiens
SAFATPFLV

SEQ ID NO: 159282 - protein, 9 aa, Homo Sapiens
SAFAYAIAA

SEQ ID NO: 159283 - protein, 9 aa, Homo Sapiens
SAFDHFASV

SEQ ID NO: 159284 - protein, 9 aa, Homo Sapiens
SAFDRCATL

SEQ ID NO: 159285 - protein, 9 aa, Homo Sapiens
SAFDRKVQF

SEQ ID NO: 159286 - protein, 9 aa, Homo Sapiens
SAFDRVMRL

SEQ ID NO: 159287 - protein, 9 aa, Homo Sapiens
SAFEKPQII

SEQ ID NO: 159288 - protein, 9 aa, Homo Sapiens
SAFGLPIVF

SEQ ID NO: 159289 - protein, 9 aa, Homo Sapiens
SAFGNVKLV

SEQ ID NO: 159290 - protein, 9 aa, Homo Sapiens
SAFGQIYKV

SEQ ID NO: 159291 - protein, 9 aa, Homo Sapiens
SAFGYFITA

SEQ ID NO: 159292 - protein, 9 aa, Homo Sapiens
SAFINLVEF

SEQ ID NO: 159293 - protein, 9 aa, Homo Sapiens
SAFLPARFY

SEQ ID NO: 159294 - protein, 9 aa, Homo Sapiens
SAFPEVRSL

SEQ ID NO: 159295 - protein, 9 aa, Homo Sapiens
SAFPFLQEY

SEQ ID NO: 159296 - protein, 9 aa, Homo Sapiens
SAFPFPVTV

SEQ ID NO: 159297 - protein, 9 aa, Homo Sapiens
SAFPHLRVL

SEQ ID NO: 159298 - protein, 9 aa, Homo Sapiens
SAFPSNIFY

SEQ ID NO: 159299 - protein, 9 aa, Homo Sapiens
SAFPYAHRF

SEQ ID NO: 159300 - protein, 9 aa, Homo Sapiens
SAFSRIMKL

SEQ ID NO: 159301 - protein, 9 aa, Homo Sapiens
SAFTNRIFF

SEQ ID NO: 159302 - protein, 9 aa, Homo Sapiens
SAFYFVMKF

SEQ ID NO: 159303 - protein, 9 aa, Homo Sapiens
SAGPLLRPY

SEQ ID NO: 159304 - protein, 9 aa, Homo Sapiens
SAHSKVVIF

SEQ ID NO: 159305 - protein, 9 aa, Homo Sapiens
SAIASTKVM

SEQ ID NO: 159306 - protein, 9 aa, Homo Sapiens
SAIDRIFTL

SEQ ID NO: 159307 - protein, 9 aa, Homo Sapiens
SAIFCVVIF

SEQ ID NO: 159308 - protein, 9 aa, Homo Sapiens
SAIGFALEL

SEQ ID NO: 159309 - protein, 9 aa, Homo Sapiens
SAIGLVLLM

SEQ ID NO: 159310 - protein, 9 aa, Homo Sapiens
SAIGYIHSL

SEQ ID NO: 159311 - protein, 9 aa, Homo Sapiens
SAINWTLIH

SEQ ID NO: 159312 - protein, 9 aa, Homo Sapiens
SAIPHPLIM

SEQ ID NO: 159313 - protein, 9 aa, Homo Sapiens
SAIQKIITI

SEQ ID NO: 159314 - protein, 9 aa, Homo Sapiens
SAISSVRLY

SEQ ID NO: 159315 - protein, 9 aa, Homo Sapiens
SAITKPWEV

SEQ ID NO: 159316 - protein, 9 aa, Homo Sapiens
SAKDFIRNL

SEQ ID NO: 159317 - protein, 9 aa, Homo Sapiens
SAKPYAHIL

SEQ ID NO: 159318 - protein, 9 aa, Homo Sapiens
SAKTPGFSV

SEQ ID NO: 159319 - protein, 9 aa, Homo Sapiens
SALDMTRYW

SEQ ID NO: 159320 - protein, 9 aa, Homo Sapiens
SALEHSIQY

SEQ ID NO: 159321 - protein, 9 aa, Homo Sapiens
SALEHVVEF

SEQ ID NO: 159322 - protein, 9 aa, Homo Sapiens
SALEVVRKY

SEQ ID NO: 159323 - protein, 9 aa, Homo Sapiens
SALHIIVQY

SEQ ID NO: 159324 - protein, 9 aa, Homo Sapiens
SALPFITYL

SEQ ID NO: 159325 - protein, 9 aa, Homo Sapiens
SALPTVVAY

SEQ ID NO: 159326 - protein, 9 aa, Homo Sapiens
SAMPTVRSF

SEQ ID NO: 159327 - protein, 9 aa, Homo Sapiens
SAMVRVISV

SEQ ID NO: 159328 - protein, 9 aa, Homo Sapiens
SANHNILQI

SEQ ID NO: 159329 - protein, 9 aa, Homo Sapiens
SAQPLPLKI

SEQ ID NO: 159330 - protein, 9 aa, Homo Sapiens
SASDIFNVA

SEQ ID NO: 159331 - protein, 9 aa, Homo Sapiens
SASEVLKEW

SEQ ID NO: 159332 - protein, 9 aa, Homo Sapiens
SASFLPKYF

SEQ ID NO: 159333 - protein, 9 aa, Homo Sapiens
SASKIIVFV

SEQ ID NO: 159334 - protein, 9 aa, Homo Sapiens
SASPIFTHV

SEQ ID NO: 159335 - protein, 9 aa, Homo Sapiens
SASPWALTI

SEQ ID NO: 159336 - protein, 9 aa, Homo Sapiens
SASRVVQVV

SEQ ID NO: 159337 - protein, 9 aa, Homo Sapiens
SASTVVLQV

SEQ ID NO: 159338 - protein, 9 aa, Homo Sapiens
SASVYIKKV

SEQ ID NO: 159339 - protein, 9 aa, Homo Sapiens
SATELMNIL

SEQ ID NO: 159340 - protein, 9 aa, Homo Sapiens
SATRLIQRL

SEQ ID NO: 159341 - protein, 9 aa, Homo Sapiens
SATSLLHTV

SEQ ID NO: 159342 - protein, 9 aa, Homo Sapiens
SAVDFIRTL

SEQ ID NO: 159343 - protein, 9 aa, Homo Sapiens
SAVDKVIFV

SEQ ID NO: 159344 - protein, 9 aa, Homo Sapiens
SAVDVHINM

SEQ ID NO: 159345 - protein, 9 aa, Homo Sapiens
SAVELVQEF

SEQ ID NO: 159346 - protein, 9 aa, Homo Sapiens
SAVEVCVVY

SEQ ID NO: 159347 - protein, 9 aa, Homo Sapiens
SAVFNPSVL

SEQ ID NO: 159348 - protein, 9 aa, Homo Sapiens
SAVGHVFSL

SEQ ID NO: 159349 - protein, 9 aa, Homo Sapiens
SAVGLTAYV

SEQ ID NO: 159350 - protein, 9 aa, Homo Sapiens
SAVNIIRTF

SEQ ID NO: 159351 - protein, 9 aa, Homo Sapiens
SAVPFLILV

SEQ ID NO: 159352 - protein, 9 aa, Homo Sapiens
SAVPKVMKV

SEQ ID NO: 159353 - protein, 9 aa, Homo Sapiens
SAVRWLLEL

SEQ ID NO: 159354 - protein, 9 aa, Homo Sapiens
SAVSIFHEL

SEQ ID NO: 159355 - protein, 9 aa, Homo Sapiens
SAVSILIKP

SEQ ID NO: 159356 - protein, 9 aa, Homo Sapiens
SAVTFVLTY

SEQ ID NO: 159357 - protein, 9 aa, Homo Sapiens
SAVTRLLIL

SEQ ID NO: 159358 - protein, 9 aa, Homo Sapiens
SAWPSLRLY

SEQ ID NO: 159359 - protein, 9 aa, Homo Sapiens
SAWRVISSI

SEQ ID NO: 159360 - protein, 9 aa, Homo Sapiens
SAWSFITTF

SEQ ID NO: 159361 - protein, 9 aa, Homo Sapiens
SAYAGFLAL

SEQ ID NO: 159362 - protein, 9 aa, Homo Sapiens
SAYAQIVQF

SEQ ID NO: 159363 - protein, 9 aa, Homo Sapiens
SAYARLIDY

SEQ ID NO: 159364 - protein, 9 aa, Homo Sapiens
SAYEFVTWL

SEQ ID NO: 159365 - protein, 9 aa, Homo Sapiens
SAYESLMEI

SEQ ID NO: 159366 - protein, 9 aa, Homo Sapiens
SAYGSVKAY

SEQ ID NO: 159367 - protein, 9 aa, Homo Sapiens
SAYLHPQQF

SEQ ID NO: 159368 - protein, 9 aa, Homo Sapiens
SAYPLSVEW

SEQ ID NO: 159369 - protein, 9 aa, Homo Sapiens
SGFSGVIRL

SEQ ID NO: 159370 - protein, 9 aa, Homo Sapiens
SGSDIVKLY

SEQ ID NO: 159371 - protein, 9 aa, Homo Sapiens
SIAWFTVFY

SEQ ID NO: 159372 - protein, 9 aa, Homo Sapiens
SIFEHKIVF

SEQ ID NO: 159373 - protein, 9 aa, Homo Sapiens
SIIGRLLEV

SEQ ID NO: 159374 - protein, 9 aa, Homo Sapiens
SIITYVVTY

SEQ ID NO: 159375 - protein, 9 aa, Homo Sapiens
SIKDGVMVL

SEQ ID NO: 159376 - protein, 9 aa, Homo Sapiens
SIPAITRYW

SEQ ID NO: 159377 - protein, 9 aa, Homo Sapiens
SIPDFPMHL

SEQ ID NO: 159378 - protein, 9 aa, Homo Sapiens
SIPEFFHIM

SEQ ID NO: 159379 - protein, 9 aa, Homo Sapiens
SITRLIKKY

SEQ ID NO: 159380 - protein, 9 aa, Homo Sapiens
SIYTGVIIV

SEQ ID NO: 159381 - protein, 9 aa, Homo Sapiens
SLAPYVKVF

SEQ ID NO: 159382 - protein, 9 aa, Homo Sapiens
SLFPHAICL

SEQ ID NO: 159383 - protein, 9 aa, Homo Sapiens
SLFSVPVIY

SEQ ID NO: 159384 - protein, 9 aa, Homo Sapiens
SLYDRIVLF

SEQ ID NO: 159385 - protein, 9 aa, Homo Sapiens
SMFGGVMVF

SEQ ID NO: 159386 - protein, 9 aa, Homo Sapiens
SMFHNRHLF

SEQ ID NO: 159387 - protein, 9 aa, Homo Sapiens
SNFLHPVIY

SEQ ID NO: 159388 - protein, 9 aa, Homo Sapiens
SQANIAQVL

SEQ ID NO: 159389 - protein, 9 aa, Homo Sapiens
SQSGLVHIW

SEQ ID NO: 159390 - protein, 9 aa, Homo Sapiens
SQYPDIVIV

SEQ ID NO: 159391 - protein, 9 aa, Homo Sapiens
SQYPFPVTL

SEQ ID NO: 159392 - protein, 9 aa, Homo Sapiens
SQYQGVVVY

SEQ ID NO: 159393 - protein, 9 aa, Homo Sapiens
SQYSNVVIF

SEQ ID NO: 159394 - protein, 9 aa, Homo Sapiens
SSAPIFTVI

SEQ ID NO: 159395 - protein, 9 aa, Homo Sapiens
SSFPGISIM

SEQ ID NO: 159396 - protein, 9 aa, Homo Sapiens
SSFPGVTVI

SEQ ID NO: 159397 - protein, 9 aa, Homo Sapiens
SSFPLPKQY

SEQ ID NO: 159398 - protein, 9 aa, Homo Sapiens
SSFPTVVIY

SEQ ID NO: 159399 - protein, 9 aa, Homo Sapiens
SSFTKVITL

SEQ ID NO: 159400 - protein, 9 aa, Homo Sapiens
SSFTTIVTY

SEQ ID NO: 159401 - protein, 9 aa, Homo Sapiens
SSSAVFLII

SEQ ID NO: 159402 - protein, 9 aa, Homo Sapiens
SSTILVVRY

SEQ ID NO: 159403 - protein, 9 aa, Homo Sapiens
SSVEILRVY

SEQ ID NO: 159404 - protein, 9 aa, Homo Sapiens
SSVHVIMYL

SEQ ID NO: 159405 - protein, 9 aa, Homo Sapiens
SSVPGVRLL

SEQ ID NO: 159406 - protein, 9 aa, Homo Sapiens
SSYDKPITF

SEQ ID NO: 159407 - protein, 9 aa, Homo Sapiens
SSYLFIVKY

SEQ ID NO: 159408 - protein, 9 aa, Homo Sapiens
SSYYNVTYW

SEQ ID NO: 159409 - protein, 9 aa, Homo Sapiens
STCEFVRTL

SEQ ID NO: 159410 - protein, 9 aa, Homo Sapiens
STFSGIKEL

SEQ ID NO: 159411 - protein, 9 aa, Homo Sapiens
STIDKVSVL

SEQ ID NO: 159412 - protein, 9 aa, Homo Sapiens
STILHLVVM

SEQ ID NO: 159413 - protein, 9 aa, Homo Sapiens
STKPPGTFL

SEQ ID NO: 159414 - protein, 9 aa, Homo Sapiens
STVHFIIFV

SEQ ID NO: 159415 - protein, 9 aa, Homo Sapiens
STYPAPFYV

SEQ ID NO: 159416 - protein, 9 aa, Homo Sapiens
SVADLAHVL

SEQ ID NO: 159417 - protein, 9 aa, Homo Sapiens
SVEDIFSEV

SEQ ID NO: 159418 - protein, 9 aa, Homo Sapiens
SVFGGLVNY

SEQ ID NO: 159419 - protein, 9 aa, Homo Sapiens
SVFPGARLL

SEQ ID NO: 159420 - protein, 9 aa, Homo Sapiens
SVIDHIHLI

SEQ ID NO: 159421 - protein, 9 aa, Homo Sapiens
SVISHLLRV

SEQ ID NO: 159422 - protein, 9 aa, Homo Sapiens
SVKWPNSVM

SEQ ID NO: 159423 - protein, 9 aa, Homo Sapiens
SVLPFQIYY

SEQ ID NO: 159424 - protein, 9 aa, Homo Sapiens
SVVSFLLRV

SEQ ID NO: 159425 - protein, 9 aa, Homo Sapiens
SVYSRVIQV

SEQ ID NO: 159426 - protein, 9 aa, Homo Sapiens
SVYSWDIVV

SEQ ID NO: 159427 - protein, 9 aa, Homo Sapiens
TAADIFKQY

SEQ ID NO: 159428 - protein, 9 aa, Homo Sapiens
TAADLGSVV

SEQ ID NO: 159429 - protein, 9 aa, Homo Sapiens
TAADTVIIY

SEQ ID NO: 159430 - protein, 9 aa, Homo Sapiens
TAADVVKQW

SEQ ID NO: 159431 - protein, 9 aa, Homo Sapiens
TAAFWTRLY

SEQ ID NO: 159432 - protein, 9 aa, Homo Sapiens
TAAGIHPQI

SEQ ID NO: 159433 - protein, 9 aa, Homo Sapiens
TAAPTIGVL

SEQ ID NO: 159434 - protein, 9 aa, Homo Sapiens
TAAVHIILV

SEQ ID NO: 159435 - protein, 9 aa, Homo Sapiens
TAFETIILL

SEQ ID NO: 159436 - protein, 9 aa, Homo Sapiens
TAFGGFLKY

SEQ ID NO: 159437 - protein, 9 aa, Homo Sapiens
TAFPEASFL

SEQ ID NO: 159438 - protein, 9 aa, Homo Sapiens
TAFPFQVEV

SEQ ID NO: 159439 - protein, 9 aa, Homo Sapiens
TAFPKPLLT

SEQ ID NO: 159440 - protein, 9 aa, Homo Sapiens
TAFQRPQLM

SEQ ID NO: 159441 - protein, 9 aa, Homo Sapiens
TAFSRLILI

SEQ ID NO: 159442 - protein, 9 aa, Homo Sapiens
TAFVEPFVI

SEQ ID NO: 159443 - protein, 9 aa, Homo Sapiens
TAFVEPLVI

SEQ ID NO: 159444 - protein, 9 aa, Homo Sapiens
TAHPSPLSV

SEQ ID NO: 159445 - protein, 9 aa, Homo Sapiens
TAIELIPSV

SEQ ID NO: 159446 - protein, 9 aa, Homo Sapiens
TAIGHINRY

SEQ ID NO: 159447 - protein, 9 aa, Homo Sapiens
TAMKKVFRV

SEQ ID NO: 159448 - protein, 9 aa, Homo Sapiens
TAQTLVRIL

SEQ ID NO: 159449 - protein, 9 aa, Homo Sapiens
TASDKILIV

SEQ ID NO: 159450 - protein, 9 aa, Homo Sapiens
TASEMILVL

SEQ ID NO: 159451 - protein, 9 aa, Homo Sapiens
TASKVIVAV

SEQ ID NO: 159452 - protein, 9 aa, Homo Sapiens
TASPLVKSV

SEQ ID NO: 159453 - protein, 9 aa, Homo Sapiens
TASPVAVSL

SEQ ID NO: 159454 - protein, 9 aa, Homo Sapiens
TASPVIKAV

SEQ ID NO: 159455 - protein, 9 aa, Homo Sapiens
TATALAIIY

SEQ ID NO: 159456 - protein, 9 aa, Homo Sapiens
TATMHILVV

SEQ ID NO: 159457 - protein, 9 aa, Homo Sapiens
TATPITIRY

SEQ ID NO: 159458 - protein, 9 aa, Homo Sapiens
TAVALLRLL

SEQ ID NO: 159459 - protein, 9 aa, Homo Sapiens
TAVFLTGVL

SEQ ID NO: 159460 - protein, 9 aa, Homo Sapiens
TAVKIAPRY

SEQ ID NO: 159461 - protein, 9 aa, Homo Sapiens
TAVRWVVTL

SEQ ID NO: 159462 - protein, 9 aa, Homo Sapiens
TAVWLPRYY

SEQ ID NO: 159463 - protein, 9 aa, Homo Sapiens
TAYAYATVL

SEQ ID NO: 159464 - protein, 9 aa, Homo Sapiens
TAYIHQVTV

SEQ ID NO: 159465 - protein, 9 aa, Homo Sapiens
TAYNLVHEL

SEQ ID NO: 159466 - protein, 9 aa, Homo Sapiens
TAYPGQTQY

SEQ ID NO: 159467 - protein, 9 aa, Homo Sapiens
TAYPQVVVV

SEQ ID NO: 159468 - protein, 9 aa, Homo Sapiens
TAYPSLRLI

SEQ ID NO: 159469 - protein, 9 aa, Homo Sapiens
TAYTRQQVL

SEQ ID NO: 159470 - protein, 9 aa, Homo Sapiens
TAYYRLLIT

SEQ ID NO: 159471 - protein, 9 aa, Homo Sapiens
TGFPWAFKV

SEQ ID NO: 159472 - protein, 9 aa, Homo Sapiens
TGTHLVLTV

SEQ ID NO: 159473 - protein, 9 aa, Homo Sapiens
TGYSEVIVV

SEQ ID NO: 159474 - protein, 9 aa, Homo Sapiens
TIKHWITII

SEQ ID NO: 159475 - protein, 9 aa, Homo Sapiens
TINGKIAVL

SEQ ID NO: 159476 - protein, 9 aa, Homo Sapiens
TIYPGLMIT

SEQ ID NO: 159477 - protein, 9 aa, Homo Sapiens
TLVDFIIIH

SEQ ID NO: 159478 - protein, 9 aa, Homo Sapiens
TLVHFVVTW

SEQ ID NO: 159479 - protein, 9 aa, Homo Sapiens
TMFVQRQVF

SEQ ID NO: 159480 - protein, 9 aa, Homo Sapiens
TMYPFIVTL

SEQ ID NO: 159481 - protein, 9 aa, Homo Sapiens
TQPTHSWKV

SEQ ID NO: 159482 - protein, 9 aa, Homo Sapiens
TSAAIYHVL

SEQ ID NO: 159483 - protein, 9 aa, Homo Sapiens
TSFPSPMEI

SEQ ID NO: 159484 - protein, 9 aa, Homo Sapiens
TSFPSPVSV

SEQ ID NO: 159485 - protein, 9 aa, Homo Sapiens
TSIGWLRLL

SEQ ID NO: 159486 - protein, 9 aa, Homo Sapiens
TSSPINIVV

SEQ ID NO: 159487 - protein, 9 aa, Homo Sapiens
TSSPSILTL

SEQ ID NO: 159488 - protein, 9 aa, Homo Sapiens
TSYPDPILL

SEQ ID NO: 159489 - protein, 9 aa, Homo Sapiens
TTFPRPVTV

SEQ ID NO: 159490 - protein, 9 aa, Homo Sapiens
TTIDIGVKY

SEQ ID NO: 159491 - protein, 9 aa, Homo Sapiens
TTSWIHPVM

SEQ ID NO: 159492 - protein, 9 aa, Homo Sapiens
TTVKFVVKM

SEQ ID NO: 159493 - protein, 9 aa, Homo Sapiens
TTVPFGVTY

SEQ ID NO: 159494 - protein, 9 aa, Homo Sapiens
TTVPGVIRY

SEQ ID NO: 159495 - protein, 9 aa, Homo Sapiens
TVPTFVLSI

SEQ ID NO: 159496 - protein, 9 aa, Homo Sapiens
TVSGRILVV

SEQ ID NO: 159497 - protein, 9 aa, Homo Sapiens
TVTTVILEV

SEQ ID NO: 159498 - protein, 9 aa, Homo Sapiens
TVVNFLIRV

SEQ ID NO: 159499 - protein, 9 aa, Homo Sapiens
TVYGGLMYI

SEQ ID NO: 159500 - protein, 9 aa, Homo Sapiens
TVYPVAIKY

SEQ ID NO: 159501 - protein, 9 aa, Homo Sapiens
TWINHFVIW

SEQ ID NO: 159502 - protein, 9 aa, Homo Sapiens
TWINHLVTW

SEQ ID NO: 159503 - protein, 9 aa, Homo Sapiens
VAADILNRL

SEQ ID NO: 159504 - protein, 9 aa, Homo Sapiens
VAAEAFSEL

SEQ ID NO: 159505 - protein, 9 aa, Homo Sapiens
VAAHLVIIM

SEQ ID NO: 159506 - protein, 9 aa, Homo Sapiens
VAANRVIIF

SEQ ID NO: 159507 - protein, 9 aa, Homo Sapiens
VAAPFRCEF

SEQ ID NO: 159508 - protein, 9 aa, Homo Sapiens
VAAPQVQQV

SEQ ID NO: 159509 - protein, 9 aa, Homo Sapiens
VAASLIQKM

SEQ ID NO: 159510 - protein, 9 aa, Homo Sapiens
VAASNIVQM

SEQ ID NO: 159511 - protein, 9 aa, Homo Sapiens
VAATLLKQL

SEQ ID NO: 159512 - protein, 9 aa, Homo Sapiens
VAFDAVLRF

SEQ ID NO: 159513 - protein, 9 aa, Homo Sapiens
VAFDVEIHM

SEQ ID NO: 159514 - protein, 9 aa, Homo Sapiens
VAFEMCSQL

SEQ ID NO: 159515 - protein, 9 aa, Homo Sapiens
VAFHIPFEV

SEQ ID NO: 159516 - protein, 9 aa, Homo Sapiens
VAFHTQLFF

SEQ ID NO: 159517 - protein, 9 aa, Homo Sapiens
VAFNQPVKL

SEQ ID NO: 159518 - protein, 9 aa, Homo Sapiens
VAFNWIIVH

SEQ ID NO: 159519 - protein, 9 aa, Homo Sapiens
VAFPKSLVA

SEQ ID NO: 159520 - protein, 9 aa, Homo Sapiens
VAFPSPAEL

SEQ ID NO: 159521 - protein, 9 aa, Homo Sapiens
VAFPSSSVY

SEQ ID NO: 159522 - protein, 9 aa, Homo Sapiens
VAFPTEIKV

SEQ ID NO: 159523 - protein, 9 aa, Homo Sapiens
VAFSEIMSM

SEQ ID NO: 159524 - protein, 9 aa, Homo Sapiens
VAFSPVTEL

SEQ ID NO: 159525 - protein, 9 aa, Homo Sapiens
VAFSQVLTI

SEQ ID NO: 159526 - protein, 9 aa, Homo Sapiens
VAFYIPMSV

SEQ ID NO: 159527 - protein, 9 aa, Homo Sapiens
VAHYPPVQV

SEQ ID NO: 159528 - protein, 9 aa, Homo Sapiens
VAIAAARVW

SEQ ID NO: 159529 - protein, 9 aa, Homo Sapiens
VAIAKVKLY

SEQ ID NO: 159530 - protein, 9 aa, Homo Sapiens
VAIEMLLKL

SEQ ID NO: 159531 - protein, 9 aa, Homo Sapiens
VAINHIVDF

SEQ ID NO: 159532 - protein, 9 aa, Homo Sapiens
VAINLIVQH

SEQ ID NO: 159533 - protein, 9 aa, Homo Sapiens
VAINRLLSM

SEQ ID NO: 159534 - protein, 9 aa, Homo Sapiens
VAIPSYICY

SEQ ID NO: 159535 - protein, 9 aa, Homo Sapiens
VAIPVSIFY

SEQ ID NO: 159536 - protein, 9 aa, Homo Sapiens
VAIQSVRCY

SEQ ID NO: 159537 - protein, 9 aa, Homo Sapiens
VAIVRPSIV

SEQ ID NO: 159538 - protein, 9 aa, Homo Sapiens
VAKIVAETM

SEQ ID NO: 159539 - protein, 9 aa, Homo Sapiens
VAKMYISEL

SEQ ID NO: 159540 - protein, 9 aa, Homo Sapiens
VAKPPVMSF

SEQ ID NO: 159541 - protein, 9 aa, Homo Sapiens
VAKWATVTF

SEQ ID NO: 159542 - protein, 9 aa, Homo Sapiens
VALDFEQEM

SEQ ID NO: 159543 - protein, 9 aa, Homo Sapiens
VALDKVIEI

SEQ ID NO: 159544 - protein, 9 aa, Homo Sapiens
VALLRVTPF

SEQ ID NO: 159545 - protein, 9 aa, Homo Sapiens
VALNFIISY

SEQ ID NO: 159546 - protein, 9 aa, Homo Sapiens
VALPMVLVL

SEQ ID NO: 159547 - protein, 9 aa, Homo Sapiens
VAMERVSVL

SEQ ID NO: 159548 - protein, 9 aa, Homo Sapiens
VAMGRVVKV

SEQ ID NO: 159549 - protein, 9 aa, Homo Sapiens
VAMKFAQVF

SEQ ID NO: 159550 - protein, 9 aa, Homo Sapiens
VANPNSAIF

SEQ ID NO: 159551 - protein, 9 aa, Homo Sapiens
VARDLRAEF

SEQ ID NO: 159552 - protein, 9 aa, Homo Sapiens
VARPDVVEM

SEQ ID NO: 159553 - protein, 9 aa, Homo Sapiens
VARSNILTL

SEQ ID NO: 159554 - protein, 9 aa, Homo Sapiens
VASAVFGVI

SEQ ID NO: 159555 - protein, 9 aa, Homo Sapiens
VASDLVMKV

SEQ ID NO: 159556 - protein, 9 aa, Homo Sapiens
VASEGIKRY

SEQ ID NO: 159557 - protein, 9 aa, Homo Sapiens
VASEIMAVL

SEQ ID NO: 159558 - protein, 9 aa, Homo Sapiens
VASGMILVM

SEQ ID NO: 159559 - protein, 9 aa, Homo Sapiens
VASNVPKVV

SEQ ID NO: 159560 - protein, 9 aa, Homo Sapiens
VASPFYLII

SEQ ID NO: 159561 - protein, 9 aa, Homo Sapiens
VASPQVHFI

SEQ ID NO: 159562 - protein, 9 aa, Homo Sapiens
VASQLPRIF

SEQ ID NO: 159563 - protein, 9 aa, Homo Sapiens
VATDFFTVL

SEQ ID NO: 159564 - protein, 9 aa, Homo Sapiens
VATFILQKI

SEQ ID NO: 159565 - protein, 9 aa, Homo Sapiens
VATSRIIKY

SEQ ID NO: 159566 - protein, 9 aa, Homo Sapiens
VAVCRIPVL

SEQ ID NO: 159567 - protein, 9 aa, Homo Sapiens
VAVDGLNQL

SEQ ID NO: 159568 - protein, 9 aa, Homo Sapiens
VAVEFIQEW

SEQ ID NO: 159569 - protein, 9 aa, Homo Sapiens
VAVGFPMMI

SEQ ID NO: 159570 - protein, 9 aa, Homo Sapiens
VAVGRALYY

SEQ ID NO: 159571 - protein, 9 aa, Homo Sapiens
VAVGVIKAV

SEQ ID NO: 159572 - protein, 9 aa, Homo Sapiens
VAVHLILYV

SEQ ID NO: 159573 - protein, 9 aa, Homo Sapiens
VAVNYIPEV

SEQ ID NO: 159574 - protein, 9 aa, Homo Sapiens
VAVPLGMTV

SEQ ID NO: 159575 - protein, 9 aa, Homo Sapiens
VAVPVAVTF

SEQ ID NO: 159576 - protein, 9 aa, Homo Sapiens
VAWDIPITY

SEQ ID NO: 159577 - protein, 9 aa, Homo Sapiens
VAYGKGTYF

SEQ ID NO: 159578 - protein, 9 aa, Homo Sapiens
VAYGQVLGV

SEQ ID NO: 159579 - protein, 9 aa, Homo Sapiens
VAYMNPIAM

SEQ ID NO: 159580 - protein, 9 aa, Homo Sapiens
VAYPCAILY

SEQ ID NO: 159581 - protein, 9 aa, Homo Sapiens
VAYPGIPKL

SEQ ID NO: 159582 - protein, 9 aa, Homo Sapiens
VAYPLYILY

SEQ ID NO: 159583 - protein, 9 aa, Homo Sapiens
VAYQHAFLY

SEQ ID NO: 159584 - protein, 9 aa, Homo Sapiens
VAYQKDRRW

SEQ ID NO: 159585 - protein, 9 aa, Homo Sapiens
VAYWDVLKA

SEQ ID NO: 159586 - protein, 9 aa, Homo Sapiens
VAYWRQAGL

SEQ ID NO: 159587 - protein, 9 aa, Homo Sapiens
VFYPYPQYF

SEQ ID NO: 159588 - protein, 9 aa, Homo Sapiens
VGFDAVMRV

SEQ ID NO: 159589 - protein, 9 aa, Homo Sapiens
VGFEEVIVV

SEQ ID NO: 159590 - protein, 9 aa, Homo Sapiens
VGIENIHVM

SEQ ID NO: 159591 - protein, 9 aa, Homo Sapiens
VGIPHIRWY

SEQ ID NO: 159592 - protein, 9 aa, Homo Sapiens
VGVDFALKV

SEQ ID NO: 159593 - protein, 9 aa, Homo Sapiens
VGYDGPIYM

SEQ ID NO: 159594 - protein, 9 aa, Homo Sapiens
VIGDVIRVY

SEQ ID NO: 159595 - protein, 9 aa, Homo Sapiens
VIPPFVFMV

SEQ ID NO: 159596 - protein, 9 aa, Homo Sapiens
VLFEHAVGY

SEQ ID NO: 159597 - protein, 9 aa, Homo Sapiens
VLFGKPMVV

SEQ ID NO: 159598 - protein, 9 aa, Homo Sapiens
VLFHNTIYY

SEQ ID NO: 159599 - protein, 9 aa, Homo Sapiens
VLFTQLIYY

SEQ ID NO: 159600 - protein, 9 aa, Homo Sapiens
VLVDHVVEF

SEQ ID NO: 159601 - protein, 9 aa, Homo Sapiens
VLYDRVLKY

SEQ ID NO: 159602 - protein, 9 aa, Homo Sapiens
VQIDITRVF

SEQ ID NO: 159603 - protein, 9 aa, Homo Sapiens
VQINVPITF

SEQ ID NO: 159604 - protein, 9 aa, Homo Sapiens
VSAAIVKEL

SEQ ID NO: 159605 - protein, 9 aa, Homo Sapiens
VSAENILTV

SEQ ID NO: 159606 - protein, 9 aa, Homo Sapiens
VSFPYVIAL

SEQ ID NO: 159607 - protein, 9 aa, Homo Sapiens
VSFQEVVTF

SEQ ID NO: 159608 - protein, 9 aa, Homo Sapiens
VSGDFVKVY

SEQ ID NO: 159609 - protein, 9 aa, Homo Sapiens
VSSHIASML

SEQ ID NO: 159610 - protein, 9 aa, Homo Sapiens
VSVPFPVTH

SEQ ID NO: 159611 - protein, 9 aa, Homo Sapiens
VSVPLIVRY

SEQ ID NO: 159612 - protein, 9 aa, Homo Sapiens
VSVQGIIIY

SEQ ID NO: 159613 - protein, 9 aa, Homo Sapiens
VSYGSIVTY

SEQ ID NO: 159614 - protein, 9 aa, Homo Sapiens
VSYSLPIVL

SEQ ID NO: 159615 - protein, 9 aa, Homo Sapiens
VTFPECVRW

SEQ ID NO: 159616 - protein, 9 aa, Homo Sapiens
VTFPGIKLI

SEQ ID NO: 159617 - protein, 9 aa, Homo Sapiens
VTFSGIHLL

SEQ ID NO: 159618 - protein, 9 aa, Homo Sapiens
VTIDRVMSY

SEQ ID NO: 159619 - protein, 9 aa, Homo Sapiens
VTIVKPIVY

SEQ ID NO: 159620 - protein, 9 aa, Homo Sapiens
VTKPNPSFM

SEQ ID NO: 159621 - protein, 9 aa, Homo Sapiens
VTSCIHNIL

SEQ ID NO: 159622 - protein, 9 aa, Homo Sapiens
VTSPVLVIH

SEQ ID NO: 159623 - protein, 9 aa, Homo Sapiens
VTVAFVQEY

SEQ ID NO: 159624 - protein, 9 aa, Homo Sapiens
VTYGFPIML

SEQ ID NO: 159625 - protein, 9 aa, Homo Sapiens
VTYNYPVHY

SEQ ID NO: 159626 - protein, 9 aa, Homo Sapiens
VTYPGELLL

SEQ ID NO: 159627 - protein, 9 aa, Homo Sapiens
VTYSFRQSF

SEQ ID NO: 159628 - protein, 9 aa, Homo Sapiens
VTYSHEVYF

SEQ ID NO: 159629 - protein, 9 aa, Homo Sapiens
VVKMPSGEF

SEQ ID NO: 159630 - protein, 9 aa, Homo Sapiens
VVKPPGSSL

SEQ ID NO: 159631 - protein, 9 aa, Homo Sapiens
VVPQFVVFY

SEQ ID NO: 159632 - protein, 9 aa, Homo Sapiens
VVYPILVEF

SEQ ID NO: 159633 - protein, 9 aa, Homo Sapiens
VVYPWTQRF

SEQ ID NO: 159634 - protein, 9 aa, Homo Sapiens
VWKLRIVSY

SEQ ID NO: 159635 - protein, 9 aa, Homo Sapiens
WAAPIRKLY

SEQ ID NO: 159636 - protein, 9 aa, Homo Sapiens
WAYARTINV

SEQ ID NO: 159637 - protein, 9 aa, Homo Sapiens
WAYPRQVFI

SEQ ID NO: 159638 - protein, 9 aa, Homo Sapiens
WGYPHPFLI

SEQ ID NO: 159639 - protein, 9 aa, Homo Sapiens
WSYPYEHSY

SEQ ID NO: 159640 - protein, 9 aa, Homo Sapiens
YAAAQLRQY

SEQ ID NO: 159641 - protein, 9 aa, Homo Sapiens
YAAELIERV

SEQ ID NO: 159642 - protein, 9 aa, Homo Sapiens
YAAGFIFTT

SEQ ID NO: 159643 - protein, 9 aa, Homo Sapiens
YAAGVHSVL

SEQ ID NO: 159644 - protein, 9 aa, Homo Sapiens
YAALHHRIL

SEQ ID NO: 159645 - protein, 9 aa, Homo Sapiens
YAANLKNVM

SEQ ID NO: 159646 - protein, 9 aa, Homo Sapiens
YAAPHFFHL

SEQ ID NO: 159647 - protein, 9 aa, Homo Sapiens
YAAPQLRSI

SEQ ID NO: 159648 - protein, 9 aa, Homo Sapiens
YAAPWFLTL

SEQ ID NO: 159649 - protein, 9 aa, Homo Sapiens
YAAVKIHQL

SEQ ID NO: 159650 - protein, 9 aa, Homo Sapiens
YAFAHILTV

SEQ ID NO: 159651 - protein, 9 aa, Homo Sapiens
YAFDFARQS

SEQ ID NO: 159652 - protein, 9 aa, Homo Sapiens
YAFDRVFQS

SEQ ID NO: 159653 - protein, 9 aa, Homo Sapiens
YAFGGGCEL

SEQ ID NO: 159654 - protein, 9 aa, Homo Sapiens
YAFGKFPTV

SEQ ID NO: 159655 - protein, 9 aa, Homo Sapiens
YAFLRREYY

SEQ ID NO: 159656 - protein, 9 aa, Homo Sapiens
YAFNGTQRF

SEQ ID NO: 159657 - protein, 9 aa, Homo Sapiens
YAFNMKATV

SEQ ID NO: 159658 - protein, 9 aa, Homo Sapiens
YAFPKAVSV

SEQ ID NO: 159659 - protein, 9 aa, Homo Sapiens
YAFPKAVTV

SEQ ID NO: 159660 - protein, 9 aa, Homo Sapiens
YAFPKEFPY

SEQ ID NO: 159661 - protein, 9 aa, Homo Sapiens
YAFPKSITV

SEQ ID NO: 159662 - protein, 9 aa, Homo Sapiens
YAFPLAHSL

SEQ ID NO: 159663 - protein, 9 aa, Homo Sapiens
YAFPRVRII

SEQ ID NO: 159664 - protein, 9 aa, Homo Sapiens
YAFPVSNNL

SEQ ID NO: 159665 - protein, 9 aa, Homo Sapiens
YAFPYIILV

SEQ ID NO: 159666 - protein, 9 aa, Homo Sapiens
YAFSGVEEL

SEQ ID NO: 159667 - protein, 9 aa, Homo Sapiens
YAFVRPVIL

SEQ ID NO: 159668 - protein, 9 aa, Homo Sapiens
YAHFPINVV

SEQ ID NO: 159669 - protein, 9 aa, Homo Sapiens
YAIDNPLHY

SEQ ID NO: 159670 - protein, 9 aa, Homo Sapiens
YAIDSVLEV

SEQ ID NO: 159671 - protein, 9 aa, Homo Sapiens
YAIEKVREI

SEQ ID NO: 159672 - protein, 9 aa, Homo Sapiens
YAIEVDPVL

SEQ ID NO: 159673 - protein, 9 aa, Homo Sapiens
YAIGLVMRL

SEQ ID NO: 159674 - protein, 9 aa, Homo Sapiens
YAIHKIAKM

SEQ ID NO: 159675 - protein, 9 aa, Homo Sapiens
YAIPMLQLL

SEQ ID NO: 159676 - protein, 9 aa, Homo Sapiens
YAISMARKI

SEQ ID NO: 159677 - protein, 9 aa, Homo Sapiens
YAITRVLRL

SEQ ID NO: 159678 - protein, 9 aa, Homo Sapiens
YAKDMLTSL

SEQ ID NO: 159679 - protein, 9 aa, Homo Sapiens
YAKEFLPFL

SEQ ID NO: 159680 - protein, 9 aa, Homo Sapiens
YAKIHIPII

SEQ ID NO: 159681 - protein, 9 aa, Homo Sapiens
YAKIVEIPF

SEQ ID NO: 159682 - protein, 9 aa, Homo Sapiens
YAKNNIPII

SEQ ID NO: 159683 - protein, 9 aa, Homo Sapiens
YAKPYFLRL

SEQ ID NO: 159684 - protein, 9 aa, Homo Sapiens
YAKRPGIGL

SEQ ID NO: 159685 - protein, 9 aa, Homo Sapiens
YALNRITVW

SEQ ID NO: 159686 - protein, 9 aa, Homo Sapiens
YAMDIVKGL

SEQ ID NO: 159687 - protein, 9 aa, Homo Sapiens
YAMRYFATV

SEQ ID NO: 159688 - protein, 9 aa, Homo Sapiens
YANYYTREV

SEQ ID NO: 159689 - protein, 9 aa, Homo Sapiens
YAPECLKEY

SEQ ID NO: 159690 - protein, 9 aa, Homo Sapiens
YAQLHSFTL

SEQ ID NO: 159691 - protein, 9 aa, Homo Sapiens
YARQLEMIV

SEQ ID NO: 159692 - protein, 9 aa, Homo Sapiens
YASDFHNVL

SEQ ID NO: 159693 - protein, 9 aa, Homo Sapiens
YASNITSVL

SEQ ID NO: 159694 - protein, 9 aa, Homo Sapiens
YASPVVAFY

SEQ ID NO: 159695 - protein, 9 aa, Homo Sapiens
YASQQIRQI

SEQ ID NO: 159696 - protein, 9 aa, Homo Sapiens
YASQYIARY

SEQ ID NO: 159697 - protein, 9 aa, Homo Sapiens
YASRFVQLV

SEQ ID NO: 159698 - protein, 9 aa, Homo Sapiens
YASSKLLKI

SEQ ID NO: 159699 - protein, 9 aa, Homo Sapiens
YASTIVSAL

SEQ ID NO: 159700 - protein, 9 aa, Homo Sapiens
YATASLRKL

SEQ ID NO: 159701 - protein, 9 aa, Homo Sapiens
YATDLVVCV

SEQ ID NO: 159702 - protein, 9 aa, Homo Sapiens
YATEKLRMI

SEQ ID NO: 159703 - protein, 9 aa, Homo Sapiens
YATFIVTNY

SEQ ID NO: 159704 - protein, 9 aa, Homo Sapiens
YATIILSKM

SEQ ID NO: 159705 - protein, 9 aa, Homo Sapiens
YATKHLRVL

SEQ ID NO: 159706 - protein, 9 aa, Homo Sapiens
YATTVIPRV

SEQ ID NO: 159707 - protein, 9 aa, Homo Sapiens
YAVDRAITH

SEQ ID NO: 159708 - protein, 9 aa, Homo Sapiens
YAVNSQFTM

SEQ ID NO: 159709 - protein, 9 aa, Homo Sapiens
YAYAAQNLL

SEQ ID NO: 159710 - protein, 9 aa, Homo Sapiens
YAYDAKIEI

SEQ ID NO: 159711 - protein, 9 aa, Homo Sapiens
YAYEKPHVV

SEQ ID NO: 159712 - protein, 9 aa, Homo Sapiens
YAYEWQRCL

SEQ ID NO: 159713 - protein, 9 aa, Homo Sapiens
YAYLKAIVL

SEQ ID NO: 159714 - protein, 9 aa, Homo Sapiens
YAYLYIRML

SEQ ID NO: 159715 - protein, 9 aa, Homo Sapiens
YAYPGVLLI

SEQ ID NO: 159716 - protein, 9 aa, Homo Sapiens
YAYPYSYYY

SEQ ID NO: 159717 - protein, 9 aa, Homo Sapiens
YAYRDAVFL

SEQ ID NO: 159718 - protein, 9 aa, Homo Sapiens
YAYTAQLKA

SEQ ID NO: 159719 - protein, 9 aa, Homo Sapiens
YAYTGRLEL

SEQ ID NO: 159720 - protein, 9 aa, Homo Sapiens
YAYTSQIEI

SEQ ID NO: 159721 - protein, 9 aa, Homo Sapiens
YAYTSRVIL

SEQ ID NO: 159722 - protein, 9 aa, Homo Sapiens
YFHCTLIGY

SEQ ID NO: 159723 - protein, 9 aa, Homo Sapiens
YFVPLVKRL

SEQ ID NO: 159724 - protein, 9 aa, Homo Sapiens
YGAEIVRRY

SEQ ID NO: 159725 - protein, 9 aa, Homo Sapiens
YGAEVISVL

SEQ ID NO: 159726 - protein, 9 aa, Homo Sapiens
YGFLHVIVH

SEQ ID NO: 159727 - protein, 9 aa, Homo Sapiens
YGIDTIRLY

SEQ ID NO: 159728 - protein, 9 aa, Homo Sapiens
YGLTFTEKW

SEQ ID NO: 159729 - protein, 9 aa, Homo Sapiens
YGMERVWCV

SEQ ID NO: 159730 - protein, 9 aa, Homo Sapiens
YGSPNALVL

SEQ ID NO: 159731 - protein, 9 aa, Homo Sapiens
YGYDNVKEY

SEQ ID NO: 159732 - protein, 9 aa, Homo Sapiens
YGYEHILTL

SEQ ID NO: 159733 - protein, 9 aa, Homo Sapiens
YGYGIRYEY

SEQ ID NO: 159734 - protein, 9 aa, Homo Sapiens
YGYNQRPPY

SEQ ID NO: 159735 - protein, 9 aa, Homo Sapiens
YGYSNPKIL

SEQ ID NO: 159736 - protein, 9 aa, Homo Sapiens
YGYYRTVIF

SEQ ID NO: 159737 - protein, 9 aa, Homo Sapiens
YIATIHSRL

SEQ ID NO: 159738 - protein, 9 aa, Homo Sapiens
YIFEEPFTI

SEQ ID NO: 159739 - protein, 9 aa, Homo Sapiens
YIFTTPKSV

SEQ ID NO: 159740 - protein, 9 aa, Homo Sapiens
YIIDTTGKL

SEQ ID NO: 159741 - protein, 9 aa, Homo Sapiens
YIIKDKHIL

SEQ ID NO: 159742 - protein, 9 aa, Homo Sapiens
YIKDFFEQM

SEQ ID NO: 159743 - protein, 9 aa, Homo Sapiens
YIPDFLTLL

SEQ ID NO: 159744 - protein, 9 aa, Homo Sapiens
YITGHVLVV

SEQ ID NO: 159745 - protein, 9 aa, Homo Sapiens
YIVDHTIIM

SEQ ID NO: 159746 - protein, 9 aa, Homo Sapiens
YLADIFTKL

SEQ ID NO: 159747 - protein, 9 aa, Homo Sapiens
YLADLYHFV

SEQ ID NO: 159748 - protein, 9 aa, Homo Sapiens
YLAPHVRTL

SEQ ID NO: 159749 - protein, 9 aa, Homo Sapiens
YLFEWRTQY

SEQ ID NO: 159750 - protein, 9 aa, Homo Sapiens
YLIKYIAIV

SEQ ID NO: 159751 - protein, 9 aa, Homo Sapiens
YLIPIVVRY

SEQ ID NO: 159752 - protein, 9 aa, Homo Sapiens
YLITHPLAV

SEQ ID NO: 159753 - protein, 9 aa, Homo Sapiens
YLKDFFSNV

SEQ ID NO: 159754 - protein, 9 aa, Homo Sapiens
YLKEFIHIL

SEQ ID NO: 159755 - protein, 9 aa, Homo Sapiens
YLSMVFSIV

SEQ ID NO: 159756 - protein, 9 aa, Homo Sapiens
YMISIVHIY

SEQ ID NO: 159757 - protein, 9 aa, Homo Sapiens
YMVTIVHIY

SEQ ID NO: 159758 - protein, 9 aa, Homo Sapiens
YNFEKPVVM

SEQ ID NO: 159759 - protein, 9 aa, Homo Sapiens
YNFEYSVVF

SEQ ID NO: 159760 - protein, 9 aa, Homo Sapiens
YNYIRIMVM

SEQ ID NO: 159761 - protein, 9 aa, Homo Sapiens
YQADIERMY

SEQ ID NO: 159762 - protein, 9 aa, Homo Sapiens
YQFTGIKKY

SEQ ID NO: 159763 - protein, 9 aa, Homo Sapiens
YQITSVIQY

SEQ ID NO: 159764 - protein, 9 aa, Homo Sapiens
YQKPFQTLM

SEQ ID NO: 159765 - protein, 9 aa, Homo Sapiens
YQTDLVNIM

SEQ ID NO: 159766 - protein, 9 aa, Homo Sapiens
YQYPRPLLI

SEQ ID NO: 159767 - protein, 9 aa, Homo Sapiens
YQYPVIIHL

SEQ ID NO: 159768 - protein, 9 aa, Homo Sapiens
YSADGHSIL

SEQ ID NO: 159769 - protein, 9 aa, Homo Sapiens
YSAPVIHVL

SEQ ID NO: 159770 - protein, 9 aa, Homo Sapiens
YSFDYPSDM

SEQ ID NO: 159771 - protein, 9 aa, Homo Sapiens
YSFGGCHRY

SEQ ID NO: 159772 - protein, 9 aa, Homo Sapiens
YSFHKFHYL

SEQ ID NO: 159773 - protein, 9 aa, Homo Sapiens
YSFYLPIAA

SEQ ID NO: 159774 - protein, 9 aa, Homo Sapiens
YSHPHVRLL

SEQ ID NO: 159775 - protein, 9 aa, Homo Sapiens
YSINWTQKL

SEQ ID NO: 159776 - protein, 9 aa, Homo Sapiens
YSISERLEM

SEQ ID NO: 159777 - protein, 9 aa, Homo Sapiens
YSKEGWEYV

SEQ ID NO: 159778 - protein, 9 aa, Homo Sapiens
YSKLPGVSL

SEQ ID NO: 159779 - protein, 9 aa, Homo Sapiens
YSLEHTVQF

SEQ ID NO: 159780 - protein, 9 aa, Homo Sapiens
YSMYREFWA

SEQ ID NO: 159781 - protein, 9 aa, Homo Sapiens
YSSGLVRLY

SEQ ID NO: 159782 - protein, 9 aa, Homo Sapiens
YSSPEILRV

SEQ ID NO: 159783 - protein, 9 aa, Homo Sapiens
YSSPLFRSL

SEQ ID NO: 159784 - protein, 9 aa, Homo Sapiens
YSVPFYPTF

SEQ ID NO: 159785 - protein, 9 aa, Homo Sapiens
YSYFSPRTM

SEQ ID NO: 159786 - protein, 9 aa, Homo Sapiens
YSYIDAVCY

SEQ ID NO: 159787 - protein, 9 aa, Homo Sapiens
YSYNIRHSF

SEQ ID NO: 159788 - protein, 9 aa, Homo Sapiens
YSYPELVKM

SEQ ID NO: 159789 - protein, 9 aa, Homo Sapiens
YSYPETPLY

SEQ ID NO: 159790 - protein, 9 aa, Homo Sapiens
YSYPSPITA

SEQ ID NO: 159791 - protein, 9 aa, Homo Sapiens
YTFGRIVIY

SEQ ID NO: 159792 - protein, 9 aa, Homo Sapiens
YTFNKVLML

SEQ ID NO: 159793 - protein, 9 aa, Homo Sapiens
YTFPAGVSV

SEQ ID NO: 159794 - protein, 9 aa, Homo Sapiens
YTFPFQQLM

SEQ ID NO: 159795 - protein, 9 aa, Homo Sapiens
YTFSEPFHL

SEQ ID NO: 159796 - protein, 9 aa, Homo Sapiens
YTHEVVTLW

SEQ ID NO: 159797 - protein, 9 aa, Homo Sapiens
YTIEFLRHL

SEQ ID NO: 159798 - protein, 9 aa, Homo Sapiens
YTIENPRHF

SEQ ID NO: 159799 - protein, 9 aa, Homo Sapiens
YTIGGVKIY

SEQ ID NO: 159800 - protein, 9 aa, Homo Sapiens
YTIPLAIKL

SEQ ID NO: 159801 - protein, 9 aa, Homo Sapiens
YTKNYLPLL

SEQ ID NO: 159802 - protein, 9 aa, Homo Sapiens
YTMPNFRQY

SEQ ID NO: 159803 - protein, 9 aa, Homo Sapiens
YTPDWIFLL

SEQ ID NO: 159804 - protein, 9 aa, Homo Sapiens
YTSGDVRVW

SEQ ID NO: 159805 - protein, 9 aa, Homo Sapiens
YTSPDFLYV

SEQ ID NO: 159806 - protein, 9 aa, Homo Sapiens
YTTDFIYQL

SEQ ID NO: 159807 - protein, 9 aa, Homo Sapiens
YTTDRVMTV

SEQ ID NO: 159808 - protein, 9 aa, Homo Sapiens
YTYEKLLWT

SEQ ID NO: 159809 - protein, 9 aa, Homo Sapiens
YTYLRINFY

SEQ ID NO: 159810 - protein, 9 aa, Homo Sapiens
YTYPWVYNY

SEQ ID NO: 159811 - protein, 9 aa, Homo Sapiens
YTYYYPHYL

SEQ ID NO: 159812 - protein, 9 aa, Homo Sapiens
YVAELIQQL

SEQ ID NO: 159813 - protein, 9 aa, Homo Sapiens
YVFPGVTRL

SEQ ID NO: 159814 - protein, 9 aa, Homo Sapiens
YVGPAKVIV

SEQ ID NO: 159815 - protein, 9 aa, Homo Sapiens
YVIELQHVV

SEQ ID NO: 159816 - protein, 9 aa, Homo Sapiens
YVLAFWALL

SEQ ID NO: 159817 - protein, 9 aa, Homo Sapiens
YVPDIVRCV

SEQ ID NO: 159818 - protein, 9 aa, Homo Sapiens
YVSPRILTA

SEQ ID NO: 159819 - protein, 9 aa, Homo Sapiens
YVTSLLKMY

SEQ ID NO: 159820 - protein, 9 aa, Homo Sapiens
YVTTSTRTY

SEQ ID NO: 159821 - protein, 9 aa, Homo Sapiens
YVVPFVAKV

SEQ ID NO: 159822 - protein, 9 aa, Homo Sapiens
YVYEYLLHI

SEQ ID NO: 159823 - protein, 9 aa, Homo Sapiens
YVYEYLLHV

SEQ ID NO: 159824 - protein, 9 aa, Homo Sapiens
YVYMFLVKW

SEQ ID NO: 159825 - protein, 9 aa, Homo Sapiens
YVYPKYLKY

SEQ ID NO: 159826 - protein, 9 aa, Homo Sapiens
YWIHWVRQM

SEQ ID NO: 159827 - protein, 10 aa, Homo Sapiens
AAAGFLLQVL

SEQ ID NO: 159828 - protein, 10 aa, Homo Sapiens
AAAPQLLIVL

SEQ ID NO: 159829 - protein, 10 aa, Homo Sapiens
AAFGGHPQCL

SEQ ID NO: 159830 - protein, 10 aa, Homo Sapiens
AAFGGNPKSV

SEQ ID NO: 159831 - protein, 10 aa, Homo Sapiens
AAFIPTGSVL

SEQ ID NO: 159832 - protein, 10 aa, Homo Sapiens
AAFPGASLYL

SEQ ID NO: 159833 - protein, 10 aa, Homo Sapiens
AAFTADPLSL

SEQ ID NO: 159834 - protein, 10 aa, Homo Sapiens
AAIGLVIYYL

SEQ ID NO: 159835 - protein, 10 aa, Homo Sapiens
AAVHIILVIN

SEQ ID NO: 159836 - protein, 10 aa, Homo Sapiens
AAYIYIRGEF

SEQ ID NO: 159837 - protein, 10 aa, Homo Sapiens
ALIEFIRSEY

SEQ ID NO: 159838 - protein, 10 aa, Homo Sapiens
ASFDGRISVY

SEQ ID NO: 159839 - protein, 10 aa, Homo Sapiens
ASYSGLMRIE

SEQ ID NO: 159840 - protein, 10 aa, Homo Sapiens
CAYDRIVVAG

SEQ ID NO: 159841 - protein, 10 aa, Homo Sapiens
CSFSGYKIYP

SEQ ID NO: 159842 - protein, 10 aa, Homo Sapiens
FAADIPRILV

SEQ ID NO: 159843 - protein, 10 aa, Homo Sapiens
FAFESDLHSL

SEQ ID NO: 159844 - protein, 10 aa, Homo Sapiens
FAFNRKRNVL

SEQ ID NO: 159845 - protein, 10 aa, Homo Sapiens
FAFQAEIAQL

SEQ ID NO: 159846 - protein, 10 aa, Homo Sapiens
FAFRGCPHVL

SEQ ID NO: 159847 - protein, 10 aa, Homo Sapiens
FAFSPDGRHL

SEQ ID NO: 159848 - protein, 10 aa, Homo Sapiens
FAGLVQEISF

SEQ ID NO: 159849 - protein, 10 aa, Homo Sapiens
FAIGGIARTY

SEQ ID NO: 159850 - protein, 10 aa, Homo Sapiens
FAKCTGMIIL

SEQ ID NO: 159851 - protein, 10 aa, Homo Sapiens
FAKGMSPAVL

SEQ ID NO: 159852 - protein, 10 aa, Homo Sapiens
FAKTFVGTPY

SEQ ID NO: 159853 - protein, 10 aa, Homo Sapiens
FANDLKPKVY

SEQ ID NO: 159854 - protein, 10 aa, Homo Sapiens
FARYPNGVVV

SEQ ID NO: 159855 - protein, 10 aa, Homo Sapiens
FASGLIHRVC

SEQ ID NO: 159856 - protein, 10 aa, Homo Sapiens
FASKLVLKAL

SEQ ID NO: 159857 - protein, 10 aa, Homo Sapiens
FASYMEQHLM

SEQ ID NO: 159858 - protein, 10 aa, Homo Sapiens
FAWEPNGSKF

SEQ ID NO: 159859 - protein, 10 aa, Homo Sapiens
FAYPAIRYLL

SEQ ID NO: 159860 - protein, 10 aa, Homo Sapiens
FAYPNRPDVL

SEQ ID NO: 159861 - protein, 10 aa, Homo Sapiens
FFLDHVRTSF

SEQ ID NO: 159862 - protein, 10 aa, Homo Sapiens
FLFDGSPTYV

SEQ ID NO: 159863 - protein, 10 aa, Homo Sapiens
FLFDKVVIVC

SEQ ID NO: 159864 - protein, 10 aa, Homo Sapiens
FLYPFPLALF

SEQ ID NO: 159865 - protein, 10 aa, Homo Sapiens
FQNPQTHVIE

SEQ ID NO: 159866 - protein, 10 aa, Homo Sapiens
FSFEGPEKVH

SEQ ID NO: 159867 - protein, 10 aa, Homo Sapiens
FSFGGKLVTF

SEQ ID NO: 159868 - protein, 10 aa, Homo Sapiens
FSNDIPHVVR

SEQ ID NO: 159869 - protein, 10 aa, Homo Sapiens
FTFDQDPSVL

SEQ ID NO: 159870 - protein, 10 aa, Homo Sapiens
FTPFVDPRVY

SEQ ID NO: 159871 - protein, 10 aa, Homo Sapiens
FVAPFPLSIW

SEQ ID NO: 159872 - protein, 10 aa, Homo Sapiens
FVHPDPLWIP

SEQ ID NO: 159873 - protein, 10 aa, Homo Sapiens
FVVDHVIKIT

SEQ ID NO: 159874 - protein, 10 aa, Homo Sapiens
FVYPEESLVI

SEQ ID NO: 159875 - protein, 10 aa, Homo Sapiens
FVYPGNPLRH

SEQ ID NO: 159876 - protein, 10 aa, Homo Sapiens
GGEVLSHSLL

SEQ ID NO: 159877 - protein, 10 aa, Homo Sapiens
GPPPPPGKPQ

SEQ ID NO: 159878 - protein, 10 aa, Homo Sapiens
HAAPFQNILP

SEQ ID NO: 159879 - protein, 10 aa, Homo Sapiens
HAFDGRPSVA

SEQ ID NO: 159880 - protein, 10 aa, Homo Sapiens
HQSGIVQLLW

SEQ ID NO: 159881 - protein, 10 aa, Homo Sapiens
IAGPVLLILV

SEQ ID NO: 159882 - protein, 10 aa, Homo Sapiens
IAGPVVEISH

SEQ ID NO: 159883 - protein, 10 aa, Homo Sapiens
IAVDPRHLSL

SEQ ID NO: 159884 - protein, 10 aa, Homo Sapiens
IIPSWPLKVL

SEQ ID NO: 159885 - protein, 10 aa, Homo Sapiens
ISSHIPLIIQ

SEQ ID NO: 159886 - protein, 10 aa, Homo Sapiens
KAFPFHIIFD

SEQ ID NO: 159887 - protein, 10 aa, Homo Sapiens
KAFQKIVVLF

SEQ ID NO: 159888 - protein, 10 aa, Homo Sapiens
KAKWPDRITL

SEQ ID NO: 159889 - protein, 10 aa, Homo Sapiens
KAVDIVKQVW

SEQ ID NO: 159890 - protein, 10 aa, Homo Sapiens
KAVGWRLIAL

SEQ ID NO: 159891 - protein, 10 aa, Homo Sapiens
KSFEGNVFMY

SEQ ID NO: 159892 - protein, 10 aa, Homo Sapiens
KTPDFILQVP

SEQ ID NO: 159893 - protein, 10 aa, Homo Sapiens
LAFDPSGQRL

SEQ ID NO: 159894 - protein, 10 aa, Homo Sapiens
LAFSNDGTTL

SEQ ID NO: 159895 - protein, 10 aa, Homo Sapiens
LLYPFAPLIL

SEQ ID NO: 159896 - protein, 10 aa, Homo Sapiens
LMAFLLPLII

SEQ ID NO: 159897 - protein, 10 aa, Homo Sapiens
LSFPTTKTYF

SEQ ID NO: 159898 - protein, 10 aa, Homo Sapiens
LSSFVGGLSV

SEQ ID NO: 159899 - protein, 10 aa, Homo Sapiens
MAFDPTSTLL

SEQ ID NO: 159900 - protein, 10 aa, Homo Sapiens
MAFLLPLIIV

SEQ ID NO: 159901 - protein, 10 aa, Homo Sapiens
MATPLLMQAL

SEQ ID NO: 159902 - protein, 10 aa, Homo Sapiens
MAVEFPLVLY

SEQ ID NO: 159903 - protein, 10 aa, Homo Sapiens
MAYGASFLSF

SEQ ID NO: 159904 - protein, 10 aa, Homo Sapiens
MIAEPAHFYL

SEQ ID NO: 159905 - protein, 10 aa, Homo Sapiens
MSVDPDRMVI

SEQ ID NO: 159906 - protein, 10 aa, Homo Sapiens
MSYEQLMQLY

SEQ ID NO: 159907 - protein, 10 aa, Homo Sapiens
NAGPAIVISF

SEQ ID NO: 159908 - protein, 10 aa, Homo Sapiens
NAIDKLFVLF

SEQ ID NO: 159909 - protein, 10 aa, Homo Sapiens
NIKAPGEQTV

SEQ ID NO: 159910 - protein, 10 aa, Homo Sapiens
QSFPEPLIIP

SEQ ID NO: 159911 - protein, 10 aa, Homo Sapiens
RAFGIPIRVY

SEQ ID NO: 159912 - protein, 10 aa, Homo Sapiens
RAPDNIIKFY

SEQ ID NO: 159913 - protein, 10 aa, Homo Sapiens
RAYPAAITIL

SEQ ID NO: 159914 - protein, 10 aa, Homo Sapiens
RQIGVEHVVV

SEQ ID NO: 159915 - protein, 10 aa, Homo Sapiens
RTVDLFPVLP

SEQ ID NO: 159916 - protein, 10 aa, Homo Sapiens
RTVDWALAEY

SEQ ID NO: 159917 - protein, 10 aa, Homo Sapiens
SAFDRKVQFL

SEQ ID NO: 159918 - protein, 10 aa, Homo Sapiens
SAFEKPQIIA

SEQ ID NO: 159919 - protein, 10 aa, Homo Sapiens
SAPGYLPTSL

SEQ ID NO: 159920 - protein, 10 aa, Homo Sapiens
SAVDFIRTLL

SEQ ID NO: 159921 - protein, 10 aa, Homo Sapiens
SAVNIIRTFL

SEQ ID NO: 159922 - protein, 10 aa, Homo Sapiens
SAVPFLILVA

SEQ ID NO: 159923 - protein, 10 aa, Homo Sapiens
SAYPLSVEWL

SEQ ID NO: 159924 - protein, 10 aa, Homo Sapiens
SDESLIACKA

SEQ ID NO: 159925 - protein, 10 aa, Homo Sapiens
SFFENPILSF

SEQ ID NO: 159926 - protein, 10 aa, Homo Sapiens
SSFDGIIAMM

SEQ ID NO: 159927 - protein, 10 aa, Homo Sapiens
TAFHGCMELL

SEQ ID NO: 159928 - protein, 10 aa, Homo Sapiens
TAFSRLILIL

SEQ ID NO: 159929 - protein, 10 aa, Homo Sapiens
TAYPNRPMVL

SEQ ID NO: 159930 - protein, 10 aa, Homo Sapiens
TGYAVWLVLW

SEQ ID NO: 159931 - protein, 10 aa, Homo Sapiens
VAFDGDAVLF

SEQ ID NO: 159932 - protein, 10 aa, Homo Sapiens
VAHEFGAITF

SEQ ID NO: 159933 - protein, 10 aa, Homo Sapiens
VAKLIQCIVF

SEQ ID NO: 159934 - protein, 10 aa, Homo Sapiens
VAMNPTNTVF

SEQ ID NO: 159935 - protein, 10 aa, Homo Sapiens
VAVGFPMMIL

SEQ ID NO: 159936 - protein, 10 aa, Homo Sapiens
VAYEGLPLHL

SEQ ID NO: 159937 - protein, 10 aa, Homo Sapiens
VFDGPAAQPS

SEQ ID NO: 159938 - protein, 10 aa, Homo Sapiens
VSQDPRHMVL

SEQ ID NO: 159939 - protein, 10 aa, Homo Sapiens
VSWTGKPVSY

SEQ ID NO: 159940 - protein, 10 aa, Homo Sapiens
VTFPGIKLIY

SEQ ID NO: 159941 - protein, 10 aa, Homo Sapiens
VTYNYPVHYF

SEQ ID NO: 159942 - protein, 10 aa, Homo Sapiens
YAFAHILTVL

SEQ ID NO: 159943 - protein, 10 aa, Homo Sapiens
YAFDLKCDSV

SEQ ID NO: 159944 - protein, 10 aa, Homo Sapiens
YAFEYLIETL

SEQ ID NO: 159945 - protein, 10 aa, Homo Sapiens
YAFNGTQRFL

SEQ ID NO: 159946 - protein, 10 aa, Homo Sapiens
YAFPKAVSVF

SEQ ID NO: 159947 - protein, 10 aa, Homo Sapiens
YAFPKAVTVF

SEQ ID NO: 159948 - protein, 10 aa, Homo Sapiens
YAFPKSITVF

SEQ ID NO: 159949 - protein, 10 aa, Homo Sapiens
YAFPYIILVL

SEQ ID NO: 159950 - protein, 10 aa, Homo Sapiens
YATTVIPRVY

SEQ ID NO: 159951 - protein, 10 aa, Homo Sapiens
YAVDRAITHL

SEQ ID NO: 159952 - protein, 10 aa, Homo Sapiens
YAVGWGPITW

SEQ ID NO: 159953 - protein, 10 aa, Homo Sapiens
YAYDGKDYIA

SEQ ID NO: 159954 - protein, 10 aa, Homo Sapiens
YAYEKPHVVC

SEQ ID NO: 159955 - protein, 10 aa, Homo Sapiens
YAYLKAIVLF

SEQ ID NO: 159956 - protein, 10 aa, Homo Sapiens
YFIPFLPLEY

SEQ ID NO: 159957 - protein, 10 aa, Homo Sapiens
YGYDNVKEYL

SEQ ID NO: 159958 - protein, 10 aa, Homo Sapiens
YIFEEPFTIR

SEQ ID NO: 159959 - protein, 10 aa, Homo Sapiens
YMIDPSGVSY

SEQ ID NO: 159960 - protein, 10 aa, Homo Sapiens
YMILGQNGFF

SEQ ID NO: 159961 - protein, 10 aa, Homo Sapiens
YQFTGIKKYF

SEQ ID NO: 159962 - protein, 10 aa, Homo Sapiens
YTFDQKIVEW

SEQ ID NO: 159963 - protein, 10 aa, Homo Sapiens
YTFGRIVIYI

SEQ ID NO: 159964 - protein, 10 aa, Homo Sapiens
YVFDGKPPQL

SEQ ID NO: 159965 - protein, 11 aa, Homo Sapiens
AAAPQLLIVLL

SEQ ID NO: 159966 - protein, 11 aa, Homo Sapiens
AAFFVRKKSSL

SEQ ID NO: 159967 - protein, 11 aa, Homo Sapiens
AAFGAPGIISA

SEQ ID NO: 159968 - protein, 11 aa, Homo Sapiens
AAFSHTQVIEL

SEQ ID NO: 159969 - protein, 11 aa, Homo Sapiens
AAFTADPLSLL

SEQ ID NO: 159970 - protein, 11 aa, Homo Sapiens
AAIDHQIEVLL

SEQ ID NO: 159971 - protein, 11 aa, Homo Sapiens
AAINPELLQLL

SEQ ID NO: 159972 - protein, 11 aa, Homo Sapiens
AAYGELRAMVL

SEQ ID NO: 159973 - protein, 11 aa, Homo Sapiens
AAYYPSDVSSL

SEQ ID NO: 159974 - protein, 11 aa, Homo Sapiens
ASEQILLATAH

SEQ ID NO: 159975 - protein, 11 aa, Homo Sapiens
ATIDPDTISAL

SEQ ID NO: 159976 - protein, 11 aa, Homo Sapiens
CAFPYSLLIFV

SEQ ID NO: 159977 - protein, 11 aa, Homo Sapiens
FAHFPGLASEL

SEQ ID NO: 159978 - protein, 11 aa, Homo Sapiens
FAHNSNWYITF

SEQ ID NO: 159979 - protein, 11 aa, Homo Sapiens
FAKPVYPGQTL

SEQ ID NO: 159980 - protein, 11 aa, Homo Sapiens
FASSHTPRITF

SEQ ID NO: 159981 - protein, 11 aa, Homo Sapiens
FASTILHLVVM

SEQ ID NO: 159982 - protein, 11 aa, Homo Sapiens
FAVDPEKIQLY

SEQ ID NO: 159983 - protein, 11 aa, Homo Sapiens
FAYDGKDYLTL

SEQ ID NO: 159984 - protein, 11 aa, Homo Sapiens
FAYDPSNYEYL

SEQ ID NO: 159985 - protein, 11 aa, Homo Sapiens
FAYPAIRYLLY

SEQ ID NO: 159986 - protein, 11 aa, Homo Sapiens
FQNPQTHVIEN

SEQ ID NO: 159987 - protein, 11 aa, Homo Sapiens
FSFPHKFEISF

SEQ ID NO: 159988 - protein, 11 aa, Homo Sapiens
FSNDIPHVVRF

SEQ ID NO: 159989 - protein, 11 aa, Homo Sapiens
GHQQLYWSHPR

SEQ ID NO: 159990 - protein, 11 aa, Homo Sapiens
GIHETTFNSIM

SEQ ID NO: 159991 - protein, 11 aa, Homo Sapiens
GPPPPPPGKPQ

SEQ ID NO: 159992 - protein, 11 aa, Homo Sapiens
HAANIVTAIYI

SEQ ID NO: 159993 - protein, 11 aa, Homo Sapiens
HACGVIATIAF

SEQ ID NO: 159994 - protein, 11 aa, Homo Sapiens
HAFDSLSGISL

SEQ ID NO: 159995 - protein, 11 aa, Homo Sapiens
HAFSFPLLIML

SEQ ID NO: 159996 - protein, 11 aa, Homo Sapiens
HAYDGKDYISL

SEQ ID NO: 159997 - protein, 11 aa, Homo Sapiens
IAGPVLLILVH

SEQ ID NO: 159998 - protein, 11 aa, Homo Sapiens
ISSHIPLIIQF

SEQ ID NO: 159999 - protein, 11 aa, Homo Sapiens
ISSPLTKSISL

SEQ ID NO: 160000 - protein, 11 aa, Homo Sapiens
KAFENLLGQAL

SEQ ID NO: 160001 - protein, 11 aa, Homo Sapiens
KAFQKIVVLFY

SEQ ID NO: 160002 - protein, 11 aa, Homo Sapiens
KAVGHPFVIQL

SEQ ID NO: 160003 - protein, 11 aa, Homo Sapiens
LSFPTTKTYFP

SEQ ID NO: 160004 - protein, 11 aa, Homo Sapiens
LSSDLIKIIYV

SEQ ID NO: 160005 - protein, 11 aa, Homo Sapiens
LVAQIAAGMEY

SEQ ID NO: 160006 - protein, 11 aa, Homo Sapiens
MAFLLPLIIVL

SEQ ID NO: 160007 - protein, 11 aa, Homo Sapiens
MAPSETQFSHL

SEQ ID NO: 160008 - protein, 11 aa, Homo Sapiens
MLPDHVSIILL

SEQ ID NO: 160009 - protein, 11 aa, Homo Sapiens
NAVDAARLHYM

SEQ ID NO: 160010 - protein, 11 aa, Homo Sapiens
QAIDPKNLSRL

SEQ ID NO: 160011 - protein, 11 aa, Homo Sapiens
RAFEVSENGNL

SEQ ID NO: 160012 - protein, 11 aa, Homo Sapiens
RAFGGILVVVY

SEQ ID NO: 160013 - protein, 11 aa, Homo Sapiens
RIMDPDVITGY

SEQ ID NO: 160014 - protein, 11 aa, Homo Sapiens
RQIEREHLIQL

SEQ ID NO: 160015 - protein, 11 aa, Homo Sapiens
RQIGVEHVVVY

SEQ ID NO: 160016 - protein, 11 aa, Homo Sapiens
SAFGDLTIKSL

SEQ ID NO: 160017 - protein, 11 aa, Homo Sapiens
SAFPFPVTVSL

SEQ ID NO: 160018 - protein, 11 aa, Homo Sapiens
SAVNPEHLSYF

SEQ ID NO: 160019 - protein, 11 aa, Homo Sapiens
SAYDGKDYIAL

SEQ ID NO: 160020 - protein, 11 aa, Homo Sapiens
SSINPDHLSYF

SEQ ID NO: 160021 - protein, 11 aa, Homo Sapiens
SSINPDHLTYF

SEQ ID NO: 160022 - protein, 11 aa, Homo Sapiens
STINPDHLSYF

SEQ ID NO: 160023 - protein, 11 aa, Homo Sapiens
SVTQAECSGVI

SEQ ID NO: 160024 - protein, 11 aa, Homo Sapiens
TAFVEPFVILL

SEQ ID NO: 160025 - protein, 11 aa, Homo Sapiens
TAQNHPMLVEL

SEQ ID NO: 160026 - protein, 11 aa, Homo Sapiens
TIIDSDKIMVL

SEQ ID NO: 160027 - protein, 11 aa, Homo Sapiens
VASPFYLIIDH

SEQ ID NO: 160028 - protein, 11 aa, Homo Sapiens
VATPHARIIEL

SEQ ID NO: 160029 - protein, 11 aa, Homo Sapiens
VATSFIRTIEL

SEQ ID NO: 160030 - protein, 11 aa, Homo Sapiens
VAVDPSILARL

SEQ ID NO: 160031 - protein, 11 aa, Homo Sapiens
YAFPKAVSVFF

SEQ ID NO: 160032 - protein, 11 aa, Homo Sapiens
YAFPKSITVFF

SEQ ID NO: 160033 - protein, 11 aa, Homo Sapiens
YAFPRVRIITT

SEQ ID NO: 160034 - protein, 11 aa, Homo Sapiens
YAKDIGFIKLD

SEQ ID NO: 160035 - protein, 11 aa, Homo Sapiens
YAMAHTGVIFF

SEQ ID NO: 160036 - protein, 11 aa, Homo Sapiens
YASGRTTGIVM

SEQ ID NO: 160037 - protein, 11 aa, Homo Sapiens
YAVDPAQLQAL

SEQ ID NO: 160038 - protein, 11 aa, Homo Sapiens
YAYDGKDYIAL

SEQ ID NO: 160039 - protein, 11 aa, Homo Sapiens
YAYDGNRVRKW

SEQ ID NO: 160040 - protein, 11 aa, Homo Sapiens
YAYETKDALCL

SEQ ID NO: 160041 - protein, 11 aa, Homo Sapiens
YQFDKVGILTL

SEQ ID NO: 160042 - protein, 11 aa, Homo Sapiens
YQYPRPLLIAF

SEQ ID NO: 160043 - protein, 11 aa, Homo Sapiens
YTTDRVMTVSF

SEQ ID NO: 160044 - protein, 8 aa, Homo Sapiens
AFFTSKAL

SEQ ID NO: 160045 - protein, 8 aa, Homo Sapiens
AFHTASVL

SEQ ID NO: 160046 - protein, 8 aa, Homo Sapiens
AFLTGVGL

SEQ ID NO: 160047 - protein, 8 aa, Homo Sapiens
AFLVTRSM

SEQ ID NO: 160048 - protein, 8 aa, Homo Sapiens
AFMEGIAL

SEQ ID NO: 160049 - protein, 8 aa, Homo Sapiens
AFNIAEAF

SEQ ID NO: 160050 - protein, 8 aa, Homo Sapiens
AFQISKEY

SEQ ID NO: 160051 - protein, 8 aa, Homo Sapiens
AFTNRIFF

SEQ ID NO: 160052 - protein, 8 aa, Homo Sapiens
ATQVGIEW

SEQ ID NO: 160053 - protein, 8 aa, Homo Sapiens
AYFTAAQL

SEQ ID NO: 160054 - protein, 8 aa, Homo Sapiens
AYLQRIAL

SEQ ID NO: 160055 - protein, 8 aa, Homo Sapiens
AYMNHIMV

SEQ ID NO: 160056 - protein, 8 aa, Homo Sapiens
AYQVGAVL

SEQ ID NO: 160057 - protein, 8 aa, Homo Sapiens
AYSVGWEM

SEQ ID NO: 160058 - protein, 8 aa, Homo Sapiens
AYYAGHVL

SEQ ID NO: 160059 - protein, 8 aa, Homo Sapiens
CYGIRPEL

SEQ ID NO: 160060 - protein, 8 aa, Homo Sapiens
CYLTIKEM

SEQ ID NO: 160061 - protein, 8 aa, Homo Sapiens
CYNNQQVF

SEQ ID NO: 160062 - protein, 8 aa, Homo Sapiens
CYNTALRL

SEQ ID NO: 160063 - protein, 8 aa, Homo Sapiens
FFENHPYF

SEQ ID NO: 160064 - protein, 8 aa, Homo Sapiens
FFESFGDL

SEQ ID NO: 160065 - protein, 8 aa, Homo Sapiens
FFFYGKSL

SEQ ID NO: 160066 - protein, 8 aa, Homo Sapiens
FFKDGLEM

SEQ ID NO: 160067 - protein, 8 aa, Homo Sapiens
FFLEHEAL

SEQ ID NO: 160068 - protein, 8 aa, Homo Sapiens
FFLESIAM

SEQ ID NO: 160069 - protein, 8 aa, Homo Sapiens
FFLIGPPL

SEQ ID NO: 160070 - protein, 8 aa, Homo Sapiens
FFLISKEM

SEQ ID NO: 160071 - protein, 8 aa, Homo Sapiens
FFLLGKTL

SEQ ID NO: 160072 - protein, 8 aa, Homo Sapiens
FFLSHPAY

SEQ ID NO: 160073 - protein, 8 aa, Homo Sapiens
FFLVSREL

SEQ ID NO: 160074 - protein, 8 aa, Homo Sapiens
FFLVVDAY

SEQ ID NO: 160075 - protein, 8 aa, Homo Sapiens
FFPNGNAF

SEQ ID NO: 160076 - protein, 8 aa, Homo Sapiens
FFQVGSDL

SEQ ID NO: 160077 - protein, 8 aa, Homo Sapiens
FFRVVSEY

SEQ ID NO: 160078 - protein, 8 aa, Homo Sapiens
FFVPHGYL

SEQ ID NO: 160079 - protein, 8 aa, Homo Sapiens
FYAFGRVF

SEQ ID NO: 160080 - protein, 8 aa, Homo Sapiens
FYFEGTFY

SEQ ID NO: 160081 - protein, 8 aa, Homo Sapiens
FYFNTKYF

SEQ ID NO: 160082 - protein, 8 aa, Homo Sapiens
FYGFQIAM

SEQ ID NO: 160083 - protein, 8 aa, Homo Sapiens
FYGKAIEL

SEQ ID NO: 160084 - protein, 8 aa, Homo Sapiens
FYHSVQDL

SEQ ID NO: 160085 - protein, 8 aa, Homo Sapiens
FYLERSNL

SEQ ID NO: 160086 - protein, 8 aa, Homo Sapiens
FYLSGTYY

SEQ ID NO: 160087 - protein, 8 aa, Homo Sapiens
FYLTNSEY

SEQ ID NO: 160088 - protein, 8 aa, Homo Sapiens
FYNAGLAY

SEQ ID NO: 160089 - protein, 8 aa, Homo Sapiens
FYNITLAF

SEQ ID NO: 160090 - protein, 8 aa, Homo Sapiens
FYQEHPDL

SEQ ID NO: 160091 - protein, 8 aa, Homo Sapiens
FYQFVNNL

SEQ ID NO: 160092 - protein, 8 aa, Homo Sapiens
FYQLQPAM

SEQ ID NO: 160093 - protein, 8 aa, Homo Sapiens
FYTIHSCF

SEQ ID NO: 160094 - protein, 8 aa, Homo Sapiens
FYVEHPEV

SEQ ID NO: 160095 - protein, 8 aa, Homo Sapiens
FYVIGSSY

SEQ ID NO: 160096 - protein, 8 aa, Homo Sapiens
FYVNGLTL

SEQ ID NO: 160097 - protein, 8 aa, Homo Sapiens
FYVPVSEM

SEQ ID NO: 160098 - protein, 8 aa, Homo Sapiens
FYVVAESF

SEQ ID NO: 160099 - protein, 8 aa, Homo Sapiens
FYVVNSEL

SEQ ID NO: 160100 - protein, 8 aa, Homo Sapiens
FYYDGKVM

SEQ ID NO: 160101 - protein, 8 aa, Homo Sapiens
FYYFVKEF

SEQ ID NO: 160102 - protein, 8 aa, Homo Sapiens
FYYFVSAL

SEQ ID NO: 160103 - protein, 8 aa, Homo Sapiens
HFGIHEEM

SEQ ID NO: 160104 - protein, 8 aa, Homo Sapiens
HYNLQNAF

SEQ ID NO: 160105 - protein, 8 aa, Homo Sapiens
HYNNIMAL

SEQ ID NO: 160106 - protein, 8 aa, Homo Sapiens
HYQLGLAY

SEQ ID NO: 160107 - protein, 8 aa, Homo Sapiens
HYQNALYL

SEQ ID NO: 160108 - protein, 8 aa, Homo Sapiens
IFATVREL

SEQ ID NO: 160109 - protein, 8 aa, Homo Sapiens
IFFNVHSA

SEQ ID NO: 160110 - protein, 8 aa, Homo Sapiens
IFIARSQM

SEQ ID NO: 160111 - protein, 8 aa, Homo Sapiens
IFLGVSTV

SEQ ID NO: 160112 - protein, 8 aa, Homo Sapiens
IFQVAQEL

SEQ ID NO: 160113 - protein, 8 aa, Homo Sapiens
IYEVVRPL

SEQ ID NO: 160114 - protein, 8 aa, Homo Sapiens
IYFIHGLF

SEQ ID NO: 160115 - protein, 8 aa, Homo Sapiens
IYFLGNSL

SEQ ID NO: 160116 - protein, 8 aa, Homo Sapiens
IYHAVAAL

SEQ ID NO: 160117 - protein, 8 aa, Homo Sapiens
IYHISLEY

SEQ ID NO: 160118 - protein, 8 aa, Homo Sapiens
IYHVIMSV

SEQ ID NO: 160119 - protein, 8 aa, Homo Sapiens
IYIDRHVM

SEQ ID NO: 160120 - protein, 8 aa, Homo Sapiens
IYIVHDEV

SEQ ID NO: 160121 - protein, 8 aa, Homo Sapiens
IYLEGSAF

SEQ ID NO: 160122 - protein, 8 aa, Homo Sapiens
IYLNGESL

SEQ ID NO: 160123 - protein, 8 aa, Homo Sapiens
IYLNVESV

SEQ ID NO: 160124 - protein, 8 aa, Homo Sapiens
IYMESLAL

SEQ ID NO: 160125 - protein, 8 aa, Homo Sapiens
IYMIGVSL

SEQ ID NO: 160126 - protein, 8 aa, Homo Sapiens
IYMVHIQV

SEQ ID NO: 160127 - protein, 8 aa, Homo Sapiens
IYNIGTNF

SEQ ID NO: 160128 - protein, 8 aa, Homo Sapiens
IYNTAGFY

SEQ ID NO: 160129 - protein, 8 aa, Homo Sapiens
IYPLVGTM

SEQ ID NO: 160130 - protein, 8 aa, Homo Sapiens
IYQLQDVF

SEQ ID NO: 160131 - protein, 8 aa, Homo Sapiens
IYQSASVF

SEQ ID NO: 160132 - protein, 8 aa, Homo Sapiens
IYVNYPTF

SEQ ID NO: 160133 - protein, 8 aa, Homo Sapiens
KYLTAEAF

SEQ ID NO: 160134 - protein, 8 aa, Homo Sapiens
KYMNNITY

SEQ ID NO: 160135 - protein, 8 aa, Homo Sapiens
LFFVGNQL

SEQ ID NO: 160136 - protein, 8 aa, Homo Sapiens
LFLVGSSL

SEQ ID NO: 160137 - protein, 8 aa, Homo Sapiens
LFNLGSAY

SEQ ID NO: 160138 - protein, 8 aa, Homo Sapiens
LFQNGSVL

SEQ ID NO: 160139 - protein, 8 aa, Homo Sapiens
LFQNIRPL

SEQ ID NO: 160140 - protein, 8 aa, Homo Sapiens
LFQSRISL

SEQ ID NO: 160141 - protein, 8 aa, Homo Sapiens
LFTFRPAL

SEQ ID NO: 160142 - protein, 8 aa, Homo Sapiens
LYFTGEAI

SEQ ID NO: 160143 - protein, 8 aa, Homo Sapiens
LYHMERSL

SEQ ID NO: 160144 - protein, 8 aa, Homo Sapiens
LYITGAAL

SEQ ID NO: 160145 - protein, 8 aa, Homo Sapiens
LYLDGHVF

SEQ ID NO: 160146 - protein, 8 aa, Homo Sapiens
LYLIARVM

SEQ ID NO: 160147 - protein, 8 aa, Homo Sapiens
LYLLRLAL

SEQ ID NO: 160148 - protein, 8 aa, Homo Sapiens
LYLNRTSL

SEQ ID NO: 160149 - protein, 8 aa, Homo Sapiens
LYMVRTML

SEQ ID NO: 160150 - protein, 8 aa, Homo Sapiens
LYMVSKEL

SEQ ID NO: 160151 - protein, 8 aa, Homo Sapiens
LYNIAFMY

SEQ ID NO: 160152 - protein, 8 aa, Homo Sapiens
LYNIGLTY

SEQ ID NO: 160153 - protein, 8 aa, Homo Sapiens
LYNIGNVY

SEQ ID NO: 160154 - protein, 8 aa, Homo Sapiens
LYQTALHL

SEQ ID NO: 160155 - protein, 8 aa, Homo Sapiens
LYQTVTGL

SEQ ID NO: 160156 - protein, 8 aa, Homo Sapiens
LYQVGKEF

SEQ ID NO: 160157 - protein, 8 aa, Homo Sapiens
LYSTHAAL

SEQ ID NO: 160158 - protein, 8 aa, Homo Sapiens
MFLTRSEY

SEQ ID NO: 160159 - protein, 8 aa, Homo Sapiens
MFNNANVL

SEQ ID NO: 160160 - protein, 8 aa, Homo Sapiens
MYFIVRSL

SEQ ID NO: 160161 - protein, 8 aa, Homo Sapiens
MYTVAMAY

SEQ ID NO: 160162 - protein, 8 aa, Homo Sapiens
NFSIHMAL

SEQ ID NO: 160163 - protein, 8 aa, Homo Sapiens
NYHFGVTY

SEQ ID NO: 160164 - protein, 8 aa, Homo Sapiens
NYLTRIHY

SEQ ID NO: 160165 - protein, 8 aa, Homo Sapiens
NYLVVAAM

SEQ ID NO: 160166 - protein, 8 aa, Homo Sapiens
NYMMGIEF

SEQ ID NO: 160167 - protein, 8 aa, Homo Sapiens
NYYVRAVL

SEQ ID NO: 160168 - protein, 8 aa, Homo Sapiens
QFQFGHAL

SEQ ID NO: 160169 - protein, 8 aa, Homo Sapiens
QFRNAPPF

SEQ ID NO: 160170 - protein, 8 aa, Homo Sapiens
QYYVGQSF

SEQ ID NO: 160171 - protein, 8 aa, Homo Sapiens
RYMFSRPF

SEQ ID NO: 160172 - protein, 8 aa, Homo Sapiens
SFFLGKEL

SEQ ID NO: 160173 - protein, 8 aa, Homo Sapiens
SFLVNHDF

SEQ ID NO: 160174 - protein, 8 aa, Homo Sapiens
SFNTHFEM

SEQ ID NO: 160175 - protein, 8 aa, Homo Sapiens
SFNVALSL

SEQ ID NO: 160176 - protein, 8 aa, Homo Sapiens
SFYNGLSF

SEQ ID NO: 160177 - protein, 8 aa, Homo Sapiens
SYNISEVM

SEQ ID NO: 160178 - protein, 8 aa, Homo Sapiens
SYWNHREL

SEQ ID NO: 160179 - protein, 8 aa, Homo Sapiens
TFLNHPAL

SEQ ID NO: 160180 - protein, 8 aa, Homo Sapiens
TFMNRVEV

SEQ ID NO: 160181 - protein, 8 aa, Homo Sapiens
TFTNHMVF

SEQ ID NO: 160182 - protein, 8 aa, Homo Sapiens
TFVNHPQV

SEQ ID NO: 160183 - protein, 8 aa, Homo Sapiens
TYKEALEK

SEQ ID NO: 160184 - protein, 8 aa, Homo Sapiens
TYLTGDQF

SEQ ID NO: 160185 - protein, 8 aa, Homo Sapiens
TYLVAFAY

SEQ ID NO: 160186 - protein, 8 aa, Homo Sapiens
TYLVGNSL

SEQ ID NO: 160187 - protein, 8 aa, Homo Sapiens
TYSLGSAL

SEQ ID NO: 160188 - protein, 8 aa, Homo Sapiens
TYTTRIHL

SEQ ID NO: 160189 - protein, 8 aa, Homo Sapiens
VFFVAHSY

SEQ ID NO: 160190 - protein, 8 aa, Homo Sapiens
VFLAGIAL

SEQ ID NO: 160191 - protein, 8 aa, Homo Sapiens
VFLLGHSM

SEQ ID NO: 160192 - protein, 8 aa, Homo Sapiens
VFLLGVVY

SEQ ID NO: 160193 - protein, 8 aa, Homo Sapiens
VFLVVRAH

SEQ ID NO: 160194 - protein, 8 aa, Homo Sapiens
VFMTHLEF

SEQ ID NO: 160195 - protein, 8 aa, Homo Sapiens
VFRVGSVL

SEQ ID NO: 160196 - protein, 8 aa, Homo Sapiens
VFRVSSSL

SEQ ID NO: 160197 - protein, 8 aa, Homo Sapiens
VFSIGPVF

SEQ ID NO: 160198 - protein, 8 aa, Homo Sapiens
VFSLSSEF

SEQ ID NO: 160199 - protein, 8 aa, Homo Sapiens
VFTNAEVY

SEQ ID NO: 160200 - protein, 8 aa, Homo Sapiens
VFVTVKEL

SEQ ID NO: 160201 - protein, 8 aa, Homo Sapiens
VFVVGESY

SEQ ID NO: 160202 - protein, 8 aa, Homo Sapiens
VYEIGRQF

SEQ ID NO: 160203 - protein, 8 aa, Homo Sapiens
VYFVHPTF

SEQ ID NO: 160204 - protein, 8 aa, Homo Sapiens
VYHAVSVM

SEQ ID NO: 160205 - protein, 8 aa, Homo Sapiens
VYITRAQL

SEQ ID NO: 160206 - protein, 8 aa, Homo Sapiens
VYKVGIAF

SEQ ID NO: 160207 - protein, 8 aa, Homo Sapiens
VYLFTEAY

SEQ ID NO: 160208 - protein, 8 aa, Homo Sapiens
VYLNVMEL

SEQ ID NO: 160209 - protein, 8 aa, Homo Sapiens
VYLTGYNF

SEQ ID NO: 160210 - protein, 8 aa, Homo Sapiens
VYLTHLDY

SEQ ID NO: 160211 - protein, 8 aa, Homo Sapiens
VYLVHDEL

SEQ ID NO: 160212 - protein, 8 aa, Homo Sapiens
VYLVTEVY

SEQ ID NO: 160213 - protein, 8 aa, Homo Sapiens
VYMLAASL

SEQ ID NO: 160214 - protein, 8 aa, Homo Sapiens
VYMTGKEL

SEQ ID NO: 160215 - protein, 8 aa, Homo Sapiens
VYNIHLAV

SEQ ID NO: 160216 - protein, 8 aa, Homo Sapiens
VYQAVLSL

SEQ ID NO: 160217 - protein, 8 aa, Homo Sapiens
VYQAVQAL

SEQ ID NO: 160218 - protein, 8 aa, Homo Sapiens
VYQAVRQF

SEQ ID NO: 160219 - protein, 8 aa, Homo Sapiens
YFDEHYEY

SEQ ID NO: 160220 - protein, 8 aa, Homo Sapiens
YFFAVSTL

SEQ ID NO: 160221 - protein, 8 aa, Homo Sapiens
YFLEHLAF

SEQ ID NO: 160222 - protein, 8 aa, Homo Sapiens
YFLIGKVY

SEQ ID NO: 160223 - protein, 8 aa, Homo Sapiens
YFLQRHEL

SEQ ID NO: 160224 - protein, 8 aa, Homo Sapiens
YFMVGTAF

SEQ ID NO: 160225 - protein, 8 aa, Homo Sapiens
YFNEGTVL

SEQ ID NO: 160226 - protein, 8 aa, Homo Sapiens
YFSPFRPY

SEQ ID NO: 160227 - protein, 8 aa, Homo Sapiens
YQSKVREL

SEQ ID NO: 160228 - protein, 8 aa, Homo Sapiens
YSPHGHIL

SEQ ID NO: 160229 - protein, 8 aa, Homo Sapiens
YVHMVTHF

SEQ ID NO: 160230 - protein, 8 aa, Homo Sapiens
YWQNHPEL

SEQ ID NO: 160231 - protein, 8 aa, Homo Sapiens
YYASFLEV

SEQ ID NO: 160232 - protein, 8 aa, Homo Sapiens
YYEVHKEL

SEQ ID NO: 160233 - protein, 8 aa, Homo Sapiens
YYFAVDTM

SEQ ID NO: 160234 - protein, 8 aa, Homo Sapiens
YYFLGRML

SEQ ID NO: 160235 - protein, 8 aa, Homo Sapiens
YYFNQHIF

SEQ ID NO: 160236 - protein, 8 aa, Homo Sapiens
YYFSAHAL

SEQ ID NO: 160237 - protein, 8 aa, Homo Sapiens
YYFSVDNL

SEQ ID NO: 160238 - protein, 8 aa, Homo Sapiens
YYHWALSF

SEQ ID NO: 160239 - protein, 8 aa, Homo Sapiens
YYINHPLY

SEQ ID NO: 160240 - protein, 8 aa, Homo Sapiens
YYINSPEL

SEQ ID NO: 160241 - protein, 8 aa, Homo Sapiens
YYITRAKL

SEQ ID NO: 160242 - protein, 8 aa, Homo Sapiens
YYKPGLLM

SEQ ID NO: 160243 - protein, 8 aa, Homo Sapiens
YYNTAVKL

SEQ ID NO: 160244 - protein, 8 aa, Homo Sapiens
YYQFINEL

SEQ ID NO: 160245 - protein, 8 aa, Homo Sapiens
YYQLSEEL

SEQ ID NO: 160246 - protein, 8 aa, Homo Sapiens
YYTVAHAI

SEQ ID NO: 160247 - protein, 9 aa, Homo Sapiens
AFADYVSTM

SEQ ID NO: 160248 - protein, 9 aa, Homo Sapiens
AFALVSQAY

SEQ ID NO: 160249 - protein, 9 aa, Homo Sapiens
AFATPTISL

SEQ ID NO: 160250 - protein, 9 aa, Homo Sapiens
AFEDYVQSM

SEQ ID NO: 160251 - protein, 9 aa, Homo Sapiens
AFFGGSNPF

SEQ ID NO: 160252 - protein, 9 aa, Homo Sapiens
AFHLRVLAH

SEQ ID NO: 160253 - protein, 9 aa, Homo Sapiens
AFIAQALCL

SEQ ID NO: 160254 - protein, 9 aa, Homo Sapiens
AFIDQSQSL

SEQ ID NO: 160255 - protein, 9 aa, Homo Sapiens
AFIDTAQHM

SEQ ID NO: 160256 - protein, 9 aa, Homo Sapiens
AFIFRSLNL

SEQ ID NO: 160257 - protein, 9 aa, Homo Sapiens
AFIHISTAY

SEQ ID NO: 160258 - protein, 9 aa, Homo Sapiens
AFIITGQTY

SEQ ID NO: 160259 - protein, 9 aa, Homo Sapiens
AFIQEAAAF

SEQ ID NO: 160260 - protein, 9 aa, Homo Sapiens
AFISHTSVL

SEQ ID NO: 160261 - protein, 9 aa, Homo Sapiens
AFISKVSTH

SEQ ID NO: 160262 - protein, 9 aa, Homo Sapiens
AFISLAKTL

SEQ ID NO: 160263 - protein, 9 aa, Homo Sapiens
AFKEVGIEF

SEQ ID NO: 160264 - protein, 9 aa, Homo Sapiens
AFLAEASVM

SEQ ID NO: 160265 - protein, 9 aa, Homo Sapiens
AFLEAADNL

SEQ ID NO: 160266 - protein, 9 aa, Homo Sapiens
AFLEQAVSY

SEQ ID NO: 160267 - protein, 9 aa, Homo Sapiens
AFLGEANVM

SEQ ID NO: 160268 - protein, 9 aa, Homo Sapiens
AFLKTALEM

SEQ ID NO: 160269 - protein, 9 aa, Homo Sapiens
AFMDQVRAF

SEQ ID NO: 160270 - protein, 9 aa, Homo Sapiens
AFMEKVRVL

SEQ ID NO: 160271 - protein, 9 aa, Homo Sapiens
AFMSQVHSV

SEQ ID NO: 160272 - protein, 9 aa, Homo Sapiens
AFNFGSRPL

SEQ ID NO: 160273 - protein, 9 aa, Homo Sapiens
AFNTQVTAL

SEQ ID NO: 160274 - protein, 9 aa, Homo Sapiens
AFNVMGEQF

SEQ ID NO: 160275 - protein, 9 aa, Homo Sapiens
AFPDSVNSL

SEQ ID NO: 160276 - protein, 9 aa, Homo Sapiens
AFPGASLYL

SEQ ID NO: 160277 - protein, 9 aa, Homo Sapiens
AFPIGSSGF

SEQ ID NO: 160278 - protein, 9 aa, Homo Sapiens
AFPKAVSVF

SEQ ID NO: 160279 - protein, 9 aa, Homo Sapiens
AFPNLARVL

SEQ ID NO: 160280 - protein, 9 aa, Homo Sapiens
AFPYGNVAF

SEQ ID NO: 160281 - protein, 9 aa, Homo Sapiens
AFQAEIAQL

SEQ ID NO: 160282 - protein, 9 aa, Homo Sapiens
AFQERLNSY

SEQ ID NO: 160283 - protein, 9 aa, Homo Sapiens
AFQFSYTAV

SEQ ID NO: 160284 - protein, 9 aa, Homo Sapiens
AFQHVGKAF

SEQ ID NO: 160285 - protein, 9 aa, Homo Sapiens
AFQVLVKSL

SEQ ID NO: 160286 - protein, 9 aa, Homo Sapiens
AFQVSACAF

SEQ ID NO: 160287 - protein, 9 aa, Homo Sapiens
AFYDPTHAW

SEQ ID NO: 160288 - protein, 9 aa, Homo Sapiens
APYIYALLS

SEQ ID NO: 160289 - protein, 9 aa, Homo Sapiens
AVLASGATF

SEQ ID NO: 160290 - protein, 9 aa, Homo Sapiens
AVNIMHSSL

SEQ ID NO: 160291 - protein, 9 aa, Homo Sapiens
AWIDGVLDM

SEQ ID NO: 160292 - protein, 9 aa, Homo Sapiens
AYALAGVSF

SEQ ID NO: 160293 - protein, 9 aa, Homo Sapiens
AYALMAHAM

SEQ ID NO: 160294 - protein, 9 aa, Homo Sapiens
AYEFMSQAF

SEQ ID NO: 160295 - protein, 9 aa, Homo Sapiens
AYFPDARDM

SEQ ID NO: 160296 - protein, 9 aa, Homo Sapiens
AYFPYFITY

SEQ ID NO: 160297 - protein, 9 aa, Homo Sapiens
AYGRMGLAL

SEQ ID NO: 160298 - protein, 9 aa, Homo Sapiens
AYHAVVLSY

SEQ ID NO: 160299 - protein, 9 aa, Homo Sapiens
AYHELAQVY

SEQ ID NO: 160300 - protein, 9 aa, Homo Sapiens
AYHGLTVPL

SEQ ID NO: 160301 - protein, 9 aa, Homo Sapiens
AYIFNSNVM

SEQ ID NO: 160302 - protein, 9 aa, Homo Sapiens
AYIGGICSL

SEQ ID NO: 160303 - protein, 9 aa, Homo Sapiens
AYIMKRMDM

SEQ ID NO: 160304 - protein, 9 aa, Homo Sapiens
AYINKVEEL

SEQ ID NO: 160305 - protein, 9 aa, Homo Sapiens
AYINRASLL

SEQ ID NO: 160306 - protein, 9 aa, Homo Sapiens
AYKPPGFSL

SEQ ID NO: 160307 - protein, 9 aa, Homo Sapiens
AYLAALTQL

SEQ ID NO: 160308 - protein, 9 aa, Homo Sapiens
AYLALRISY

SEQ ID NO: 160309 - protein, 9 aa, Homo Sapiens
AYLEAHETF

SEQ ID NO: 160310 - protein, 9 aa, Homo Sapiens
AYLEALSHL

SEQ ID NO: 160311 - protein, 9 aa, Homo Sapiens
AYLGSAIQL

SEQ ID NO: 160312 - protein, 9 aa, Homo Sapiens
AYLIMISAL

SEQ ID NO: 160313 - protein, 9 aa, Homo Sapiens
AYLPNGAAL

SEQ ID NO: 160314 - protein, 9 aa, Homo Sapiens
AYLPVNESF

SEQ ID NO: 160315 - protein, 9 aa, Homo Sapiens
AYLRSMIPH

SEQ ID NO: 160316 - protein, 9 aa, Homo Sapiens
AYLSKAMEI

SEQ ID NO: 160317 - protein, 9 aa, Homo Sapiens
AYMAAFNSI

SEQ ID NO: 160318 - protein, 9 aa, Homo Sapiens
AYMELVNNM

SEQ ID NO: 160319 - protein, 9 aa, Homo Sapiens
AYMKSLLSL

SEQ ID NO: 160320 - protein, 9 aa, Homo Sapiens
AYMPHTFFI

SEQ ID NO: 160321 - protein, 9 aa, Homo Sapiens
AYNFPVTAM

SEQ ID NO: 160322 - protein, 9 aa, Homo Sapiens
AYNYYTKAI

SEQ ID NO: 160323 - protein, 9 aa, Homo Sapiens
AYPEIVAVY

SEQ ID NO: 160324 - protein, 9 aa, Homo Sapiens
AYPEYLITF

SEQ ID NO: 160325 - protein, 9 aa, Homo Sapiens
AYPEYLITY

SEQ ID NO: 160326 - protein, 9 aa, Homo Sapiens
AYPYNFSNL

SEQ ID NO: 160327 - protein, 9 aa, Homo Sapiens
AYPYYASAF

SEQ ID NO: 160328 - protein, 9 aa, Homo Sapiens
AYQDRLAYL

SEQ ID NO: 160329 - protein, 9 aa, Homo Sapiens
AYQEAVRTL

SEQ ID NO: 160330 - protein, 9 aa, Homo Sapiens
AYQFFREAL

SEQ ID NO: 160331 - protein, 9 aa, Homo Sapiens
AYQLMTDVF

SEQ ID NO: 160332 - protein, 9 aa, Homo Sapiens
AYQQRVTAL

SEQ ID NO: 160333 - protein, 9 aa, Homo Sapiens
AYQVSVCAF

SEQ ID NO: 160334 - protein, 9 aa, Homo Sapiens
AYQYTIRAH

SEQ ID NO: 160335 - protein, 9 aa, Homo Sapiens
AYSIVAGVF

SEQ ID NO: 160336 - protein, 9 aa, Homo Sapiens
AYTPFHAVL

SEQ ID NO: 160337 - protein, 9 aa, Homo Sapiens
AYVHMVTHF

SEQ ID NO: 160338 - protein, 9 aa, Homo Sapiens
AYVPGFAHI

SEQ ID NO: 160339 - protein, 9 aa, Homo Sapiens
AYYERALQL

SEQ ID NO: 160340 - protein, 9 aa, Homo Sapiens
AYYKKALEL

SEQ ID NO: 160341 - protein, 9 aa, Homo Sapiens
AYYPSSFPK

SEQ ID NO: 160342 - protein, 9 aa, Homo Sapiens
AYYVSNEEL

SEQ ID NO: 160343 - protein, 9 aa, Homo Sapiens
AYYYRKFFY

SEQ ID NO: 160344 - protein, 9 aa, Homo Sapiens
AYYYSLQIY

SEQ ID NO: 160345 - protein, 9 aa, Homo Sapiens
CFFPNGNAF

SEQ ID NO: 160346 - protein, 9 aa, Homo Sapiens
CFFTAKTTF

SEQ ID NO: 160347 - protein, 9 aa, Homo Sapiens
CFNPMKSVL

SEQ ID NO: 160348 - protein, 9 aa, Homo Sapiens
CFYGFQIAM

SEQ ID NO: 160349 - protein, 9 aa, Homo Sapiens
CYNLETNSL

SEQ ID NO: 160350 - protein, 9 aa, Homo Sapiens
CYQEFAAQL

SEQ ID NO: 160351 - protein, 9 aa, Homo Sapiens
CYQEGLRSL

SEQ ID NO: 160352 - protein, 9 aa, Homo Sapiens
EWPPFVVTL

SEQ ID NO: 160353 - protein, 9 aa, Homo Sapiens
FALNTKTSY

SEQ ID NO: 160354 - protein, 9 aa, Homo Sapiens
FFDEKLNSL

SEQ ID NO: 160355 - protein, 9 aa, Homo Sapiens
FFEFLTKEL

SEQ ID NO: 160356 - protein, 9 aa, Homo Sapiens
FFFAPASSY

SEQ ID NO: 160357 - protein, 9 aa, Homo Sapiens
FFFDKTEEL

SEQ ID NO: 160358 - protein, 9 aa, Homo Sapiens
FFFTARTSF

SEQ ID NO: 160359 - protein, 9 aa, Homo Sapiens
FFGTHETAF

SEQ ID NO: 160360 - protein, 9 aa, Homo Sapiens
FFHEYLVSV

SEQ ID NO: 160361 - protein, 9 aa, Homo Sapiens
FFHLVNSEM

SEQ ID NO: 160362 - protein, 9 aa, Homo Sapiens
FFHWVNNVL

SEQ ID NO: 160363 - protein, 9 aa, Homo Sapiens
FFHYAVDNL

SEQ ID NO: 160364 - protein, 9 aa, Homo Sapiens
FFIACVTSF

SEQ ID NO: 160365 - protein, 9 aa, Homo Sapiens
FFIAGRYEF

SEQ ID NO: 160366 - protein, 9 aa, Homo Sapiens
FFIDCMAAL

SEQ ID NO: 160367 - protein, 9 aa, Homo Sapiens
FFIDQANYF

SEQ ID NO: 160368 - protein, 9 aa, Homo Sapiens
FFINEAMEL

SEQ ID NO: 160369 - protein, 9 aa, Homo Sapiens
FFKERVMEI

SEQ ID NO: 160370 - protein, 9 aa, Homo Sapiens
FFKLPGGEL

SEQ ID NO: 160371 - protein, 9 aa, Homo Sapiens
FFLARPTTF

SEQ ID NO: 160372 - protein, 9 aa, Homo Sapiens
FFLIVKTLY

SEQ ID NO: 160373 - protein, 9 aa, Homo Sapiens
FFLQKRLQL

SEQ ID NO: 160374 - protein, 9 aa, Homo Sapiens
FFLRMKCTL

SEQ ID NO: 160375 - protein, 9 aa, Homo Sapiens
FFLSHQTAL

SEQ ID NO: 160376 - protein, 9 aa, Homo Sapiens
FFLSKIRSH

SEQ ID NO: 160377 - protein, 9 aa, Homo Sapiens
FFLVQTKEV

SEQ ID NO: 160378 - protein, 9 aa, Homo Sapiens
FFMEKRAKY

SEQ ID NO: 160379 - protein, 9 aa, Homo Sapiens
FFMERSWSV

SEQ ID NO: 160380 - protein, 9 aa, Homo Sapiens
FFMLRSLSL

SEQ ID NO: 160381 - protein, 9 aa, Homo Sapiens
FFMPGFAPL

SEQ ID NO: 160382 - protein, 9 aa, Homo Sapiens
FFNDTTTAF

SEQ ID NO: 160383 - protein, 9 aa, Homo Sapiens
FFNGLRTEL

SEQ ID NO: 160384 - protein, 9 aa, Homo Sapiens
FFNSVRSVF

SEQ ID NO: 160385 - protein, 9 aa, Homo Sapiens
FFPALHESL

SEQ ID NO: 160386 - protein, 9 aa, Homo Sapiens
FFPEYTHQL

SEQ ID NO: 160387 - protein, 9 aa, Homo Sapiens
FFPFDTRQM

SEQ ID NO: 160388 - protein, 9 aa, Homo Sapiens
FFPFNPLDF

SEQ ID NO: 160389 - protein, 9 aa, Homo Sapiens
FFPGFPLAL

SEQ ID NO: 160390 - protein, 9 aa, Homo Sapiens
FFPIAGLEF

SEQ ID NO: 160391 - protein, 9 aa, Homo Sapiens
FFPKKLLEL

SEQ ID NO: 160392 - protein, 9 aa, Homo Sapiens
FFPLHPMMI

SEQ ID NO: 160393 - protein, 9 aa, Homo Sapiens
FFPMHFQAF

SEQ ID NO: 160394 - protein, 9 aa, Homo Sapiens
FFPPFVSCI

SEQ ID NO: 160395 - protein, 9 aa, Homo Sapiens
FFPSNVEQF

SEQ ID NO: 160396 - protein, 9 aa, Homo Sapiens
FFPVHFQEF

SEQ ID NO: 160397 - protein, 9 aa, Homo Sapiens
FFPWNSHVV

SEQ ID NO: 160398 - protein, 9 aa, Homo Sapiens
FFPYQVTER

SEQ ID NO: 160399 - protein, 9 aa, Homo Sapiens
FFQDKARFY

SEQ ID NO: 160400 - protein, 9 aa, Homo Sapiens
FFQETNIPY

SEQ ID NO: 160401 - protein, 9 aa, Homo Sapiens
FFQFGGQSL

SEQ ID NO: 160402 - protein, 9 aa, Homo Sapiens
FFQQTTTSF

SEQ ID NO: 160403 - protein, 9 aa, Homo Sapiens
FFSEREASF

SEQ ID NO: 160404 - protein, 9 aa, Homo Sapiens
FFTDNVPAL

SEQ ID NO: 160405 - protein, 9 aa, Homo Sapiens
FFTSKALNM

SEQ ID NO: 160406 - protein, 9 aa, Homo Sapiens
FFVENVSEL

SEQ ID NO: 160407 - protein, 9 aa, Homo Sapiens
FFYPGWKVL

SEQ ID NO: 160408 - protein, 9 aa, Homo Sapiens
FFYPLDFTF

SEQ ID NO: 160409 - protein, 9 aa, Homo Sapiens
FFYQRLVEF

SEQ ID NO: 160410 - protein, 9 aa, Homo Sapiens
FFYTHLINF

SEQ ID NO: 160411 - protein, 9 aa, Homo Sapiens
FLPKGYLAL

SEQ ID NO: 160412 - protein, 9 aa, Homo Sapiens
FLYPFPLAL

SEQ ID NO: 160413 - protein, 9 aa, Homo Sapiens
FMHVQLEVM

SEQ ID NO: 160414 - protein, 9 aa, Homo Sapiens
FSPFHASVL

SEQ ID NO: 160415 - protein, 9 aa, Homo Sapiens
FTFPSDITE

SEQ ID NO: 160416 - protein, 9 aa, Homo Sapiens
FTIFRTISV

SEQ ID NO: 160417 - protein, 9 aa, Homo Sapiens
FVYITDNAY

SEQ ID NO: 160418 - protein, 9 aa, Homo Sapiens
FWPEAFSEV

SEQ ID NO: 160419 - protein, 9 aa, Homo Sapiens
FWPPYVELL

SEQ ID NO: 160420 - protein, 9 aa, Homo Sapiens
FYAHSLVEL

SEQ ID NO: 160421 - protein, 9 aa, Homo Sapiens
FYAKGALQY

SEQ ID NO: 160422 - protein, 9 aa, Homo Sapiens
FYEDNVLYM

SEQ ID NO: 160423 - protein, 9 aa, Homo Sapiens
FYEETKVKF

SEQ ID NO: 160424 - protein, 9 aa, Homo Sapiens
FYEGHITSL

SEQ ID NO: 160425 - protein, 9 aa, Homo Sapiens
FYEPYSREL

SEQ ID NO: 160426 - protein, 9 aa, Homo Sapiens
FYFALRDTL

SEQ ID NO: 160427 - protein, 9 aa, Homo Sapiens
FYFASKLVL

SEQ ID NO: 160428 - protein, 9 aa, Homo Sapiens
FYGDLRKAL

SEQ ID NO: 160429 - protein, 9 aa, Homo Sapiens
FYHAYDSYL

SEQ ID NO: 160430 - protein, 9 aa, Homo Sapiens
FYHKGIASL

SEQ ID NO: 160431 - protein, 9 aa, Homo Sapiens
FYHLRIAYY

SEQ ID NO: 160432 - protein, 9 aa, Homo Sapiens
FYHPETTQL

SEQ ID NO: 160433 - protein, 9 aa, Homo Sapiens
FYIENQKEY

SEQ ID NO: 160434 - protein, 9 aa, Homo Sapiens
FYIESISYL

SEQ ID NO: 160435 - protein, 9 aa, Homo Sapiens
FYIHEVQEL

SEQ ID NO: 160436 - protein, 9 aa, Homo Sapiens
FYIIEREPL

SEQ ID NO: 160437 - protein, 9 aa, Homo Sapiens
FYILTSKEL

SEQ ID NO: 160438 - protein, 9 aa, Homo Sapiens
FYIPQRPYM

SEQ ID NO: 160439 - protein, 9 aa, Homo Sapiens
FYISPRITF

SEQ ID NO: 160440 - protein, 9 aa, Homo Sapiens
FYISWAEEY

SEQ ID NO: 160441 - protein, 9 aa, Homo Sapiens
FYITPSTSL

SEQ ID NO: 160442 - protein, 9 aa, Homo Sapiens
FYITSRTQF

SEQ ID NO: 160443 - protein, 9 aa, Homo Sapiens
FYIYGVSDL

SEQ ID NO: 160444 - protein, 9 aa, Homo Sapiens
FYLDNVIGH

SEQ ID NO: 160445 - protein, 9 aa, Homo Sapiens
FYLDTVSAL

SEQ ID NO: 160446 - protein, 9 aa, Homo Sapiens
FYLFHPLAY

SEQ ID NO: 160447 - protein, 9 aa, Homo Sapiens
FYLFHVQEV

SEQ ID NO: 160448 - protein, 9 aa, Homo Sapiens
FYLNQSTAY

SEQ ID NO: 160449 - protein, 9 aa, Homo Sapiens
FYLPHGLSI

SEQ ID NO: 160450 - protein, 9 aa, Homo Sapiens
FYLPHVCSY

SEQ ID NO: 160451 - protein, 9 aa, Homo Sapiens
FYLPIAAAM

SEQ ID NO: 160452 - protein, 9 aa, Homo Sapiens
FYLSKMISM

SEQ ID NO: 160453 - protein, 9 aa, Homo Sapiens
FYLVPACSY

SEQ ID NO: 160454 - protein, 9 aa, Homo Sapiens
FYMDTSHLF

SEQ ID NO: 160455 - protein, 9 aa, Homo Sapiens
FYMVRAQAW

SEQ ID NO: 160456 - protein, 9 aa, Homo Sapiens
FYNEYVREL

SEQ ID NO: 160457 - protein, 9 aa, Homo Sapiens
FYNGPVSKF

SEQ ID NO: 160458 - protein, 9 aa, Homo Sapiens
FYNLIHPEY

SEQ ID NO: 160459 - protein, 9 aa, Homo Sapiens
FYNLSIQSF

SEQ ID NO: 160460 - protein, 9 aa, Homo Sapiens
FYNNRLQAY

SEQ ID NO: 160461 - protein, 9 aa, Homo Sapiens
FYNQVSTPL

SEQ ID NO: 160462 - protein, 9 aa, Homo Sapiens
FYNTSIEEM

SEQ ID NO: 160463 - protein, 9 aa, Homo Sapiens
FYPAKVTAV

SEQ ID NO: 160464 - protein, 9 aa, Homo Sapiens
FYPDLGPEL

SEQ ID NO: 160465 - protein, 9 aa, Homo Sapiens
FYPEEISSM

SEQ ID NO: 160466 - protein, 9 aa, Homo Sapiens
FYPEEVSSM

SEQ ID NO: 160467 - protein, 9 aa, Homo Sapiens
FYPELKLAY

SEQ ID NO: 160468 - protein, 9 aa, Homo Sapiens
FYPFAGHDL

SEQ ID NO: 160469 - protein, 9 aa, Homo Sapiens
FYPGLGLAL

SEQ ID NO: 160470 - protein, 9 aa, Homo Sapiens
FYPHHPQML

SEQ ID NO: 160471 - protein, 9 aa, Homo Sapiens
FYPIYFRPL

SEQ ID NO: 160472 - protein, 9 aa, Homo Sapiens
FYPPDPAQL

SEQ ID NO: 160473 - protein, 9 aa, Homo Sapiens
FYPPKVELF

SEQ ID NO: 160474 - protein, 9 aa, Homo Sapiens
FYPPLTSSL

SEQ ID NO: 160475 - protein, 9 aa, Homo Sapiens
FYPPPRITL

SEQ ID NO: 160476 - protein, 9 aa, Homo Sapiens
FYPSGGLEV

SEQ ID NO: 160477 - protein, 9 aa, Homo Sapiens
FYPYGLQTF

SEQ ID NO: 160478 - protein, 9 aa, Homo Sapiens
FYQDKLKSL

SEQ ID NO: 160479 - protein, 9 aa, Homo Sapiens
FYQGHVEGY

SEQ ID NO: 160480 - protein, 9 aa, Homo Sapiens
FYQHNVEKL

SEQ ID NO: 160481 - protein, 9 aa, Homo Sapiens
FYQPKIQQF

SEQ ID NO: 160482 - protein, 9 aa, Homo Sapiens
FYQPTCIVL

SEQ ID NO: 160483 - protein, 9 aa, Homo Sapiens
FYQRFPLSF

SEQ ID NO: 160484 - protein, 9 aa, Homo Sapiens
FYRPLAPEL

SEQ ID NO: 160485 - protein, 9 aa, Homo Sapiens
FYTVAVTSL

SEQ ID NO: 160486 - protein, 9 aa, Homo Sapiens
FYVDTVRAF

SEQ ID NO: 160487 - protein, 9 aa, Homo Sapiens
FYVPFAKAL

SEQ ID NO: 160488 - protein, 9 aa, Homo Sapiens
FYVRLIDSM

SEQ ID NO: 160489 - protein, 9 aa, Homo Sapiens
FYYGGQVNY

SEQ ID NO: 160490 - protein, 9 aa, Homo Sapiens
FYYIRISEL

SEQ ID NO: 160491 - protein, 9 aa, Homo Sapiens
GFMPGAHVF

SEQ ID NO: 160492 - protein, 9 aa, Homo Sapiens
GFPEAASSF

SEQ ID NO: 160493 - protein, 9 aa, Homo Sapiens
GFPEQATAF

SEQ ID NO: 160494 - protein, 9 aa, Homo Sapiens
GFPSSVAAL

SEQ ID NO: 160495 - protein, 9 aa, Homo Sapiens
GYAPYVNRI

SEQ ID NO: 160496 - protein, 9 aa, Homo Sapiens
GYLAASQSF

SEQ ID NO: 160497 - protein, 9 aa, Homo Sapiens
GYLPLAHVL

SEQ ID NO: 160498 - protein, 9 aa, Homo Sapiens
GYMVMGDSF

SEQ ID NO: 160499 - protein, 9 aa, Homo Sapiens
GYPEVALHF

SEQ ID NO: 160500 - protein, 9 aa, Homo Sapiens
GYVLYASAM

SEQ ID NO: 160501 - protein, 9 aa, Homo Sapiens
GYYSHALYL

SEQ ID NO: 160502 - protein, 9 aa, Homo Sapiens
HFIEKAHTL

SEQ ID NO: 160503 - protein, 9 aa, Homo Sapiens
HFIFFVQEF

SEQ ID NO: 160504 - protein, 9 aa, Homo Sapiens
HFIRPGNAL

SEQ ID NO: 160505 - protein, 9 aa, Homo Sapiens
HFITPVSTL

SEQ ID NO: 160506 - protein, 9 aa, Homo Sapiens
HFLEVAREL

SEQ ID NO: 160507 - protein, 9 aa, Homo Sapiens
HFLQQPRPL

SEQ ID NO: 160508 - protein, 9 aa, Homo Sapiens
HFNPTGSAF

SEQ ID NO: 160509 - protein, 9 aa, Homo Sapiens
HFNVTNTTF

SEQ ID NO: 160510 - protein, 9 aa, Homo Sapiens
HFPDLFHVM

SEQ ID NO: 160511 - protein, 9 aa, Homo Sapiens
HFPGLASEL

SEQ ID NO: 160512 - protein, 9 aa, Homo Sapiens
HFPMQSREF

SEQ ID NO: 160513 - protein, 9 aa, Homo Sapiens
HFQEKVESL

SEQ ID NO: 160514 - protein, 9 aa, Homo Sapiens
HFYGKAIEL

SEQ ID NO: 160515 - protein, 9 aa, Homo Sapiens
HFYLKALSL

SEQ ID NO: 160516 - protein, 9 aa, Homo Sapiens
HFYRSLVAH

SEQ ID NO: 160517 - protein, 9 aa, Homo Sapiens
HYFFAVSTL

SEQ ID NO: 160518 - protein, 9 aa, Homo Sapiens
HYIDRVRAL

SEQ ID NO: 160519 - protein, 9 aa, Homo Sapiens
HYIIAARAL

SEQ ID NO: 160520 - protein, 9 aa, Homo Sapiens
HYINEVLFL

SEQ ID NO: 160521 - protein, 9 aa, Homo Sapiens
HYITPMMEL

SEQ ID NO: 160522 - protein, 9 aa, Homo Sapiens
HYMSINDSF

SEQ ID NO: 160523 - protein, 9 aa, Homo Sapiens
HYNNIMALY

SEQ ID NO: 160524 - protein, 9 aa, Homo Sapiens
HYPDFHQEL

SEQ ID NO: 160525 - protein, 9 aa, Homo Sapiens
HYPNWFKAL

SEQ ID NO: 160526 - protein, 9 aa, Homo Sapiens
HYQAIVTAY

SEQ ID NO: 160527 - protein, 9 aa, Homo Sapiens
HYQPVDVSL

SEQ ID NO: 160528 - protein, 9 aa, Homo Sapiens
HYYDLALAF

SEQ ID NO: 160529 - protein, 9 aa, Homo Sapiens
HYYGPALEF

SEQ ID NO: 160530 - protein, 9 aa, Homo Sapiens
HYYQKALEL

SEQ ID NO: 160531 - protein, 9 aa, Homo Sapiens
HYYSITINY

SEQ ID NO: 160532 - protein, 9 aa, Homo Sapiens
IDKTMLASL

SEQ ID NO: 160533 - protein, 9 aa, Homo Sapiens
IFEGGATEL

SEQ ID NO: 160534 - protein, 9 aa, Homo Sapiens
IFFPGVSEF

SEQ ID NO: 160535 - protein, 9 aa, Homo Sapiens
IFIDEIDSF

SEQ ID NO: 160536 - protein, 9 aa, Homo Sapiens
IFIDEIDSI

SEQ ID NO: 160537 - protein, 9 aa, Homo Sapiens
IFIDEVDSL

SEQ ID NO: 160538 - protein, 9 aa, Homo Sapiens
IFIKDSNSL

SEQ ID NO: 160539 - protein, 9 aa, Homo Sapiens
IFIPKTEEM

SEQ ID NO: 160540 - protein, 9 aa, Homo Sapiens
IFIPSSIAF

SEQ ID NO: 160541 - protein, 9 aa, Homo Sapiens
IFMDEIDSI

SEQ ID NO: 160542 - protein, 9 aa, Homo Sapiens
IFMENRNEF

SEQ ID NO: 160543 - protein, 9 aa, Homo Sapiens
IFNTVNTSL

SEQ ID NO: 160544 - protein, 9 aa, Homo Sapiens
IFNVAGYSH

SEQ ID NO: 160545 - protein, 9 aa, Homo Sapiens
IFPAKTITY

SEQ ID NO: 160546 - protein, 9 aa, Homo Sapiens
IFPDRATLY

SEQ ID NO: 160547 - protein, 9 aa, Homo Sapiens
IFPECPHVY

SEQ ID NO: 160548 - protein, 9 aa, Homo Sapiens
IFPEFLKEL

SEQ ID NO: 160549 - protein, 9 aa, Homo Sapiens
IFPEGFVEL

SEQ ID NO: 160550 - protein, 9 aa, Homo Sapiens
IFPLIYSEM

SEQ ID NO: 160551 - protein, 9 aa, Homo Sapiens
IFPNQTEEL

SEQ ID NO: 160552 - protein, 9 aa, Homo Sapiens
IFPPSGMEY

SEQ ID NO: 160553 - protein, 9 aa, Homo Sapiens
IFPSSISAM

SEQ ID NO: 160554 - protein, 9 aa, Homo Sapiens
IFPTLTSPL

SEQ ID NO: 160555 - protein, 9 aa, Homo Sapiens
IFQDPRSWF

SEQ ID NO: 160556 - protein, 9 aa, Homo Sapiens
IFQGNVHNF

SEQ ID NO: 160557 - protein, 9 aa, Homo Sapiens
IFQIGVLGF

SEQ ID NO: 160558 - protein, 9 aa, Homo Sapiens
IFQIHTSRM

SEQ ID NO: 160559 - protein, 9 aa, Homo Sapiens
IFQNIKQEY

SEQ ID NO: 160560 - protein, 9 aa, Homo Sapiens
IFQPHVRHL

SEQ ID NO: 160561 - protein, 9 aa, Homo Sapiens
IFQTAKETL

SEQ ID NO: 160562 - protein, 9 aa, Homo Sapiens
IFQTGLVAY

SEQ ID NO: 160563 - protein, 9 aa, Homo Sapiens
IFSIREVSF

SEQ ID NO: 160564 - protein, 9 aa, Homo Sapiens
IFVVASSSY

SEQ ID NO: 160565 - protein, 9 aa, Homo Sapiens
IFYDRAEYL

SEQ ID NO: 160566 - protein, 9 aa, Homo Sapiens
IWPEKVLDI

SEQ ID NO: 160567 - protein, 9 aa, Homo Sapiens
IWPLYLRFL

SEQ ID NO: 160568 - protein, 9 aa, Homo Sapiens
IWVDYINFL

SEQ ID NO: 160569 - protein, 9 aa, Homo Sapiens
IYADYARSL

SEQ ID NO: 160570 - protein, 9 aa, Homo Sapiens
IYAVNGIAF

SEQ ID NO: 160571 - protein, 9 aa, Homo Sapiens
IYELMQTEF

SEQ ID NO: 160572 - protein, 9 aa, Homo Sapiens
IYFDSSATY

SEQ ID NO: 160573 - protein, 9 aa, Homo Sapiens
IYFEYSHAF

SEQ ID NO: 160574 - protein, 9 aa, Homo Sapiens
IYFTRIIAF

SEQ ID NO: 160575 - protein, 9 aa, Homo Sapiens
IYHNGVLEF

SEQ ID NO: 160576 - protein, 9 aa, Homo Sapiens
IYIDGVQEV

SEQ ID NO: 160577 - protein, 9 aa, Homo Sapiens
IYIDRGVVF

SEQ ID NO: 160578 - protein, 9 aa, Homo Sapiens
IYIINVHSM

SEQ ID NO: 160579 - protein, 9 aa, Homo Sapiens
IYLDSVMCL

SEQ ID NO: 160580 - protein, 9 aa, Homo Sapiens
IYLEGKIDY

SEQ ID NO: 160581 - protein, 9 aa, Homo Sapiens
IYLIGHVAA

SEQ ID NO: 160582 - protein, 9 aa, Homo Sapiens
IYLIKGSAL

SEQ ID NO: 160583 - protein, 9 aa, Homo Sapiens
IYLNHIEPL

SEQ ID NO: 160584 - protein, 9 aa, Homo Sapiens
IYLPAAQTM

SEQ ID NO: 160585 - protein, 9 aa, Homo Sapiens
IYMDSGMSL

SEQ ID NO: 160586 - protein, 9 aa, Homo Sapiens
IYMDTLNIF

SEQ ID NO: 160587 - protein, 9 aa, Homo Sapiens
IYMGHVKGY

SEQ ID NO: 160588 - protein, 9 aa, Homo Sapiens
IYMQKVIYY

SEQ ID NO: 160589 - protein, 9 aa, Homo Sapiens
IYPDSFTVL

SEQ ID NO: 160590 - protein, 9 aa, Homo Sapiens
IYPEAVTMF

SEQ ID NO: 160591 - protein, 9 aa, Homo Sapiens
IYPETAAIL

SEQ ID NO: 160592 - protein, 9 aa, Homo Sapiens
IYPEVVHMF

SEQ ID NO: 160593 - protein, 9 aa, Homo Sapiens
IYPPEVAEF

SEQ ID NO: 160594 - protein, 9 aa, Homo Sapiens
IYPVNAISF

SEQ ID NO: 160595 - protein, 9 aa, Homo Sapiens
IYPYAAISY

SEQ ID NO: 160596 - protein, 9 aa, Homo Sapiens
IYQEKVLDL

SEQ ID NO: 160597 - protein, 9 aa, Homo Sapiens
IYQIHKEYL

SEQ ID NO: 160598 - protein, 9 aa, Homo Sapiens
IYQQIIQTY

SEQ ID NO: 160599 - protein, 9 aa, Homo Sapiens
IYQSKVREL

SEQ ID NO: 160600 - protein, 9 aa, Homo Sapiens
IYQSMPRML

SEQ ID NO: 160601 - protein, 9 aa, Homo Sapiens
IYQYMEEIY

SEQ ID NO: 160602 - protein, 9 aa, Homo Sapiens
IYQYVLNSM

SEQ ID NO: 160603 - protein, 9 aa, Homo Sapiens
IYSFHTLSF

SEQ ID NO: 160604 - protein, 9 aa, Homo Sapiens
IYVISAETF

SEQ ID NO: 160605 - protein, 9 aa, Homo Sapiens
IYVTGGYSY

SEQ ID NO: 160606 - protein, 9 aa, Homo Sapiens
IYWDGPLAL

SEQ ID NO: 160607 - protein, 9 aa, Homo Sapiens
IYYFAAVAH

SEQ ID NO: 160608 - protein, 9 aa, Homo Sapiens
IYYFKANVF

SEQ ID NO: 160609 - protein, 9 aa, Homo Sapiens
IYYQSPLSL

SEQ ID NO: 160610 - protein, 9 aa, Homo Sapiens
KFIDKQLEL

SEQ ID NO: 160611 - protein, 9 aa, Homo Sapiens
KFIDTTSKF

SEQ ID NO: 160612 - protein, 9 aa, Homo Sapiens
KFKEVGEAF

SEQ ID NO: 160613 - protein, 9 aa, Homo Sapiens
KFLAAGTHL

SEQ ID NO: 160614 - protein, 9 aa, Homo Sapiens
KFLASDVVF

SEQ ID NO: 160615 - protein, 9 aa, Homo Sapiens
KFLPDAQAL

SEQ ID NO: 160616 - protein, 9 aa, Homo Sapiens
KFLVAVESM

SEQ ID NO: 160617 - protein, 9 aa, Homo Sapiens
KFPAYERVL

SEQ ID NO: 160618 - protein, 9 aa, Homo Sapiens
KFPDSVEEL

SEQ ID NO: 160619 - protein, 9 aa, Homo Sapiens
KFPEIVAPL

SEQ ID NO: 160620 - protein, 9 aa, Homo Sapiens
KFPTSRLEM

SEQ ID NO: 160621 - protein, 9 aa, Homo Sapiens
KFQAMDISL

SEQ ID NO: 160622 - protein, 9 aa, Homo Sapiens
KFYATLVRY

SEQ ID NO: 160623 - protein, 9 aa, Homo Sapiens
KFYNAGLAY

SEQ ID NO: 160624 - protein, 9 aa, Homo Sapiens
KFYSVNVDY

SEQ ID NO: 160625 - protein, 9 aa, Homo Sapiens
KFYYSKIEY

SEQ ID NO: 160626 - protein, 9 aa, Homo Sapiens
KYAVQLVEM

SEQ ID NO: 160627 - protein, 9 aa, Homo Sapiens
KYFGRSLEL

SEQ ID NO: 160628 - protein, 9 aa, Homo Sapiens
KYIDFTSDY

SEQ ID NO: 160629 - protein, 9 aa, Homo Sapiens
KYIEGVSDF

SEQ ID NO: 160630 - protein, 9 aa, Homo Sapiens
KYIHSANVL

SEQ ID NO: 160631 - protein, 9 aa, Homo Sapiens
KYLALRIAL

SEQ ID NO: 160632 - protein, 9 aa, Homo Sapiens
KYLAVRLAL

SEQ ID NO: 160633 - protein, 9 aa, Homo Sapiens
KYLTSNVAY

SEQ ID NO: 160634 - protein, 9 aa, Homo Sapiens
KYMNNITYY

SEQ ID NO: 160635 - protein, 9 aa, Homo Sapiens
KYMYFTVVM

SEQ ID NO: 160636 - protein, 9 aa, Homo Sapiens
KYNIMLVRL

SEQ ID NO: 160637 - protein, 9 aa, Homo Sapiens
KYPASSSVF

SEQ ID NO: 160638 - protein, 9 aa, Homo Sapiens
KYPDYEVTW

SEQ ID NO: 160639 - protein, 9 aa, Homo Sapiens
KYPNFDVEY

SEQ ID NO: 160640 - protein, 9 aa, Homo Sapiens
KYQAQDNFM

SEQ ID NO: 160641 - protein, 9 aa, Homo Sapiens
KYQAVTATL

SEQ ID NO: 160642 - protein, 9 aa, Homo Sapiens
KYQEVTNNL

SEQ ID NO: 160643 - protein, 9 aa, Homo Sapiens
KYQIQQVDM

SEQ ID NO: 160644 - protein, 9 aa, Homo Sapiens
KYYFILSPY

SEQ ID NO: 160645 - protein, 9 aa, Homo Sapiens
LFAPYGTVM

SEQ ID NO: 160646 - protein, 9 aa, Homo Sapiens
LFEGRRIEF

SEQ ID NO: 160647 - protein, 9 aa, Homo Sapiens
LFFDSKQSL

SEQ ID NO: 160648 - protein, 9 aa, Homo Sapiens
LFHEVVQAF

SEQ ID NO: 160649 - protein, 9 aa, Homo Sapiens
LFHNAVSAY

SEQ ID NO: 160650 - protein, 9 aa, Homo Sapiens
LFHTIGVEF

SEQ ID NO: 160651 - protein, 9 aa, Homo Sapiens
LFIEHSVEV

SEQ ID NO: 160652 - protein, 9 aa, Homo Sapiens
LFIFSVANM

SEQ ID NO: 160653 - protein, 9 aa, Homo Sapiens
LFIPRETTY

SEQ ID NO: 160654 - protein, 9 aa, Homo Sapiens
LFIPRRAPF

SEQ ID NO: 160655 - protein, 9 aa, Homo Sapiens
LFLEKAMQL

SEQ ID NO: 160656 - protein, 9 aa, Homo Sapiens
LFLPTAAAY

SEQ ID NO: 160657 - protein, 9 aa, Homo Sapiens
LFMPRSTEF

SEQ ID NO: 160658 - protein, 9 aa, Homo Sapiens
LFMPSTSSM

SEQ ID NO: 160659 - protein, 9 aa, Homo Sapiens
LFMSSFQSY

SEQ ID NO: 160660 - protein, 9 aa, Homo Sapiens
LFPDTPLAL

SEQ ID NO: 160661 - protein, 9 aa, Homo Sapiens
LFPDVVNCM

SEQ ID NO: 160662 - protein, 9 aa, Homo Sapiens
LFPGKVHSL

SEQ ID NO: 160663 - protein, 9 aa, Homo Sapiens
LFPGPSKPF

SEQ ID NO: 160664 - protein, 9 aa, Homo Sapiens
LFQDKASEL

SEQ ID NO: 160665 - protein, 9 aa, Homo Sapiens
LFQHICTAY

SEQ ID NO: 160666 - protein, 9 aa, Homo Sapiens
LFYFSNEKY

SEQ ID NO: 160667 - protein, 9 aa, Homo Sapiens
LLPHYPNWF

SEQ ID NO: 160668 - protein, 9 aa, Homo Sapiens
LPINGNGKQ

SEQ ID NO: 160669 - protein, 9 aa, Homo Sapiens
LSWNKTVEL

SEQ ID NO: 160670 - protein, 9 aa, Homo Sapiens
LTTKRFLEL

SEQ ID NO: 160671 - protein, 9 aa, Homo Sapiens
LYAIRTQEY

SEQ ID NO: 160672 - protein, 9 aa, Homo Sapiens
LYFENAMRF

SEQ ID NO: 160673 - protein, 9 aa, Homo Sapiens
LYFGGAAAV

SEQ ID NO: 160674 - protein, 9 aa, Homo Sapiens
LYFIAPTGH

SEQ ID NO: 160675 - protein, 9 aa, Homo Sapiens
LYGPKYTFF

SEQ ID NO: 160676 - protein, 9 aa, Homo Sapiens
LYHFSSSEL

SEQ ID NO: 160677 - protein, 9 aa, Homo Sapiens
LYHGMALAL

SEQ ID NO: 160678 - protein, 9 aa, Homo Sapiens
LYHWSVESY

SEQ ID NO: 160679 - protein, 9 aa, Homo Sapiens
LYIHHAIDL

SEQ ID NO: 160680 - protein, 9 aa, Homo Sapiens
LYIQRTKSM

SEQ ID NO: 160681 - protein, 9 aa, Homo Sapiens
LYLPATTPY

SEQ ID NO: 160682 - protein, 9 aa, Homo Sapiens
LYLPMAQSV

SEQ ID NO: 160683 - protein, 9 aa, Homo Sapiens
LYLTSCVNY

SEQ ID NO: 160684 - protein, 9 aa, Homo Sapiens
LYNIMKEGL

SEQ ID NO: 160685 - protein, 9 aa, Homo Sapiens
LYPACLREM

SEQ ID NO: 160686 - protein, 9 aa, Homo Sapiens
LYPAVSAVY

SEQ ID NO: 160687 - protein, 9 aa, Homo Sapiens
LYPEYGAAF

SEQ ID NO: 160688 - protein, 9 aa, Homo Sapiens
LYQDFVRDY

SEQ ID NO: 160689 - protein, 9 aa, Homo Sapiens
LYQIQQVTM

SEQ ID NO: 160690 - protein, 9 aa, Homo Sapiens
LYQPSAESL

SEQ ID NO: 160691 - protein, 9 aa, Homo Sapiens
LYYIGGEVF

SEQ ID NO: 160692 - protein, 9 aa, Homo Sapiens
LYYNANRAF

SEQ ID NO: 160693 - protein, 9 aa, Homo Sapiens
LYYVGGEVY

SEQ ID NO: 160694 - protein, 9 aa, Homo Sapiens
MFCEKAMEL

SEQ ID NO: 160695 - protein, 9 aa, Homo Sapiens
MFFFSRLEY

SEQ ID NO: 160696 - protein, 9 aa, Homo Sapiens
MFYIAAVEK

SEQ ID NO: 160697 - protein, 9 aa, Homo Sapiens
MTQIMFETF

SEQ ID NO: 160698 - protein, 9 aa, Homo Sapiens
MYIARQLSF

SEQ ID NO: 160699 - protein, 9 aa, Homo Sapiens
MYPAFAEEY

SEQ ID NO: 160700 - protein, 9 aa, Homo Sapiens
MYPGIADRM

SEQ ID NO: 160701 - protein, 9 aa, Homo Sapiens
MYQDKLASL

SEQ ID NO: 160702 - protein, 9 aa, Homo Sapiens
MYSIMVHAL

SEQ ID NO: 160703 - protein, 9 aa, Homo Sapiens
NFFPSGIDF

SEQ ID NO: 160704 - protein, 9 aa, Homo Sapiens
NFFTKATPL

SEQ ID NO: 160705 - protein, 9 aa, Homo Sapiens
NFHGEWLEV

SEQ ID NO: 160706 - protein, 9 aa, Homo Sapiens
NFICPALEF

SEQ ID NO: 160707 - protein, 9 aa, Homo Sapiens
NFIEDVLGY

SEQ ID NO: 160708 - protein, 9 aa, Homo Sapiens
NFIEKVEAL

SEQ ID NO: 160709 - protein, 9 aa, Homo Sapiens
NFIPTGSAF

SEQ ID NO: 160710 - protein, 9 aa, Homo Sapiens
NFIRVLVSY

SEQ ID NO: 160711 - protein, 9 aa, Homo Sapiens
NFISGAGIL

SEQ ID NO: 160712 - protein, 9 aa, Homo Sapiens
NFITGVGIL

SEQ ID NO: 160713 - protein, 9 aa, Homo Sapiens
NFLALAREL

SEQ ID NO: 160714 - protein, 9 aa, Homo Sapiens
NFLAQTEAL

SEQ ID NO: 160715 - protein, 9 aa, Homo Sapiens
NFLGAENAF

SEQ ID NO: 160716 - protein, 9 aa, Homo Sapiens
NFLLHVTAL

SEQ ID NO: 160717 - protein, 9 aa, Homo Sapiens
NFLNMSRSM

SEQ ID NO: 160718 - protein, 9 aa, Homo Sapiens
NFLPEALDF

SEQ ID NO: 160719 - protein, 9 aa, Homo Sapiens
NFLSTLTSF

SEQ ID NO: 160720 - protein, 9 aa, Homo Sapiens
NFMLHLVSM

SEQ ID NO: 160721 - protein, 9 aa, Homo Sapiens
NFNMSVSSM

SEQ ID NO: 160722 - protein, 9 aa, Homo Sapiens
NFPEHIFPA

SEQ ID NO: 160723 - protein, 9 aa, Homo Sapiens
NFPGIVTSF

SEQ ID NO: 160724 - protein, 9 aa, Homo Sapiens
NFPIKARSL

SEQ ID NO: 160725 - protein, 9 aa, Homo Sapiens
NFPKVATSF

SEQ ID NO: 160726 - protein, 9 aa, Homo Sapiens
NFPNGVTDF

SEQ ID NO: 160727 - protein, 9 aa, Homo Sapiens
NFQAIRVTL

SEQ ID NO: 160728 - protein, 9 aa, Homo Sapiens
NFQAIVISL

SEQ ID NO: 160729 - protein, 9 aa, Homo Sapiens
NFQTAKEAL

SEQ ID NO: 160730 - protein, 9 aa, Homo Sapiens
NFYNFASSF

SEQ ID NO: 160731 - protein, 9 aa, Homo Sapiens
NFYSTEVSV

SEQ ID NO: 160732 - protein, 9 aa, Homo Sapiens
NYAEYQVCL

SEQ ID NO: 160733 - protein, 9 aa, Homo Sapiens
NYETMGRAL

SEQ ID NO: 160734 - protein, 9 aa, Homo Sapiens
NYFLRLCSF

SEQ ID NO: 160735 - protein, 9 aa, Homo Sapiens
NYFPGGVAL

SEQ ID NO: 160736 - protein, 9 aa, Homo Sapiens
NYHAMTEFL

SEQ ID NO: 160737 - protein, 9 aa, Homo Sapiens
NYHWQETAY

SEQ ID NO: 160738 - protein, 9 aa, Homo Sapiens
NYIDKVRFL

SEQ ID NO: 160739 - protein, 9 aa, Homo Sapiens
NYIEFTRIL

SEQ ID NO: 160740 - protein, 9 aa, Homo Sapiens
NYIEGTKML

SEQ ID NO: 160741 - protein, 9 aa, Homo Sapiens
NYIEKVVAI

SEQ ID NO: 160742 - protein, 9 aa, Homo Sapiens
NYIHVGAQL

SEQ ID NO: 160743 - protein, 9 aa, Homo Sapiens
NYIMQSHSL

SEQ ID NO: 160744 - protein, 9 aa, Homo Sapiens
NYIRDRLAL

SEQ ID NO: 160745 - protein, 9 aa, Homo Sapiens
NYMAHLVEV

SEQ ID NO: 160746 - protein, 9 aa, Homo Sapiens
NYMMRNAVL

SEQ ID NO: 160747 - protein, 9 aa, Homo Sapiens
NYNFQYISL

SEQ ID NO: 160748 - protein, 9 aa, Homo Sapiens
NYNPAQQAF

SEQ ID NO: 160749 - protein, 9 aa, Homo Sapiens
NYNTIFQYY

SEQ ID NO: 160750 - protein, 9 aa, Homo Sapiens
NYPAFMMEM

SEQ ID NO: 160751 - protein, 9 aa, Homo Sapiens
NYPGLSISL

SEQ ID NO: 160752 - protein, 9 aa, Homo Sapiens
NYPVTGLAF

SEQ ID NO: 160753 - protein, 9 aa, Homo Sapiens
NYQAYRSYL

SEQ ID NO: 160754 - protein, 9 aa, Homo Sapiens
NYQVQFVTL

SEQ ID NO: 160755 - protein, 9 aa, Homo Sapiens
NYVDLVSSL

SEQ ID NO: 160756 - protein, 9 aa, Homo Sapiens
NYVPEVSAL

SEQ ID NO: 160757 - protein, 9 aa, Homo Sapiens
NYYPGSLFL

SEQ ID NO: 160758 - protein, 9 aa, Homo Sapiens
NYYTPITPH

SEQ ID NO: 160759 - protein, 9 aa, Homo Sapiens
QFLRGARAM

SEQ ID NO: 160760 - protein, 9 aa, Homo Sapiens
QYFTARTSL

SEQ ID NO: 160761 - protein, 9 aa, Homo Sapiens
QYLELAHSL

SEQ ID NO: 160762 - protein, 9 aa, Homo Sapiens
QYPDFNNYL

SEQ ID NO: 160763 - protein, 9 aa, Homo Sapiens
QYPENILSF

SEQ ID NO: 160764 - protein, 9 aa, Homo Sapiens
QYPGSALAL

SEQ ID NO: 160765 - protein, 9 aa, Homo Sapiens
QYPWGVAEV

SEQ ID NO: 160766 - protein, 9 aa, Homo Sapiens
QYQPPAPAL

SEQ ID NO: 160767 - protein, 9 aa, Homo Sapiens
QYVIQLTSM

SEQ ID NO: 160768 - protein, 9 aa, Homo Sapiens
RFFAQSQSL

SEQ ID NO: 160769 - protein, 9 aa, Homo Sapiens
RFFDGAKDV

SEQ ID NO: 160770 - protein, 9 aa, Homo Sapiens
RFFTSSTSL

SEQ ID NO: 160771 - protein, 9 aa, Homo Sapiens
RFHEMHVAL

SEQ ID NO: 160772 - protein, 9 aa, Homo Sapiens
RFHTITTSY

SEQ ID NO: 160773 - protein, 9 aa, Homo Sapiens
RFIGATANF

SEQ ID NO: 160774 - protein, 9 aa, Homo Sapiens
RFIGAVNNM

SEQ ID NO: 160775 - protein, 9 aa, Homo Sapiens
RFIPSAYPY

SEQ ID NO: 160776 - protein, 9 aa, Homo Sapiens
RFIPYTEEF

SEQ ID NO: 160777 - protein, 9 aa, Homo Sapiens
RFLDKALEL

SEQ ID NO: 160778 - protein, 9 aa, Homo Sapiens
RFLENALAV

SEQ ID NO: 160779 - protein, 9 aa, Homo Sapiens
RFLYSNIAF

SEQ ID NO: 160780 - protein, 9 aa, Homo Sapiens
RFPDFVRDF

SEQ ID NO: 160781 - protein, 9 aa, Homo Sapiens
RFPDLTVEL

SEQ ID NO: 160782 - protein, 9 aa, Homo Sapiens
RFPDTVKQM

SEQ ID NO: 160783 - protein, 9 aa, Homo Sapiens
RFPEHVREI

SEQ ID NO: 160784 - protein, 9 aa, Homo Sapiens
RFPELSLAL

SEQ ID NO: 160785 - protein, 9 aa, Homo Sapiens
RFPNFTNQL

SEQ ID NO: 160786 - protein, 9 aa, Homo Sapiens
RFPQHYKSL

SEQ ID NO: 160787 - protein, 9 aa, Homo Sapiens
RFQDLIREL

SEQ ID NO: 160788 - protein, 9 aa, Homo Sapiens
RFQDQVLDL

SEQ ID NO: 160789 - protein, 9 aa, Homo Sapiens
RFQNYMVAL

SEQ ID NO: 160790 - protein, 9 aa, Homo Sapiens
RFSLNTVEL

SEQ ID NO: 160791 - protein, 9 aa, Homo Sapiens
RFYAFGRVF

SEQ ID NO: 160792 - protein, 9 aa, Homo Sapiens
RFYEGVVEL

SEQ ID NO: 160793 - protein, 9 aa, Homo Sapiens
RLPPYSSQL

SEQ ID NO: 160794 - protein, 9 aa, Homo Sapiens
RWPDYVREL

SEQ ID NO: 160795 - protein, 9 aa, Homo Sapiens
RYFGPAAAL

SEQ ID NO: 160796 - protein, 9 aa, Homo Sapiens
RYIGKTMDY

SEQ ID NO: 160797 - protein, 9 aa, Homo Sapiens
RYIPDAMNL

SEQ ID NO: 160798 - protein, 9 aa, Homo Sapiens
RYIPTAAAF

SEQ ID NO: 160799 - protein, 9 aa, Homo Sapiens
RYLEKCIAY

SEQ ID NO: 160800 - protein, 9 aa, Homo Sapiens
RYLGGSMDL

SEQ ID NO: 160801 - protein, 9 aa, Homo Sapiens
RYLGKVLEL

SEQ ID NO: 160802 - protein, 9 aa, Homo Sapiens
RYLSKVLEL

SEQ ID NO: 160803 - protein, 9 aa, Homo Sapiens
RYLTVAAVF

SEQ ID NO: 160804 - protein, 9 aa, Homo Sapiens
RYLYMVMEY

SEQ ID NO: 160805 - protein, 9 aa, Homo Sapiens
RYMAFAHDL

SEQ ID NO: 160806 - protein, 9 aa, Homo Sapiens
RYMNHMQSL

SEQ ID NO: 160807 - protein, 9 aa, Homo Sapiens
RYMVHLLEL

SEQ ID NO: 160808 - protein, 9 aa, Homo Sapiens
RYNVMHVAA

SEQ ID NO: 160809 - protein, 9 aa, Homo Sapiens
RYPDSILEH

SEQ ID NO: 160810 - protein, 9 aa, Homo Sapiens
RYPEETLSL

SEQ ID NO: 160811 - protein, 9 aa, Homo Sapiens
RYPTSIASL

SEQ ID NO: 160812 - protein, 9 aa, Homo Sapiens
RYQATGLHF

SEQ ID NO: 160813 - protein, 9 aa, Homo Sapiens
RYQDAIRVF

SEQ ID NO: 160814 - protein, 9 aa, Homo Sapiens
RYQEALSEL

SEQ ID NO: 160815 - protein, 9 aa, Homo Sapiens
RYQEFVRAL

SEQ ID NO: 160816 - protein, 9 aa, Homo Sapiens
RYQEKISAL

SEQ ID NO: 160817 - protein, 9 aa, Homo Sapiens
RYTVQFTTM

SEQ ID NO: 160818 - protein, 9 aa, Homo Sapiens
RYVAIARAL

SEQ ID NO: 160819 - protein, 9 aa, Homo Sapiens
RYVPRASYF

SEQ ID NO: 160820 - protein, 9 aa, Homo Sapiens
RYWNSYTEF

SEQ ID NO: 160821 - protein, 9 aa, Homo Sapiens
RYYAFDEAF

SEQ ID NO: 160822 - protein, 9 aa, Homo Sapiens
SFAAEAIAM

SEQ ID NO: 160823 - protein, 9 aa, Homo Sapiens
SFAAVIQAL

SEQ ID NO: 160824 - protein, 9 aa, Homo Sapiens
SFADFGSAL

SEQ ID NO: 160825 - protein, 9 aa, Homo Sapiens
SFFGAASQY

SEQ ID NO: 160826 - protein, 9 aa, Homo Sapiens
SFFGGSNPF

SEQ ID NO: 160827 - protein, 9 aa, Homo Sapiens
SFFPKVLEM

SEQ ID NO: 160828 - protein, 9 aa, Homo Sapiens
SFHAAGLQM

SEQ ID NO: 160829 - protein, 9 aa, Homo Sapiens
SFHHNVAAL

SEQ ID NO: 160830 - protein, 9 aa, Homo Sapiens
SFHTHVKEL

SEQ ID NO: 160831 - protein, 9 aa, Homo Sapiens
SFIAAGICF

SEQ ID NO: 160832 - protein, 9 aa, Homo Sapiens
SFIAFARVF

SEQ ID NO: 160833 - protein, 9 aa, Homo Sapiens
SFIENSSAL

SEQ ID NO: 160834 - protein, 9 aa, Homo Sapiens
SFIHAAMGM

SEQ ID NO: 160835 - protein, 9 aa, Homo Sapiens
SFILKANEL

SEQ ID NO: 160836 - protein, 9 aa, Homo Sapiens
SFIQGTTTM

SEQ ID NO: 160837 - protein, 9 aa, Homo Sapiens
SFISEAESL

SEQ ID NO: 160838 - protein, 9 aa, Homo Sapiens
SFISFANSR

SEQ ID NO: 160839 - protein, 9 aa, Homo Sapiens
SFISVIKEM

SEQ ID NO: 160840 - protein, 9 aa, Homo Sapiens
SFLAAAETL

SEQ ID NO: 160841 - protein, 9 aa, Homo Sapiens
SFLATGSNL

SEQ ID NO: 160842 - protein, 9 aa, Homo Sapiens
SFLATITSF

SEQ ID NO: 160843 - protein, 9 aa, Homo Sapiens
SFLDLARNI

SEQ ID NO: 160844 - protein, 9 aa, Homo Sapiens
SFLEDARAY

SEQ ID NO: 160845 - protein, 9 aa, Homo Sapiens
SFLEKTAVL

SEQ ID NO: 160846 - protein, 9 aa, Homo Sapiens
SFLETNVPL

SEQ ID NO: 160847 - protein, 9 aa, Homo Sapiens
SFLPSGSEM

SEQ ID NO: 160848 - protein, 9 aa, Homo Sapiens
SFMDPASAL

SEQ ID NO: 160849 - protein, 9 aa, Homo Sapiens
SFMDVSNPF

SEQ ID NO: 160850 - protein, 9 aa, Homo Sapiens
SFMEGAIIY

SEQ ID NO: 160851 - protein, 9 aa, Homo Sapiens
SFMGMVISH

SEQ ID NO: 160852 - protein, 9 aa, Homo Sapiens
SFMIMKTNF

SEQ ID NO: 160853 - protein, 9 aa, Homo Sapiens
SFMSGADSF

SEQ ID NO: 160854 - protein, 9 aa, Homo Sapiens
SFMYAHLAF

SEQ ID NO: 160855 - protein, 9 aa, Homo Sapiens
SFNKMSIEY

SEQ ID NO: 160856 - protein, 9 aa, Homo Sapiens
SFPAHRAVL

SEQ ID NO: 160857 - protein, 9 aa, Homo Sapiens
SFPENLRHL

SEQ ID NO: 160858 - protein, 9 aa, Homo Sapiens
SFPEVFTTY

SEQ ID NO: 160859 - protein, 9 aa, Homo Sapiens
SFPFVSKTL

SEQ ID NO: 160860 - protein, 9 aa, Homo Sapiens
SFPHMVLSL

SEQ ID NO: 160861 - protein, 9 aa, Homo Sapiens
SFPHPLPSL

SEQ ID NO: 160862 - protein, 9 aa, Homo Sapiens
SFPHTTPSM

SEQ ID NO: 160863 - protein, 9 aa, Homo Sapiens
SFPIFISAL

SEQ ID NO: 160864 - protein, 9 aa, Homo Sapiens
SFPQLRATM

SEQ ID NO: 160865 - protein, 9 aa, Homo Sapiens
SFPQPAAVY

SEQ ID NO: 160866 - protein, 9 aa, Homo Sapiens
SFPVNYKSL

SEQ ID NO: 160867 - protein, 9 aa, Homo Sapiens
SFQDFVSHF

SEQ ID NO: 160868 - protein, 9 aa, Homo Sapiens
SFQFAHLEF

SEQ ID NO: 160869 - protein, 9 aa, Homo Sapiens
SFQGMVTSF

SEQ ID NO: 160870 - protein, 9 aa, Homo Sapiens
SFSEFTSSL

SEQ ID NO: 160871 - protein, 9 aa, Homo Sapiens
SFSPGAGAF

SEQ ID NO: 160872 - protein, 9 aa, Homo Sapiens
SFVDQVREI

SEQ ID NO: 160873 - protein, 9 aa, Homo Sapiens
SFVDSVGVM

SEQ ID NO: 160874 - protein, 9 aa, Homo Sapiens
SFVIRALGF

SEQ ID NO: 160875 - protein, 9 aa, Homo Sapiens
SFVWHALDY

SEQ ID NO: 160876 - protein, 9 aa, Homo Sapiens
SLPAYLNSL

SEQ ID NO: 160877 - protein, 9 aa, Homo Sapiens
SMPLYAVMY

SEQ ID NO: 160878 - protein, 9 aa, Homo Sapiens
SPGAAVVML

SEQ ID NO: 160879 - protein, 9 aa, Homo Sapiens
SWPDGMLSM

SEQ ID NO: 160880 - protein, 9 aa, Homo Sapiens
SWPTYPQLY

SEQ ID NO: 160881 - protein, 9 aa, Homo Sapiens
SYENMVTEI

SEQ ID NO: 160882 - protein, 9 aa, Homo Sapiens
SYFGSFSSL

SEQ ID NO: 160883 - protein, 9 aa, Homo Sapiens
SYFMATNSL

SEQ ID NO: 160884 - protein, 9 aa, Homo Sapiens
SYFPKILTF

SEQ ID NO: 160885 - protein, 9 aa, Homo Sapiens
SYFSSTKTL

SEQ ID NO: 160886 - protein, 9 aa, Homo Sapiens
SYGAAGLAF

SEQ ID NO: 160887 - protein, 9 aa, Homo Sapiens
SYHPSGLSL

SEQ ID NO: 160888 - protein, 9 aa, Homo Sapiens
SYHSYVIGF

SEQ ID NO: 160889 - protein, 9 aa, Homo Sapiens
SYIAMDTEF

SEQ ID NO: 160890 - protein, 9 aa, Homo Sapiens
SYIIGTSSV

SEQ ID NO: 160891 - protein, 9 aa, Homo Sapiens
SYISEVKEV

SEQ ID NO: 160892 - protein, 9 aa, Homo Sapiens
SYIYGAQHL

SEQ ID NO: 160893 - protein, 9 aa, Homo Sapiens
SYLDFTNPK

SEQ ID NO: 160894 - protein, 9 aa, Homo Sapiens
SYLFSHVPL

SEQ ID NO: 160895 - protein, 9 aa, Homo Sapiens
SYLIARIAL

SEQ ID NO: 160896 - protein, 9 aa, Homo Sapiens
SYLITSVEL

SEQ ID NO: 160897 - protein, 9 aa, Homo Sapiens
SYLPEAGQY

SEQ ID NO: 160898 - protein, 9 aa, Homo Sapiens
SYLPHAPPF

SEQ ID NO: 160899 - protein, 9 aa, Homo Sapiens
SYLPLAHMF

SEQ ID NO: 160900 - protein, 9 aa, Homo Sapiens
SYLTSASSL

SEQ ID NO: 160901 - protein, 9 aa, Homo Sapiens
SYMDPMNEY

SEQ ID NO: 160902 - protein, 9 aa, Homo Sapiens
SYMESVVTF

SEQ ID NO: 160903 - protein, 9 aa, Homo Sapiens
SYMPTVSHL

SEQ ID NO: 160904 - protein, 9 aa, Homo Sapiens
SYMWTINNF

SEQ ID NO: 160905 - protein, 9 aa, Homo Sapiens
SYNDYLRAA

SEQ ID NO: 160906 - protein, 9 aa, Homo Sapiens
SYNDYVREF

SEQ ID NO: 160907 - protein, 9 aa, Homo Sapiens
SYNLTVREL

SEQ ID NO: 160908 - protein, 9 aa, Homo Sapiens
SYPDAILQA

SEQ ID NO: 160909 - protein, 9 aa, Homo Sapiens
SYPDFLRMM

SEQ ID NO: 160910 - protein, 9 aa, Homo Sapiens
SYPDNFLHI

SEQ ID NO: 160911 - protein, 9 aa, Homo Sapiens
SYPFDFLEF

SEQ ID NO: 160912 - protein, 9 aa, Homo Sapiens
SYPHHATQL

SEQ ID NO: 160913 - protein, 9 aa, Homo Sapiens
SYPLFSQEF

SEQ ID NO: 160914 - protein, 9 aa, Homo Sapiens
SYPSVVSTL

SEQ ID NO: 160915 - protein, 9 aa, Homo Sapiens
SYQDLVKCF

SEQ ID NO: 160916 - protein, 9 aa, Homo Sapiens
SYQEHVKQL

SEQ ID NO: 160917 - protein, 9 aa, Homo Sapiens
SYQILTRQL

SEQ ID NO: 160918 - protein, 9 aa, Homo Sapiens
SYSSIASEF

SEQ ID NO: 160919 - protein, 9 aa, Homo Sapiens
SYYAVAHAV

SEQ ID NO: 160920 - protein, 9 aa, Homo Sapiens
SYYAYVVEL

SEQ ID NO: 160921 - protein, 9 aa, Homo Sapiens
SYYEEALEL

SEQ ID NO: 160922 - protein, 9 aa, Homo Sapiens
SYYKDALRF

SEQ ID NO: 160923 - protein, 9 aa, Homo Sapiens
SYYSPSIGF

SEQ ID NO: 160924 - protein, 9 aa, Homo Sapiens
SYYTVAHAI

SEQ ID NO: 160925 - protein, 9 aa, Homo Sapiens
TFGERVVAF

SEQ ID NO: 160926 - protein, 9 aa, Homo Sapiens
TFIDDISAY

SEQ ID NO: 160927 - protein, 9 aa, Homo Sapiens
TFIDPRIPL

SEQ ID NO: 160928 - protein, 9 aa, Homo Sapiens
TFINNVISH

SEQ ID NO: 160929 - protein, 9 aa, Homo Sapiens
TFLEAGVEM

SEQ ID NO: 160930 - protein, 9 aa, Homo Sapiens
TFMPVASGL

SEQ ID NO: 160931 - protein, 9 aa, Homo Sapiens
TFNEDVQAL

SEQ ID NO: 160932 - protein, 9 aa, Homo Sapiens
TFNNPTTEF

SEQ ID NO: 160933 - protein, 9 aa, Homo Sapiens
TFPDIIRNY

SEQ ID NO: 160934 - protein, 9 aa, Homo Sapiens
TFPLQVLGF

SEQ ID NO: 160935 - protein, 9 aa, Homo Sapiens
TFPMQCSAL

SEQ ID NO: 160936 - protein, 9 aa, Homo Sapiens
TFPSDITEF

SEQ ID NO: 160937 - protein, 9 aa, Homo Sapiens
TFQDKTLNF

SEQ ID NO: 160938 - protein, 9 aa, Homo Sapiens
TFQSRTLAL

SEQ ID NO: 160939 - protein, 9 aa, Homo Sapiens
TLPHEILEM

SEQ ID NO: 160940 - protein, 9 aa, Homo Sapiens
TWPDGWTAV

SEQ ID NO: 160941 - protein, 9 aa, Homo Sapiens
TYFIVGTAM

SEQ ID NO: 160942 - protein, 9 aa, Homo Sapiens
TYGERVVAF

SEQ ID NO: 160943 - protein, 9 aa, Homo Sapiens
TYIGSVEPL

SEQ ID NO: 160944 - protein, 9 aa, Homo Sapiens
TYINHVVSV

SEQ ID NO: 160945 - protein, 9 aa, Homo Sapiens
TYLGVAASL

SEQ ID NO: 160946 - protein, 9 aa, Homo Sapiens
TYLPAGQSV

SEQ ID NO: 160947 - protein, 9 aa, Homo Sapiens
TYLQTMVFY

SEQ ID NO: 160948 - protein, 9 aa, Homo Sapiens
TYMAMYLTY

SEQ ID NO: 160949 - protein, 9 aa, Homo Sapiens
TYNTQVNFM

SEQ ID NO: 160950 - protein, 9 aa, Homo Sapiens
TYPAGFMDV

SEQ ID NO: 160951 - protein, 9 aa, Homo Sapiens
TYPPYVPEY

SEQ ID NO: 160952 - protein, 9 aa, Homo Sapiens
TYPSLPKSL

SEQ ID NO: 160953 - protein, 9 aa, Homo Sapiens
TYPSNILSH

SEQ ID NO: 160954 - protein, 9 aa, Homo Sapiens
TYQAMVHEL

SEQ ID NO: 160955 - protein, 9 aa, Homo Sapiens
TYQKLARAL

SEQ ID NO: 160956 - protein, 9 aa, Homo Sapiens
TYQRSVLAL

SEQ ID NO: 160957 - protein, 9 aa, Homo Sapiens
TYQVLAVTF

SEQ ID NO: 160958 - protein, 9 aa, Homo Sapiens
TYQVQKLSL

SEQ ID NO: 160959 - protein, 9 aa, Homo Sapiens
TYQVYGLAL

SEQ ID NO: 160960 - protein, 9 aa, Homo Sapiens
TYSEFAREL

SEQ ID NO: 160961 - protein, 9 aa, Homo Sapiens
TYVTEVREL

SEQ ID NO: 160962 - protein, 9 aa, Homo Sapiens
TYVTPRRPF

SEQ ID NO: 160963 - protein, 9 aa, Homo Sapiens
VANTMRTSL

SEQ ID NO: 160964 - protein, 9 aa, Homo Sapiens
VAPEEHPVL

SEQ ID NO: 160965 - protein, 9 aa, Homo Sapiens
VAYVSSVAL

SEQ ID NO: 160966 - protein, 9 aa, Homo Sapiens
VFAPPAEAY

SEQ ID NO: 160967 - protein, 9 aa, Homo Sapiens
VFHVSNLEF

SEQ ID NO: 160968 - protein, 9 aa, Homo Sapiens
VFIDEIDAI

SEQ ID NO: 160969 - protein, 9 aa, Homo Sapiens
VFIDGPLAL

SEQ ID NO: 160970 - protein, 9 aa, Homo Sapiens
VFLEAAKAL

SEQ ID NO: 160971 - protein, 9 aa, Homo Sapiens
VFLERGEVM

SEQ ID NO: 160972 - protein, 9 aa, Homo Sapiens
VFLLDLGKV

SEQ ID NO: 160973 - protein, 9 aa, Homo Sapiens
VFLPRALAL

SEQ ID NO: 160974 - protein, 9 aa, Homo Sapiens
VFLPRVTEL

SEQ ID NO: 160975 - protein, 9 aa, Homo Sapiens
VFMHVSTAY

SEQ ID NO: 160976 - protein, 9 aa, Homo Sapiens
VFMISSHEL

SEQ ID NO: 160977 - protein, 9 aa, Homo Sapiens
VFMPHVTEA

SEQ ID NO: 160978 - protein, 9 aa, Homo Sapiens
VFPDFYLHL

SEQ ID NO: 160979 - protein, 9 aa, Homo Sapiens
VFPEFAAAH

SEQ ID NO: 160980 - protein, 9 aa, Homo Sapiens
VFPEKGYSF

SEQ ID NO: 160981 - protein, 9 aa, Homo Sapiens
VFPKPVTAL

SEQ ID NO: 160982 - protein, 9 aa, Homo Sapiens
VFPLAAGIF

SEQ ID NO: 160983 - protein, 9 aa, Homo Sapiens
VFPLFSSEL

SEQ ID NO: 160984 - protein, 9 aa, Homo Sapiens
VFPTRTARF

SEQ ID NO: 160985 - protein, 9 aa, Homo Sapiens
VFPWHKNLL

SEQ ID NO: 160986 - protein, 9 aa, Homo Sapiens
VFQERINCL

SEQ ID NO: 160987 - protein, 9 aa, Homo Sapiens
VFQEVGINY

SEQ ID NO: 160988 - protein, 9 aa, Homo Sapiens
VFQPETSTL

SEQ ID NO: 160989 - protein, 9 aa, Homo Sapiens
VFQPSVKSL

SEQ ID NO: 160990 - protein, 9 aa, Homo Sapiens
VFQPSVRSL

SEQ ID NO: 160991 - protein, 9 aa, Homo Sapiens
VFQQVGVSM

SEQ ID NO: 160992 - protein, 9 aa, Homo Sapiens
VFQVKTLSL

SEQ ID NO: 160993 - protein, 9 aa, Homo Sapiens
VFQYRLVEY

SEQ ID NO: 160994 - protein, 9 aa, Homo Sapiens
VFSDGAVSL

SEQ ID NO: 160995 - protein, 9 aa, Homo Sapiens
VFSVRGTSF

SEQ ID NO: 160996 - protein, 9 aa, Homo Sapiens
VFVDRAACF

SEQ ID NO: 160997 - protein, 9 aa, Homo Sapiens
VFVDRAGEW

SEQ ID NO: 160998 - protein, 9 aa, Homo Sapiens
VFVDRTLDL

SEQ ID NO: 160999 - protein, 9 aa, Homo Sapiens
VFVEATHVL

SEQ ID NO: 161000 - protein, 9 aa, Homo Sapiens
VFVEDVDSF

SEQ ID NO: 161001 - protein, 9 aa, Homo Sapiens
VFVVDSAAF

SEQ ID NO: 161002 - protein, 9 aa, Homo Sapiens
VFYELAHQL

SEQ ID NO: 161003 - protein, 9 aa, Homo Sapiens
VFYPSSLAF

SEQ ID NO: 161004 - protein, 9 aa, Homo Sapiens
VFYPYPQYF

SEQ ID NO: 161005 - protein, 9 aa, Homo Sapiens
VLPVYMNCL

SEQ ID NO: 161006 - protein, 9 aa, Homo Sapiens
VMINKATPY

SEQ ID NO: 161007 - protein, 9 aa, Homo Sapiens
VVNIQTIAM

SEQ ID NO: 161008 - protein, 9 aa, Homo Sapiens
VVVDVSHED

SEQ ID NO: 161009 - protein, 9 aa, Homo Sapiens
VYAFSARPL

SEQ ID NO: 161010 - protein, 9 aa, Homo Sapiens
VYALQQTAL

SEQ ID NO: 161011 - protein, 9 aa, Homo Sapiens
VYEGEVTEL

SEQ ID NO: 161012 - protein, 9 aa, Homo Sapiens
VYFASLLTV

SEQ ID NO: 161013 - protein, 9 aa, Homo Sapiens
VYFGIAASL

SEQ ID NO: 161014 - protein, 9 aa, Homo Sapiens
VYFPALTSL

SEQ ID NO: 161015 - protein, 9 aa, Homo Sapiens
VYFPWVSQY

SEQ ID NO: 161016 - protein, 9 aa, Homo Sapiens
VYFQMQTTY

SEQ ID NO: 161017 - protein, 9 aa, Homo Sapiens
VYFSAAHAL

SEQ ID NO: 161018 - protein, 9 aa, Homo Sapiens
VYFTQGLGL

SEQ ID NO: 161019 - protein, 9 aa, Homo Sapiens
VYFVQKNSL

SEQ ID NO: 161020 - protein, 9 aa, Homo Sapiens
VYHEILIGY

SEQ ID NO: 161021 - protein, 9 aa, Homo Sapiens
VYHVVGVDV

SEQ ID NO: 161022 - protein, 9 aa, Homo Sapiens
VYIDKVRSL

SEQ ID NO: 161023 - protein, 9 aa, Homo Sapiens
VYIDQTMVL

SEQ ID NO: 161024 - protein, 9 aa, Homo Sapiens
VYIDRVRSL

SEQ ID NO: 161025 - protein, 9 aa, Homo Sapiens
VYIEHRLMM

SEQ ID NO: 161026 - protein, 9 aa, Homo Sapiens
VYIGVHVPF

SEQ ID NO: 161027 - protein, 9 aa, Homo Sapiens
VYINTAQEF

SEQ ID NO: 161028 - protein, 9 aa, Homo Sapiens
VYIPFSAIY

SEQ ID NO: 161029 - protein, 9 aa, Homo Sapiens
VYISNGQVL

SEQ ID NO: 161030 - protein, 9 aa, Homo Sapiens
VYISSRPPL

SEQ ID NO: 161031 - protein, 9 aa, Homo Sapiens
VYLERLLTY

SEQ ID NO: 161032 - protein, 9 aa, Homo Sapiens
VYLFTEAYY

SEQ ID NO: 161033 - protein, 9 aa, Homo Sapiens
VYLPMSYCY

SEQ ID NO: 161034 - protein, 9 aa, Homo Sapiens
VYLPTHTSL

SEQ ID NO: 161035 - protein, 9 aa, Homo Sapiens
VYLYYKLAY

SEQ ID NO: 161036 - protein, 9 aa, Homo Sapiens
VYMNRVKEI

SEQ ID NO: 161037 - protein, 9 aa, Homo Sapiens
VYNFSLVAL

SEQ ID NO: 161038 - protein, 9 aa, Homo Sapiens
VYNVQYSFI

SEQ ID NO: 161039 - protein, 9 aa, Homo Sapiens
VYNVTQHAV

SEQ ID NO: 161040 - protein, 9 aa, Homo Sapiens
VYNYAEQTL

SEQ ID NO: 161041 - protein, 9 aa, Homo Sapiens
VYPDGIRHI

SEQ ID NO: 161042 - protein, 9 aa, Homo Sapiens
VYPEYVIQY

SEQ ID NO: 161043 - protein, 9 aa, Homo Sapiens
VYPLYTIVF

SEQ ID NO: 161044 - protein, 9 aa, Homo Sapiens
VYPMPRVIF

SEQ ID NO: 161045 - protein, 9 aa, Homo Sapiens
VYPPGFMGL

SEQ ID NO: 161046 - protein, 9 aa, Homo Sapiens
VYPPPHQVF

SEQ ID NO: 161047 - protein, 9 aa, Homo Sapiens
VYPQYVIEY

SEQ ID NO: 161048 - protein, 9 aa, Homo Sapiens
VYPTAVHVL

SEQ ID NO: 161049 - protein, 9 aa, Homo Sapiens
VYQEIWIGM

SEQ ID NO: 161050 - protein, 9 aa, Homo Sapiens
VYQIAMVHY

SEQ ID NO: 161051 - protein, 9 aa, Homo Sapiens
VYQNIFTAM

SEQ ID NO: 161052 - protein, 9 aa, Homo Sapiens
VYQNQIAEL

SEQ ID NO: 161053 - protein, 9 aa, Homo Sapiens
VYQTYVNAM

SEQ ID NO: 161054 - protein, 9 aa, Homo Sapiens
VYQYMHETI

SEQ ID NO: 161055 - protein, 9 aa, Homo Sapiens
VYSNPVSSL

SEQ ID NO: 161056 - protein, 9 aa, Homo Sapiens
VYVAAVREF

SEQ ID NO: 161057 - protein, 9 aa, Homo Sapiens
VYVERAEVL

SEQ ID NO: 161058 - protein, 9 aa, Homo Sapiens
VYVKHSISF

SEQ ID NO: 161059 - protein, 9 aa, Homo Sapiens
VYVMGGVAM

SEQ ID NO: 161060 - protein, 9 aa, Homo Sapiens
VYVVGTAHF

SEQ ID NO: 161061 - protein, 9 aa, Homo Sapiens
VYWVARKPM

SEQ ID NO: 161062 - protein, 9 aa, Homo Sapiens
VYYEVAGHL

SEQ ID NO: 161063 - protein, 9 aa, Homo Sapiens
VYYFSKGTL

SEQ ID NO: 161064 - protein, 9 aa, Homo Sapiens
VYYPELFVW

SEQ ID NO: 161065 - protein, 9 aa, Homo Sapiens
WFHYTLVAF

SEQ ID NO: 161066 - protein, 9 aa, Homo Sapiens
WFIPFVQSL

SEQ ID NO: 161067 - protein, 9 aa, Homo Sapiens
WYQRVYQSL

SEQ ID NO: 161068 - protein, 9 aa, Homo Sapiens
WYYSTKVQL

SEQ ID NO: 161069 - protein, 9 aa, Homo Sapiens
YFADGVLSL

SEQ ID NO: 161070 - protein, 9 aa, Homo Sapiens
YFEDVANAM

SEQ ID NO: 161071 - protein, 9 aa, Homo Sapiens
YFEGGVSSV

SEQ ID NO: 161072 - protein, 9 aa, Homo Sapiens
YFFAVDTAY

SEQ ID NO: 161073 - protein, 9 aa, Homo Sapiens
YFHDATRVY

SEQ ID NO: 161074 - protein, 9 aa, Homo Sapiens
YFHDRFLEL

SEQ ID NO: 161075 - protein, 9 aa, Homo Sapiens
YFHDRVASF

SEQ ID NO: 161076 - protein, 9 aa, Homo Sapiens
YFHEFGHVM

SEQ ID NO: 161077 - protein, 9 aa, Homo Sapiens
YFHIGSNAL

SEQ ID NO: 161078 - protein, 9 aa, Homo Sapiens
YFHTMVESL

SEQ ID NO: 161079 - protein, 9 aa, Homo Sapiens
YFILNSSCL

SEQ ID NO: 161080 - protein, 9 aa, Homo Sapiens
YFIRDVKSL

SEQ ID NO: 161081 - protein, 9 aa, Homo Sapiens
YFISHILAF

SEQ ID NO: 161082 - protein, 9 aa, Homo Sapiens
YFISYGIEH

SEQ ID NO: 161083 - protein, 9 aa, Homo Sapiens
YFIVTRQDY

SEQ ID NO: 161084 - protein, 9 aa, Homo Sapiens
YFKPMMKEF

SEQ ID NO: 161085 - protein, 9 aa, Homo Sapiens
YFLEWRSVL

SEQ ID NO: 161086 - protein, 9 aa, Homo Sapiens
YFLNRKLVY

SEQ ID NO: 161087 - protein, 9 aa, Homo Sapiens
YFLPLANTL

SEQ ID NO: 161088 - protein, 9 aa, Homo Sapiens
YFLSRAQSL

SEQ ID NO: 161089 - protein, 9 aa, Homo Sapiens
YFLTTRQTL

SEQ ID NO: 161090 - protein, 9 aa, Homo Sapiens
YFPDKVALL

SEQ ID NO: 161091 - protein, 9 aa, Homo Sapiens
YFPELIANF

SEQ ID NO: 161092 - protein, 9 aa, Homo Sapiens
YFPGQAIAM

SEQ ID NO: 161093 - protein, 9 aa, Homo Sapiens
YFPHYEVPL

SEQ ID NO: 161094 - protein, 9 aa, Homo Sapiens
YFPKALAPL

SEQ ID NO: 161095 - protein, 9 aa, Homo Sapiens
YFPKKISEL

SEQ ID NO: 161096 - protein, 9 aa, Homo Sapiens
YFPTQALNF

SEQ ID NO: 161097 - protein, 9 aa, Homo Sapiens
YFQAKIRAL

SEQ ID NO: 161098 - protein, 9 aa, Homo Sapiens
YFQALVNNM

SEQ ID NO: 161099 - protein, 9 aa, Homo Sapiens
YFQHREFSF

SEQ ID NO: 161100 - protein, 9 aa, Homo Sapiens
YFQTTSTNL

SEQ ID NO: 161101 - protein, 9 aa, Homo Sapiens
YFVDDRLVM

SEQ ID NO: 161102 - protein, 9 aa, Homo Sapiens
YFWPRTVPM

SEQ ID NO: 161103 - protein, 9 aa, Homo Sapiens
YFYVIGSSY

SEQ ID NO: 161104 - protein, 9 aa, Homo Sapiens
YLHPLRSLF

SEQ ID NO: 161105 - protein, 9 aa, Homo Sapiens
YMNVMLENY

SEQ ID NO: 161106 - protein, 9 aa, Homo Sapiens
YMPAKIGAF

SEQ ID NO: 161107 - protein, 9 aa, Homo Sapiens
YMPQNPHII

SEQ ID NO: 161108 - protein, 9 aa, Homo Sapiens
YWPDVIHSF

SEQ ID NO: 161109 - protein, 9 aa, Homo Sapiens
YYEFREEAY

SEQ ID NO: 161110 - protein, 9 aa, Homo Sapiens
YYFALAHTV

SEQ ID NO: 161111 - protein, 9 aa, Homo Sapiens
YYFDSYAHF

SEQ ID NO: 161112 - protein, 9 aa, Homo Sapiens
YYFDYKEQL

SEQ ID NO: 161113 - protein, 9 aa, Homo Sapiens
YYFFTPYVY

SEQ ID NO: 161114 - protein, 9 aa, Homo Sapiens
YYFSKLIEF

SEQ ID NO: 161115 - protein, 9 aa, Homo Sapiens
YYFVFDHAL

SEQ ID NO: 161116 - protein, 9 aa, Homo Sapiens
YYFVTREVM

SEQ ID NO: 161117 - protein, 9 aa, Homo Sapiens
YYHARVYEF

SEQ ID NO: 161118 - protein, 9 aa, Homo Sapiens
YYHSYWHSM

SEQ ID NO: 161119 - protein, 9 aa, Homo Sapiens
YYHYSYSVV

SEQ ID NO: 161120 - protein, 9 aa, Homo Sapiens
YYIDCIRQV

SEQ ID NO: 161121 - protein, 9 aa, Homo Sapiens
YYIEGINQL

SEQ ID NO: 161122 - protein, 9 aa, Homo Sapiens
YYINIRKAL

SEQ ID NO: 161123 - protein, 9 aa, Homo Sapiens
YYISPRITF

SEQ ID NO: 161124 - protein, 9 aa, Homo Sapiens
YYITTRAQF

SEQ ID NO: 161125 - protein, 9 aa, Homo Sapiens
YYITTRVQF

SEQ ID NO: 161126 - protein, 9 aa, Homo Sapiens
YYKNIGLGF

SEQ ID NO: 161127 - protein, 9 aa, Homo Sapiens
YYLARLLGL

SEQ ID NO: 161128 - protein, 9 aa, Homo Sapiens
YYLGKILEM

SEQ ID NO: 161129 - protein, 9 aa, Homo Sapiens
YYLNEIQSF

SEQ ID NO: 161130 - protein, 9 aa, Homo Sapiens
YYLPKDDEY

SEQ ID NO: 161131 - protein, 9 aa, Homo Sapiens
YYLPKLLSY

SEQ ID NO: 161132 - protein, 9 aa, Homo Sapiens
YYLTFVQEL

SEQ ID NO: 161133 - protein, 9 aa, Homo Sapiens
YYLTHGLYL

SEQ ID NO: 161134 - protein, 9 aa, Homo Sapiens
YYLVKREDY

SEQ ID NO: 161135 - protein, 9 aa, Homo Sapiens
YYLWMLHSV

SEQ ID NO: 161136 - protein, 9 aa, Homo Sapiens
YYMDYLAAL

SEQ ID NO: 161137 - protein, 9 aa, Homo Sapiens
YYNLQGISH

SEQ ID NO: 161138 - protein, 9 aa, Homo Sapiens
YYPAKIEAI

SEQ ID NO: 161139 - protein, 9 aa, Homo Sapiens
YYPEHTSVL

SEQ ID NO: 161140 - protein, 9 aa, Homo Sapiens
YYPELAFQF

SEQ ID NO: 161141 - protein, 9 aa, Homo Sapiens
YYPEYLINL

SEQ ID NO: 161142 - protein, 9 aa, Homo Sapiens
YYPFHYAPF

SEQ ID NO: 161143 - protein, 9 aa, Homo Sapiens
YYPQQAIVF

SEQ ID NO: 161144 - protein, 9 aa, Homo Sapiens
YYPSDVSSL

SEQ ID NO: 161145 - protein, 9 aa, Homo Sapiens
YYPYTITEY

SEQ ID NO: 161146 - protein, 9 aa, Homo Sapiens
YYQDTPKQI

SEQ ID NO: 161147 - protein, 9 aa, Homo Sapiens
YYQHIVTTL

SEQ ID NO: 161148 - protein, 9 aa, Homo Sapiens
YYQLMKTAL

SEQ ID NO: 161149 - protein, 9 aa, Homo Sapiens
YYQNHIMNL

SEQ ID NO: 161150 - protein, 9 aa, Homo Sapiens
YYQPLVHLL

SEQ ID NO: 161151 - protein, 9 aa, Homo Sapiens
YYQSSVQYL

SEQ ID NO: 161152 - protein, 9 aa, Homo Sapiens
YYQTPRLWL

SEQ ID NO: 161153 - protein, 9 aa, Homo Sapiens
YYQYMETYM

SEQ ID NO: 161154 - protein, 9 aa, Homo Sapiens
YYRDYPTLV

SEQ ID NO: 161155 - protein, 9 aa, Homo Sapiens
YYSPHGHIL

SEQ ID NO: 161156 - protein, 9 aa, Homo Sapiens
YYTDFVMEL

SEQ ID NO: 161157 - protein, 9 aa, Homo Sapiens
YYTVRQLEL

SEQ ID NO: 161158 - protein, 9 aa, Homo Sapiens
YYVRKVLEL

SEQ ID NO: 161159 - protein, 9 aa, Homo Sapiens
YYVWTVKEV

SEQ ID NO: 161160 - protein, 9 aa, Homo Sapiens
YYYDKNIIH

SEQ ID NO: 161161 - protein, 9 aa, Homo Sapiens
YYYDPTTGL

SEQ ID NO: 161162 - protein, 9 aa, Homo Sapiens
YYYNGKAVY

SEQ ID NO: 161163 - protein, 10 aa, Homo Sapiens
AFFEEERSAL

SEQ ID NO: 161164 - protein, 10 aa, Homo Sapiens
AFFPGFPLAL

SEQ ID NO: 161165 - protein, 10 aa, Homo Sapiens
AFFTSKALNM

SEQ ID NO: 161166 - protein, 10 aa, Homo Sapiens
AFPEIHVAQY

SEQ ID NO: 161167 - protein, 10 aa, Homo Sapiens
AFPGGPLGAL

SEQ ID NO: 161168 - protein, 10 aa, Homo Sapiens
AFVDKPVSPY

SEQ ID NO: 161169 - protein, 10 aa, Homo Sapiens
AFVTFSTRAM

SEQ ID NO: 161170 - protein, 10 aa, Homo Sapiens
AFVTFTTRAM

SEQ ID NO: 161171 - protein, 10 aa, Homo Sapiens
AFYDWDNTEL

SEQ ID NO: 161172 - protein, 10 aa, Homo Sapiens
AFYEHAQTYY

SEQ ID NO: 161173 - protein, 10 aa, Homo Sapiens
AFYMDTSHLF

SEQ ID NO: 161174 - protein, 10 aa, Homo Sapiens
AWIDAEVTEF

SEQ ID NO: 161175 - protein, 10 aa, Homo Sapiens
AYIDPIAMEY

SEQ ID NO: 161176 - protein, 10 aa, Homo Sapiens
AYMDAPKAAL

SEQ ID NO: 161177 - protein, 10 aa, Homo Sapiens
AYMELVNNML

SEQ ID NO: 161178 - protein, 10 aa, Homo Sapiens
AYPDFAPQKF

SEQ ID NO: 161179 - protein, 10 aa, Homo Sapiens
AYYEFREEAY

SEQ ID NO: 161180 - protein, 10 aa, Homo Sapiens
AYYLGKILEM

SEQ ID NO: 161181 - protein, 10 aa, Homo Sapiens
AYYPSDVSSL

SEQ ID NO: 161182 - protein, 10 aa, Homo Sapiens
FFFDSAMESY

SEQ ID NO: 161183 - protein, 10 aa, Homo Sapiens
FFFGKSTLPF

SEQ ID NO: 161184 - protein, 10 aa, Homo Sapiens
FFFPTQGHDY

SEQ ID NO: 161185 - protein, 10 aa, Homo Sapiens
FFFTARTSFF

SEQ ID NO: 161186 - protein, 10 aa, Homo Sapiens
FFFTGPLSHF

SEQ ID NO: 161187 - protein, 10 aa, Homo Sapiens
FFPDKPITQY

SEQ ID NO: 161188 - protein, 10 aa, Homo Sapiens
FFPEAAQVAY

SEQ ID NO: 161189 - protein, 10 aa, Homo Sapiens
FFPEYTHQLF

SEQ ID NO: 161190 - protein, 10 aa, Homo Sapiens
FFPSTFQPSY

SEQ ID NO: 161191 - protein, 10 aa, Homo Sapiens
FFPYYVYNII

SEQ ID NO: 161192 - protein, 10 aa, Homo Sapiens
FFQETKTGEL

SEQ ID NO: 161193 - protein, 10 aa, Homo Sapiens
FFYDGIKAIF

SEQ ID NO: 161194 - protein, 10 aa, Homo Sapiens
FFYEGSRVLF

SEQ ID NO: 161195 - protein, 10 aa, Homo Sapiens
FFYNEHTNDF

SEQ ID NO: 161196 - protein, 10 aa, Homo Sapiens
FFYNLIHPEY

SEQ ID NO: 161197 - protein, 10 aa, Homo Sapiens
FHPEAHAITL

SEQ ID NO: 161198 - protein, 10 aa, Homo Sapiens
FLPARFYQAL

SEQ ID NO: 161199 - protein, 10 aa, Homo Sapiens
FLPEEAWCDL

SEQ ID NO: 161200 - protein, 10 aa, Homo Sapiens
FYADFGPLNL

SEQ ID NO: 161201 - protein, 10 aa, Homo Sapiens
FYFDNILNSF

SEQ ID NO: 161202 - protein, 10 aa, Homo Sapiens
FYFDRDDVAL

SEQ ID NO: 161203 - protein, 10 aa, Homo Sapiens
FYFWPRTVPM

SEQ ID NO: 161204 - protein, 10 aa, Homo Sapiens
FYHLGVRESF

SEQ ID NO: 161205 - protein, 10 aa, Homo Sapiens
FYNQVSTPLL

SEQ ID NO: 161206 - protein, 10 aa, Homo Sapiens
FYPEELDQLL

SEQ ID NO: 161207 - protein, 10 aa, Homo Sapiens
FYPGASPTEF

SEQ ID NO: 161208 - protein, 10 aa, Homo Sapiens
FYPGWKVLVF

SEQ ID NO: 161209 - protein, 10 aa, Homo Sapiens
FYPIYFRPLM

SEQ ID NO: 161210 - protein, 10 aa, Homo Sapiens
FYQDTFGQQW

SEQ ID NO: 161211 - protein, 10 aa, Homo Sapiens
FYTPQNPSSL

SEQ ID NO: 161212 - protein, 10 aa, Homo Sapiens
FYYDGKVMKL

SEQ ID NO: 161213 - protein, 10 aa, Homo Sapiens
FYYFPDSGFF

SEQ ID NO: 161214 - protein, 10 aa, Homo Sapiens
GGYDGYRPSF

SEQ ID NO: 161215 - protein, 10 aa, Homo Sapiens
HFFEFLTKEL

SEQ ID NO: 161216 - protein, 10 aa, Homo Sapiens
HFGGGGFLAF

SEQ ID NO: 161217 - protein, 10 aa, Homo Sapiens
HFIGNCVSSF

SEQ ID NO: 161218 - protein, 10 aa, Homo Sapiens
HFPSNLVTEM

SEQ ID NO: 161219 - protein, 10 aa, Homo Sapiens
HFSVEGQLEF

SEQ ID NO: 161220 - protein, 10 aa, Homo Sapiens
IFIDRDPAAF

SEQ ID NO: 161221 - protein, 10 aa, Homo Sapiens
IFIDRDPTVF

SEQ ID NO: 161222 - protein, 10 aa, Homo Sapiens
IFLDSKGLEY

SEQ ID NO: 161223 - protein, 10 aa, Homo Sapiens
IFQELVEGVF

SEQ ID NO: 161224 - protein, 10 aa, Homo Sapiens
IWPNARISVM

SEQ ID NO: 161225 - protein, 10 aa, Homo Sapiens
IYFAPMADSL

SEQ ID NO: 161226 - protein, 10 aa, Homo Sapiens
IYFDHDLQSY

SEQ ID NO: 161227 - protein, 10 aa, Homo Sapiens
IYLPGRPTSM

SEQ ID NO: 161228 - protein, 10 aa, Homo Sapiens
IYMEPEKQVM

SEQ ID NO: 161229 - protein, 10 aa, Homo Sapiens
IYPGYHQSSY

SEQ ID NO: 161230 - protein, 10 aa, Homo Sapiens
IYQEGWRTVF

SEQ ID NO: 161231 - protein, 10 aa, Homo Sapiens
IYTDYRPTPL

SEQ ID NO: 161232 - protein, 10 aa, Homo Sapiens
IYYTGKYQSL

SEQ ID NO: 161233 - protein, 10 aa, Homo Sapiens
KYYDEIINAL

SEQ ID NO: 161234 - protein, 10 aa, Homo Sapiens
KYYDKLFKEY

SEQ ID NO: 161235 - protein, 10 aa, Homo Sapiens
KYYDKNAIAI

SEQ ID NO: 161236 - protein, 10 aa, Homo Sapiens
LFPEGPARAF

SEQ ID NO: 161237 - protein, 10 aa, Homo Sapiens
LFPELPKSAL

SEQ ID NO: 161238 - protein, 10 aa, Homo Sapiens
LFPEPEHSSF

SEQ ID NO: 161239 - protein, 10 aa, Homo Sapiens
LFPEYKNNKL

SEQ ID NO: 161240 - protein, 10 aa, Homo Sapiens
LYPENIVPSF

SEQ ID NO: 161241 - protein, 10 aa, Homo Sapiens
LYPEVPPEEF

SEQ ID NO: 161242 - protein, 10 aa, Homo Sapiens
MFPEHAVKAY

SEQ ID NO: 161243 - protein, 10 aa, Homo Sapiens
MMPPMGGPPM

SEQ ID NO: 161244 - protein, 10 aa, Homo Sapiens
MYKYPSDISY

SEQ ID NO: 161245 - protein, 10 aa, Homo Sapiens
NFPEHIFPAL

SEQ ID NO: 161246 - protein, 10 aa, Homo Sapiens
NFYEGHITSL

SEQ ID NO: 161247 - protein, 10 aa, Homo Sapiens
NFYGDLRKAL

SEQ ID NO: 161248 - protein, 10 aa, Homo Sapiens
NYIDLPVLAI

SEQ ID NO: 161249 - protein, 10 aa, Homo Sapiens
NYIDRFLSSM

SEQ ID NO: 161250 - protein, 10 aa, Homo Sapiens
NYYDLVRTEI

SEQ ID NO: 161251 - protein, 10 aa, Homo Sapiens
NYYNKVSTVF

SEQ ID NO: 161252 - protein, 10 aa, Homo Sapiens
NYYPYTITEY

SEQ ID NO: 161253 - protein, 10 aa, Homo Sapiens
PEVKFNWYVD

SEQ ID NO: 161254 - protein, 10 aa, Homo Sapiens
QFYDNKGITY

SEQ ID NO: 161255 - protein, 10 aa, Homo Sapiens
QYYIFIPSKF

SEQ ID NO: 161256 - protein, 10 aa, Homo Sapiens
QYYNGKIHAY

SEQ ID NO: 161257 - protein, 10 aa, Homo Sapiens
RFFDTNTSVL

SEQ ID NO: 161258 - protein, 10 aa, Homo Sapiens
RFIDDVVSAV

SEQ ID NO: 161259 - protein, 10 aa, Homo Sapiens
RFIDISPAEM

SEQ ID NO: 161260 - protein, 10 aa, Homo Sapiens
RFPDQPFIAL

SEQ ID NO: 161261 - protein, 10 aa, Homo Sapiens
RFPEELTQTF

SEQ ID NO: 161262 - protein, 10 aa, Homo Sapiens
RFPGQLNADL

SEQ ID NO: 161263 - protein, 10 aa, Homo Sapiens
RFPNFTNQLL

SEQ ID NO: 161264 - protein, 10 aa, Homo Sapiens
RFQEADSPTL

SEQ ID NO: 161265 - protein, 10 aa, Homo Sapiens
RFVEVGRVAY

SEQ ID NO: 161266 - protein, 10 aa, Homo Sapiens
RLMVHTVATF

SEQ ID NO: 161267 - protein, 10 aa, Homo Sapiens
RSNFGYNIPL

SEQ ID NO: 161268 - protein, 10 aa, Homo Sapiens
RYIMGSGESF

SEQ ID NO: 161269 - protein, 10 aa, Homo Sapiens
RYMELYTHVY

SEQ ID NO: 161270 - protein, 10 aa, Homo Sapiens
RYPDIQASYL

SEQ ID NO: 161271 - protein, 10 aa, Homo Sapiens
RYPGYMNNDL

SEQ ID NO: 161272 - protein, 10 aa, Homo Sapiens
SFFDNISSEL

SEQ ID NO: 161273 - protein, 10 aa, Homo Sapiens
SFFGETSHNY

SEQ ID NO: 161274 - protein, 10 aa, Homo Sapiens
SFMQHDVQEL

SEQ ID NO: 161275 - protein, 10 aa, Homo Sapiens
SFPDDATSPL

SEQ ID NO: 161276 - protein, 10 aa, Homo Sapiens
SFPEHRVLSF

SEQ ID NO: 161277 - protein, 10 aa, Homo Sapiens
SFPKYKPSSL

SEQ ID NO: 161278 - protein, 10 aa, Homo Sapiens
SFYEKGPLTF

SEQ ID NO: 161279 - protein, 10 aa, Homo Sapiens
SFYNLLTRTF

SEQ ID NO: 161280 - protein, 10 aa, Homo Sapiens
SFYPEEVSSM

SEQ ID NO: 161281 - protein, 10 aa, Homo Sapiens
SFYTAIAQAF

SEQ ID NO: 161282 - protein, 10 aa, Homo Sapiens
SWPTYPQLYV

SEQ ID NO: 161283 - protein, 10 aa, Homo Sapiens
SYFDAIPVTM

SEQ ID NO: 161284 - protein, 10 aa, Homo Sapiens
SYFDRYRDSF

SEQ ID NO: 161285 - protein, 10 aa, Homo Sapiens
SYFEIPTKEF

SEQ ID NO: 161286 - protein, 10 aa, Homo Sapiens
SYFEKETLTF

SEQ ID NO: 161287 - protein, 10 aa, Homo Sapiens
SYFEKGPLTF

SEQ ID NO: 161288 - protein, 10 aa, Homo Sapiens
SYIDRLISVF

SEQ ID NO: 161289 - protein, 10 aa, Homo Sapiens
SYPAAVPQAL

SEQ ID NO: 161290 - protein, 10 aa, Homo Sapiens
SYQIPTENSM

SEQ ID NO: 161291 - protein, 10 aa, Homo Sapiens
SYQSYQSPTM

SEQ ID NO: 161292 - protein, 10 aa, Homo Sapiens
SYVNLPTIAL

SEQ ID NO: 161293 - protein, 10 aa, Homo Sapiens
SYYGNRAATL

SEQ ID NO: 161294 - protein, 10 aa, Homo Sapiens
TYIGYLPLAH

SEQ ID NO: 161295 - protein, 10 aa, Homo Sapiens
TYLETKGAAL

SEQ ID NO: 161296 - protein, 10 aa, Homo Sapiens
TYPEFLANAL

SEQ ID NO: 161297 - protein, 10 aa, Homo Sapiens
VFINVPTVSF

SEQ ID NO: 161298 - protein, 10 aa, Homo Sapiens
VFITDKISSF

SEQ ID NO: 161299 - protein, 10 aa, Homo Sapiens
VFMPHVTEAY

SEQ ID NO: 161300 - protein, 10 aa, Homo Sapiens
VFPPLTQRTY

SEQ ID NO: 161301 - protein, 10 aa, Homo Sapiens
VFYPGETVVH

SEQ ID NO: 161302 - protein, 10 aa, Homo Sapiens
VLPHQPLATY

SEQ ID NO: 161303 - protein, 10 aa, Homo Sapiens
VYFAERVTSL

SEQ ID NO: 161304 - protein, 10 aa, Homo Sapiens
VYFHTLTSEY

SEQ ID NO: 161305 - protein, 10 aa, Homo Sapiens
VYIGYLPLAH

SEQ ID NO: 161306 - protein, 10 aa, Homo Sapiens
VYMTEPIDEY

SEQ ID NO: 161307 - protein, 10 aa, Homo Sapiens
VYPNFRPTPK

SEQ ID NO: 161308 - protein, 10 aa, Homo Sapiens
VYYVGVASCL

SEQ ID NO: 161309 - protein, 10 aa, Homo Sapiens
YFADRLYDSM

SEQ ID NO: 161310 - protein, 10 aa, Homo Sapiens
YFFDNDSKSF

SEQ ID NO: 161311 - protein, 10 aa, Homo Sapiens
YFHDGVRVAA

SEQ ID NO: 161312 - protein, 10 aa, Homo Sapiens
YFHDRVASFY

SEQ ID NO: 161313 - protein, 10 aa, Homo Sapiens
YFIAPSGHGL

SEQ ID NO: 161314 - protein, 10 aa, Homo Sapiens
YFIAPTGHSL

SEQ ID NO: 161315 - protein, 10 aa, Homo Sapiens
YFINGDISSL

SEQ ID NO: 161316 - protein, 10 aa, Homo Sapiens
YFIPATGHSL

SEQ ID NO: 161317 - protein, 10 aa, Homo Sapiens
YFIPFLPLEY

SEQ ID NO: 161318 - protein, 10 aa, Homo Sapiens
YFISHVLAFF

SEQ ID NO: 161319 - protein, 10 aa, Homo Sapiens
YFISPTGHSL

SEQ ID NO: 161320 - protein, 10 aa, Homo Sapiens
YFITPTGHSL

SEQ ID NO: 161321 - protein, 10 aa, Homo Sapiens
YFLDKAAEQL

SEQ ID NO: 161322 - protein, 10 aa, Homo Sapiens
YFPDYSIGNL

SEQ ID NO: 161323 - protein, 10 aa, Homo Sapiens
YFPEEKFESL

SEQ ID NO: 161324 - protein, 10 aa, Homo Sapiens
YFPEMQILAV

SEQ ID NO: 161325 - protein, 10 aa, Homo Sapiens
YFYDDVTTLY

SEQ ID NO: 161326 - protein, 10 aa, Homo Sapiens
YFYDPDVGNF

SEQ ID NO: 161327 - protein, 10 aa, Homo Sapiens
YFYDRRRIYL

SEQ ID NO: 161328 - protein, 10 aa, Homo Sapiens
YFYPFPVPPL

SEQ ID NO: 161329 - protein, 10 aa, Homo Sapiens
YFYPYGLQTF

SEQ ID NO: 161330 - protein, 10 aa, Homo Sapiens
YLPDFRFTPF

SEQ ID NO: 161331 - protein, 10 aa, Homo Sapiens
YLPENQVLPH

SEQ ID NO: 161332 - protein, 10 aa, Homo Sapiens
YLPNQLFRTF

SEQ ID NO: 161333 - protein, 10 aa, Homo Sapiens
YMIDPSGVSY

SEQ ID NO: 161334 - protein, 10 aa, Homo Sapiens
YWPEGKRVAM

SEQ ID NO: 161335 - protein, 10 aa, Homo Sapiens
YWPHQPIENL

SEQ ID NO: 161336 - protein, 10 aa, Homo Sapiens
YWPTYTPMEV

SEQ ID NO: 161337 - protein, 10 aa, Homo Sapiens
YWPTYVPMEV

SEQ ID NO: 161338 - protein, 10 aa, Homo Sapiens
YYDPLAGTYY

SEQ ID NO: 161339 - protein, 10 aa, Homo Sapiens
YYFDRDDVAL

SEQ ID NO: 161340 - protein, 10 aa, Homo Sapiens
YYFEGIKQTF

SEQ ID NO: 161341 - protein, 10 aa, Homo Sapiens
YYFNRKTFSF

SEQ ID NO: 161342 - protein, 10 aa, Homo Sapiens
YYIDDVFHAL

SEQ ID NO: 161343 - protein, 10 aa, Homo Sapiens
YYINYTTIEL

SEQ ID NO: 161344 - protein, 10 aa, Homo Sapiens
YYIPEITSVL

SEQ ID NO: 161345 - protein, 10 aa, Homo Sapiens
YYIQNGIQSF

SEQ ID NO: 161346 - protein, 10 aa, Homo Sapiens
YYLQHPPISF

SEQ ID NO: 161347 - protein, 10 aa, Homo Sapiens
YYLQIHPQEL

SEQ ID NO: 161348 - protein, 10 aa, Homo Sapiens
YYPAQGVQQF

SEQ ID NO: 161349 - protein, 10 aa, Homo Sapiens
YYPPSQIAQL

SEQ ID NO: 161350 - protein, 10 aa, Homo Sapiens
YYRYPTGESY

SEQ ID NO: 161351 - protein, 10 aa, Homo Sapiens
YYVDTAVRHV

SEQ ID NO: 161352 - protein, 10 aa, Homo Sapiens
YYYDGDIGNY

SEQ ID NO: 161353 - protein, 10 aa, Homo Sapiens
YYYDGDVGNY

SEQ ID NO: 161354 - protein, 10 aa, Homo Sapiens
YYYDPLAGTY

SEQ ID NO: 161355 - protein, 10 aa, Homo Sapiens
YYYDPQTGLY

SEQ ID NO: 161356 - protein, 10 aa, Homo Sapiens
YYYDPTTGLY

SEQ ID NO: 161357 - protein, 10 aa, Homo Sapiens
YYYDTHTNTY

SEQ ID NO: 161358 - protein, 10 aa, Homo Sapiens
YYYHARVYEF

SEQ ID NO: 161359 - protein, 10 aa, Homo Sapiens
YYYNGKAVYA

SEQ ID NO: 161360 - protein, 11 aa, Homo Sapiens
APTHGSILIEC

SEQ ID NO: 161361 - protein, 11 aa, Homo Sapiens
AYMELQQKAEF

SEQ ID NO: 161362 - protein, 11 aa, Homo Sapiens
AYYPAQGVQQF

SEQ ID NO: 161363 - protein, 11 aa, Homo Sapiens
FYIDPYKLLPL

SEQ ID NO: 161364 - protein, 11 aa, Homo Sapiens
FYNTAQSPSAL

SEQ ID NO: 161365 - protein, 11 aa, Homo Sapiens
FYQDTFGQQWK

SEQ ID NO: 161366 - protein, 11 aa, Homo Sapiens
FYVDSDMVNEF

SEQ ID NO: 161367 - protein, 11 aa, Homo Sapiens
FYYLGSGRETF

SEQ ID NO: 161368 - protein, 11 aa, Homo Sapiens
FYYNTSEQNVM

SEQ ID NO: 161369 - protein, 11 aa, Homo Sapiens
HFIQAGLLSAL

SEQ ID NO: 161370 - protein, 11 aa, Homo Sapiens
HYMNPYQLNAY

SEQ ID NO: 161371 - protein, 11 aa, Homo Sapiens
IECLPTSGHLS

SEQ ID NO: 161372 - protein, 11 aa, Homo Sapiens
IFFFGTHETAF

SEQ ID NO: 161373 - protein, 11 aa, Homo Sapiens
IYALNENVSSF

SEQ ID NO: 161374 - protein, 11 aa, Homo Sapiens
IYIDRHVMQPY

SEQ ID NO: 161375 - protein, 11 aa, Homo Sapiens
IYMERAEDLPL

SEQ ID NO: 161376 - protein, 11 aa, Homo Sapiens
KYMPSVKVSVF

SEQ ID NO: 161377 - protein, 11 aa, Homo Sapiens
KYPKGAGRVAF

SEQ ID NO: 161378 - protein, 11 aa, Homo Sapiens
NYPDYMPSNIF

SEQ ID NO: 161379 - protein, 11 aa, Homo Sapiens
RDPNHGLYPKP

SEQ ID NO: 161380 - protein, 11 aa, Homo Sapiens
RYINPAKLTPY

SEQ ID NO: 161381 - protein, 11 aa, Homo Sapiens
SFFDATDRVSF

SEQ ID NO: 161382 - protein, 11 aa, Homo Sapiens
SFPTTKTYFPH

SEQ ID NO: 161383 - protein, 11 aa, Homo Sapiens
SYIFPSSISAM

SEQ ID NO: 161384 - protein, 11 aa, Homo Sapiens
SYYGPLNLLTF

SEQ ID NO: 161385 - protein, 11 aa, Homo Sapiens
SYYPAENLIEY

SEQ ID NO: 161386 - protein, 11 aa, Homo Sapiens
TYMPSVSLQSL

SEQ ID NO: 161387 - protein, 11 aa, Homo Sapiens
VFQEPSLLSSL

SEQ ID NO: 161388 - protein, 11 aa, Homo Sapiens
VYFKGKWKTPF

SEQ ID NO: 161389 - protein, 11 aa, Homo Sapiens
VYQSLCPTSWV

SEQ ID NO: 161390 - protein, 11 aa, Homo Sapiens
YFYDVEALRDY

SEQ ID NO: 161391 - protein, 11 aa, Homo Sapiens
YYALCGFGGVL

SEQ ID NO: 161392 - protein, 11 aa, Homo Sapiens
YYDGDIGNYYY

SEQ ID NO: 161393 - protein, 11 aa, Homo Sapiens
YYDGDVGNYYY

SEQ ID NO: 161394 - protein, 11 aa, Homo Sapiens
YYFAQQNSGHF

SEQ ID NO: 161395 - protein, 11 aa, Homo Sapiens
YYFDAAEAEAW

SEQ ID NO: 161396 - protein, 11 aa, Homo Sapiens
YYFDNVSSTEL

SEQ ID NO: 161397 - protein, 11 aa, Homo Sapiens
YYIDADLLREI

SEQ ID NO: 161398 - protein, 11 aa, Homo Sapiens
YYIGDIHPSDL

SEQ ID NO: 161399 - protein, 11 aa, Homo Sapiens
YYIPGQGRSTY

SEQ ID NO: 161400 - protein, 11 aa, Homo Sapiens
YYITNDTVQTY

SEQ ID NO: 161401 - protein, 11 aa, Homo Sapiens
YYLNEQGDRVY

SEQ ID NO: 161402 - protein, 11 aa, Homo Sapiens
YYPGFNPFRAY

SEQ ID NO: 161403 - protein, 11 aa, Homo Sapiens
YYYDGDIGNYY

SEQ ID NO: 161404 - protein, 11 aa, Homo Sapiens
YYYDPLAGTYY

SEQ ID NO: 161405 - protein, 11 aa, Homo Sapiens
YYYDPQEEVYL

SEQ ID NO: 161406 - protein, 11 aa, Homo Sapiens
YYYDPQTGLYY

SEQ ID NO: 161407 - protein, 11 aa, Homo Sapiens
YYYDPTTGLYY

SEQ ID NO: 161408 - protein, 11 aa, Homo Sapiens
YYYDTHTNTYY

SEQ ID NO: 161409 - protein, 8 aa, Homo Sapiens
AFFTGQIF

SEQ ID NO: 161410 - protein, 8 aa, Homo Sapiens
AFFTSKAL

SEQ ID NO: 161411 - protein, 8 aa, Homo Sapiens
AFGTRDAL

SEQ ID NO: 161412 - protein, 8 aa, Homo Sapiens
AFGVGSEL

SEQ ID NO: 161413 - protein, 8 aa, Homo Sapiens
AFHTASVL

SEQ ID NO: 161414 - protein, 8 aa, Homo Sapiens
AFIERLEM

SEQ ID NO: 161415 - protein, 8 aa, Homo Sapiens
AFKNRMEV

SEQ ID NO: 161416 - protein, 8 aa, Homo Sapiens
AFLCGRAL

SEQ ID NO: 161417 - protein, 8 aa, Homo Sapiens
AFLNNQEY

SEQ ID NO: 161418 - protein, 8 aa, Homo Sapiens
AFLTGVGL

SEQ ID NO: 161419 - protein, 8 aa, Homo Sapiens
AFMAAESL

SEQ ID NO: 161420 - protein, 8 aa, Homo Sapiens
AFMEGIAL

SEQ ID NO: 161421 - protein, 8 aa, Homo Sapiens
AFNIAEAF

SEQ ID NO: 161422 - protein, 8 aa, Homo Sapiens
AFNISSNL

SEQ ID NO: 161423 - protein, 8 aa, Homo Sapiens
AFNVSSHL

SEQ ID NO: 161424 - protein, 8 aa, Homo Sapiens
AFQAALAL

SEQ ID NO: 161425 - protein, 8 aa, Homo Sapiens
AFQISKEY

SEQ ID NO: 161426 - protein, 8 aa, Homo Sapiens
AFQNVLTH

SEQ ID NO: 161427 - protein, 8 aa, Homo Sapiens
AFSVRSSL

SEQ ID NO: 161428 - protein, 8 aa, Homo Sapiens
AFTNRIFF

SEQ ID NO: 161429 - protein, 8 aa, Homo Sapiens
ATAEGALK

SEQ ID NO: 161430 - protein, 8 aa, Homo Sapiens
ATQVGIEW

SEQ ID NO: 161431 - protein, 8 aa, Homo Sapiens
AYFDVKEY

SEQ ID NO: 161432 - protein, 8 aa, Homo Sapiens
AYFEGHHL

SEQ ID NO: 161433 - protein, 8 aa, Homo Sapiens
AYFTAAQL

SEQ ID NO: 161434 - protein, 8 aa, Homo Sapiens
AYFTHSNL

SEQ ID NO: 161435 - protein, 8 aa, Homo Sapiens
AYGKGTYF

SEQ ID NO: 161436 - protein, 8 aa, Homo Sapiens
AYGLSREV

SEQ ID NO: 161437 - protein, 8 aa, Homo Sapiens
AYLEALSH

SEQ ID NO: 161438 - protein, 8 aa, Homo Sapiens
AYLIVKEL

SEQ ID NO: 161439 - protein, 8 aa, Homo Sapiens
AYLNVVGM

SEQ ID NO: 161440 - protein, 8 aa, Homo Sapiens
AYLQRIAL

SEQ ID NO: 161441 - protein, 8 aa, Homo Sapiens
AYLVRWEY

SEQ ID NO: 161442 - protein, 8 aa, Homo Sapiens
AYMNHIMV

SEQ ID NO: 161443 - protein, 8 aa, Homo Sapiens
AYNLHSAY

SEQ ID NO: 161444 - protein, 8 aa, Homo Sapiens
AYQDRLAY

SEQ ID NO: 161445 - protein, 8 aa, Homo Sapiens
AYQIAEQF

SEQ ID NO: 161446 - protein, 8 aa, Homo Sapiens
AYQLAFRY

SEQ ID NO: 161447 - protein, 8 aa, Homo Sapiens
AYQLGSVY

SEQ ID NO: 161448 - protein, 8 aa, Homo Sapiens
AYQSVRIL

SEQ ID NO: 161449 - protein, 8 aa, Homo Sapiens
AYQVGAVL

SEQ ID NO: 161450 - protein, 8 aa, Homo Sapiens
AYQYQNIF

SEQ ID NO: 161451 - protein, 8 aa, Homo Sapiens
AYSIRGQL

SEQ ID NO: 161452 - protein, 8 aa, Homo Sapiens
AYVSGLSF

SEQ ID NO: 161453 - protein, 8 aa, Homo Sapiens
AYYAGHVL

SEQ ID NO: 161454 - protein, 8 aa, Homo Sapiens
CSGTVEVR

SEQ ID NO: 161455 - protein, 8 aa, Homo Sapiens
DFFNGKEL

SEQ ID NO: 161456 - protein, 8 aa, Homo Sapiens
FFANHPDL

SEQ ID NO: 161457 - protein, 8 aa, Homo Sapiens
FFAVRESL

SEQ ID NO: 161458 - protein, 8 aa, Homo Sapiens
FFENHPYF

SEQ ID NO: 161459 - protein, 8 aa, Homo Sapiens
FFESFGDL

SEQ ID NO: 161460 - protein, 8 aa, Homo Sapiens
FFEVRRVV

SEQ ID NO: 161461 - protein, 8 aa, Homo Sapiens
FFFAGYYL

SEQ ID NO: 161462 - protein, 8 aa, Homo Sapiens
FFFNGQHM

SEQ ID NO: 161463 - protein, 8 aa, Homo Sapiens
FFFYGKSL

SEQ ID NO: 161464 - protein, 8 aa, Homo Sapiens
FFHNGRYL

SEQ ID NO: 161465 - protein, 8 aa, Homo Sapiens
FFKDGLEM

SEQ ID NO: 161466 - protein, 8 aa, Homo Sapiens
FFKDRNWL

SEQ ID NO: 161467 - protein, 8 aa, Homo Sapiens
FFLAAKEL

SEQ ID NO: 161468 - protein, 8 aa, Homo Sapiens
FFLEALDF

SEQ ID NO: 161469 - protein, 8 aa, Homo Sapiens
FFLESIAM

SEQ ID NO: 161470 - protein, 8 aa, Homo Sapiens
FFLIGPPL

SEQ ID NO: 161471 - protein, 8 aa, Homo Sapiens
FFLLGKTL

SEQ ID NO: 161472 - protein, 8 aa, Homo Sapiens
FFLPAAAF

SEQ ID NO: 161473 - protein, 8 aa, Homo Sapiens
FFLPKGAY

SEQ ID NO: 161474 - protein, 8 aa, Homo Sapiens
FFLSHPAY

SEQ ID NO: 161475 - protein, 8 aa, Homo Sapiens
FFLVSREL

SEQ ID NO: 161476 - protein, 8 aa, Homo Sapiens
FFLVVDAY

SEQ ID NO: 161477 - protein, 8 aa, Homo Sapiens
FFPSGIDF

SEQ ID NO: 161478 - protein, 8 aa, Homo Sapiens
FFQEAVSH

SEQ ID NO: 161479 - protein, 8 aa, Homo Sapiens
FFQRVRAL

SEQ ID NO: 161480 - protein, 8 aa, Homo Sapiens
FFQVGSDL

SEQ ID NO: 161481 - protein, 8 aa, Homo Sapiens
FFRVVSEY

SEQ ID NO: 161482 - protein, 8 aa, Homo Sapiens
FFVPHGYL

SEQ ID NO: 161483 - protein, 8 aa, Homo Sapiens
FFWPGIDL

SEQ ID NO: 161484 - protein, 8 aa, Homo Sapiens
FFYGHSAF

SEQ ID NO: 161485 - protein, 8 aa, Homo Sapiens
FSPVGSVL

SEQ ID NO: 161486 - protein, 8 aa, Homo Sapiens
FTADPLSL

SEQ ID NO: 161487 - protein, 8 aa, Homo Sapiens
FTMVGKTF

SEQ ID NO: 161488 - protein, 8 aa, Homo Sapiens
FYAFGRVF

SEQ ID NO: 161489 - protein, 8 aa, Homo Sapiens
FYCPGSAL

SEQ ID NO: 161490 - protein, 8 aa, Homo Sapiens
FYFAAEHL

SEQ ID NO: 161491 - protein, 8 aa, Homo Sapiens
FYFEGTFY

SEQ ID NO: 161492 - protein, 8 aa, Homo Sapiens
FYFNTKYF

SEQ ID NO: 161493 - protein, 8 aa, Homo Sapiens
FYFPAAYY

SEQ ID NO: 161494 - protein, 8 aa, Homo Sapiens
FYFPHYEV

SEQ ID NO: 161495 - protein, 8 aa, Homo Sapiens
FYGFQIAM

SEQ ID NO: 161496 - protein, 8 aa, Homo Sapiens
FYGKAIEL

SEQ ID NO: 161497 - protein, 8 aa, Homo Sapiens
FYGRHAEL

SEQ ID NO: 161498 - protein, 8 aa, Homo Sapiens
FYHISLEH

SEQ ID NO: 161499 - protein, 8 aa, Homo Sapiens
FYHPAQEY

SEQ ID NO: 161500 - protein, 8 aa, Homo Sapiens
FYHSVQDL

SEQ ID NO: 161501 - protein, 8 aa, Homo Sapiens
FYIESISY

SEQ ID NO: 161502 - protein, 8 aa, Homo Sapiens
FYINKLCF

SEQ ID NO: 161503 - protein, 8 aa, Homo Sapiens
FYIVGLIL

SEQ ID NO: 161504 - protein, 8 aa, Homo Sapiens
FYKDVLEV

SEQ ID NO: 161505 - protein, 8 aa, Homo Sapiens
FYLERSNL

SEQ ID NO: 161506 - protein, 8 aa, Homo Sapiens
FYLNALEW

SEQ ID NO: 161507 - protein, 8 aa, Homo Sapiens
FYLSGTYY

SEQ ID NO: 161508 - protein, 8 aa, Homo Sapiens
FYMIGSEV

SEQ ID NO: 161509 - protein, 8 aa, Homo Sapiens
FYNAGLAY

SEQ ID NO: 161510 - protein, 8 aa, Homo Sapiens
FYNITLAF

SEQ ID NO: 161511 - protein, 8 aa, Homo Sapiens
FYNPVQEF

SEQ ID NO: 161512 - protein, 8 aa, Homo Sapiens
FYQEHPDL

SEQ ID NO: 161513 - protein, 8 aa, Homo Sapiens
FYQFVNNL

SEQ ID NO: 161514 - protein, 8 aa, Homo Sapiens
FYQLQPAM

SEQ ID NO: 161515 - protein, 8 aa, Homo Sapiens
FYQLSHFL

SEQ ID NO: 161516 - protein, 8 aa, Homo Sapiens
FYQNHRRY

SEQ ID NO: 161517 - protein, 8 aa, Homo Sapiens
FYQTAEEL

SEQ ID NO: 161518 - protein, 8 aa, Homo Sapiens
FYQVGILY

SEQ ID NO: 161519 - protein, 8 aa, Homo Sapiens
FYSFQDKL

SEQ ID NO: 161520 - protein, 8 aa, Homo Sapiens
FYSVNVDY

SEQ ID NO: 161521 - protein, 8 aa, Homo Sapiens
FYTIHSCF

SEQ ID NO: 161522 - protein, 8 aa, Homo Sapiens
FYVEHPEV

SEQ ID NO: 161523 - protein, 8 aa, Homo Sapiens
FYVIGSSY

SEQ ID NO: 161524 - protein, 8 aa, Homo Sapiens
FYVNGLTL

SEQ ID NO: 161525 - protein, 8 aa, Homo Sapiens
FYVVAESF

SEQ ID NO: 161526 - protein, 8 aa, Homo Sapiens
FYVVNSEL

SEQ ID NO: 161527 - protein, 8 aa, Homo Sapiens
FYYDGKVM

SEQ ID NO: 161528 - protein, 8 aa, Homo Sapiens
FYYFVKEF

SEQ ID NO: 161529 - protein, 8 aa, Homo Sapiens
FYYFVSAL

SEQ ID NO: 161530 - protein, 8 aa, Homo Sapiens
GGLRAELL

SEQ ID NO: 161531 - protein, 8 aa, Homo Sapiens
HFGIHEEM

SEQ ID NO: 161532 - protein, 8 aa, Homo Sapiens
HFLEHMVF

SEQ ID NO: 161533 - protein, 8 aa, Homo Sapiens
HFLLGSIY

SEQ ID NO: 161534 - protein, 8 aa, Homo Sapiens
HFQVVKCL

SEQ ID NO: 161535 - protein, 8 aa, Homo Sapiens
HYINGSLF

SEQ ID NO: 161536 - protein, 8 aa, Homo Sapiens
HYLYVRAH

SEQ ID NO: 161537 - protein, 8 aa, Homo Sapiens
HYNCISAL

SEQ ID NO: 161538 - protein, 8 aa, Homo Sapiens
HYNLQNAF

SEQ ID NO: 161539 - protein, 8 aa, Homo Sapiens
HYNNIMAL

SEQ ID NO: 161540 - protein, 8 aa, Homo Sapiens
HYNTGWVL

SEQ ID NO: 161541 - protein, 8 aa, Homo Sapiens
HYQDVSCL

SEQ ID NO: 161542 - protein, 8 aa, Homo Sapiens
HYQLGLAY

SEQ ID NO: 161543 - protein, 8 aa, Homo Sapiens
HYQNALYL

SEQ ID NO: 161544 - protein, 8 aa, Homo Sapiens
HYYNAISV

SEQ ID NO: 161545 - protein, 8 aa, Homo Sapiens
IDRFLSSM

SEQ ID NO: 161546 - protein, 8 aa, Homo Sapiens
IFASGSEL

SEQ ID NO: 161547 - protein, 8 aa, Homo Sapiens
IFATVREL

SEQ ID NO: 161548 - protein, 8 aa, Homo Sapiens
IFFNVHSA

SEQ ID NO: 161549 - protein, 8 aa, Homo Sapiens
IFIARSQM

SEQ ID NO: 161550 - protein, 8 aa, Homo Sapiens
IFLGVSTV

SEQ ID NO: 161551 - protein, 8 aa, Homo Sapiens
IFLSASEL

SEQ ID NO: 161552 - protein, 8 aa, Homo Sapiens
IFLVATSF

SEQ ID NO: 161553 - protein, 8 aa, Homo Sapiens
IFNNSSHF

SEQ ID NO: 161554 - protein, 8 aa, Homo Sapiens
IFNVSQQM

SEQ ID NO: 161555 - protein, 8 aa, Homo Sapiens
IFQPVAEL

SEQ ID NO: 161556 - protein, 8 aa, Homo Sapiens
IFQVAQEL

SEQ ID NO: 161557 - protein, 8 aa, Homo Sapiens
IFSEHSCL

SEQ ID NO: 161558 - protein, 8 aa, Homo Sapiens
IFTMGIAL

SEQ ID NO: 161559 - protein, 8 aa, Homo Sapiens
IFYLGEAL

SEQ ID NO: 161560 - protein, 8 aa, Homo Sapiens
INKPPIAK

SEQ ID NO: 161561 - protein, 8 aa, Homo Sapiens
IYAIRNLT

SEQ ID NO: 161562 - protein, 8 aa, Homo Sapiens
IYAIRQSI

SEQ ID NO: 161563 - protein, 8 aa, Homo Sapiens
IYDNRIVL

SEQ ID NO: 161564 - protein, 8 aa, Homo Sapiens
IYFLGHIF

SEQ ID NO: 161565 - protein, 8 aa, Homo Sapiens
IYFLGNSL

SEQ ID NO: 161566 - protein, 8 aa, Homo Sapiens
IYHAVAAL

SEQ ID NO: 161567 - protein, 8 aa, Homo Sapiens
IYHISLEY

SEQ ID NO: 161568 - protein, 8 aa, Homo Sapiens
IYHTIAYL

SEQ ID NO: 161569 - protein, 8 aa, Homo Sapiens
IYHVIMSV

SEQ ID NO: 161570 - protein, 8 aa, Homo Sapiens
IYIDRHVM

SEQ ID NO: 161571 - protein, 8 aa, Homo Sapiens
IYITGSSI

SEQ ID NO: 161572 - protein, 8 aa, Homo Sapiens
IYIVHDEV

SEQ ID NO: 161573 - protein, 8 aa, Homo Sapiens
IYKIGQGY

SEQ ID NO: 161574 - protein, 8 aa, Homo Sapiens
IYLEGSAF

SEQ ID NO: 161575 - protein, 8 aa, Homo Sapiens
IYLNGESL

SEQ ID NO: 161576 - protein, 8 aa, Homo Sapiens
IYLNVESV

SEQ ID NO: 161577 - protein, 8 aa, Homo Sapiens
IYLTADNL

SEQ ID NO: 161578 - protein, 8 aa, Homo Sapiens
IYMESLAL

SEQ ID NO: 161579 - protein, 8 aa, Homo Sapiens
IYMVHIQV

SEQ ID NO: 161580 - protein, 8 aa, Homo Sapiens
IYNIGTNF

SEQ ID NO: 161581 - protein, 8 aa, Homo Sapiens
IYNTAGFY

SEQ ID NO: 161582 - protein, 8 aa, Homo Sapiens
IYPLVGTM

SEQ ID NO: 161583 - protein, 8 aa, Homo Sapiens
IYQLQDVF

SEQ ID NO: 161584 - protein, 8 aa, Homo Sapiens
IYQSASVF

SEQ ID NO: 161585 - protein, 8 aa, Homo Sapiens
IYQWINEL

SEQ ID NO: 161586 - protein, 8 aa, Homo Sapiens
IYTLGRYL

SEQ ID NO: 161587 - protein, 8 aa, Homo Sapiens
IYTVGKRF

SEQ ID NO: 161588 - protein, 8 aa, Homo Sapiens
IYVNYPTF

SEQ ID NO: 161589 - protein, 8 aa, Homo Sapiens
IYVVGGAM

SEQ ID NO: 161590 - protein, 8 aa, Homo Sapiens
KFFTGDVF

SEQ ID NO: 161591 - protein, 8 aa, Homo Sapiens
KFMDASAL

SEQ ID NO: 161592 - protein, 8 aa, Homo Sapiens
KFQIGDYL

SEQ ID NO: 161593 - protein, 8 aa, Homo Sapiens
KYFIRDEF

SEQ ID NO: 161594 - protein, 8 aa, Homo Sapiens
KYLTAEAF

SEQ ID NO: 161595 - protein, 8 aa, Homo Sapiens
KYLTSLNY

SEQ ID NO: 161596 - protein, 8 aa, Homo Sapiens
KYMNNITY

SEQ ID NO: 161597 - protein, 8 aa, Homo Sapiens
LFFVGNQL

SEQ ID NO: 161598 - protein, 8 aa, Homo Sapiens
LFGTFSCL

SEQ ID NO: 161599 - protein, 8 aa, Homo Sapiens
LFHFGNCF

SEQ ID NO: 161600 - protein, 8 aa, Homo Sapiens
LFHIGVAF

SEQ ID NO: 161601 - protein, 8 aa, Homo Sapiens
LFINTSSY

SEQ ID NO: 161602 - protein, 8 aa, Homo Sapiens
LFLEGMHY

SEQ ID NO: 161603 - protein, 8 aa, Homo Sapiens
LFLTGESY

SEQ ID NO: 161604 - protein, 8 aa, Homo Sapiens
LFNLGSAY

SEQ ID NO: 161605 - protein, 8 aa, Homo Sapiens
LFNVAHTL

SEQ ID NO: 161606 - protein, 8 aa, Homo Sapiens
LFNVGNKL

SEQ ID NO: 161607 - protein, 8 aa, Homo Sapiens
LFQEAEEF

SEQ ID NO: 161608 - protein, 8 aa, Homo Sapiens
LFQEVRCM

SEQ ID NO: 161609 - protein, 8 aa, Homo Sapiens
LFQNGSVL

SEQ ID NO: 161610 - protein, 8 aa, Homo Sapiens
LFQNIRPL

SEQ ID NO: 161611 - protein, 8 aa, Homo Sapiens
LFQSRISL

SEQ ID NO: 161612 - protein, 8 aa, Homo Sapiens
LFRVITEV

SEQ ID NO: 161613 - protein, 8 aa, Homo Sapiens
LFTFRPAL

SEQ ID NO: 161614 - protein, 8 aa, Homo Sapiens
LFVPRPVL

SEQ ID NO: 161615 - protein, 8 aa, Homo Sapiens
LFYFRVPF

SEQ ID NO: 161616 - protein, 8 aa, Homo Sapiens
LLHQAGEI

SEQ ID NO: 161617 - protein, 8 aa, Homo Sapiens
LYFTGEAI

SEQ ID NO: 161618 - protein, 8 aa, Homo Sapiens
LYITGAAL

SEQ ID NO: 161619 - protein, 8 aa, Homo Sapiens
LYLDGHVF

SEQ ID NO: 161620 - protein, 8 aa, Homo Sapiens
LYLIARVM

SEQ ID NO: 161621 - protein, 8 aa, Homo Sapiens
LYLLRLAL

SEQ ID NO: 161622 - protein, 8 aa, Homo Sapiens
LYLNRTSL

SEQ ID NO: 161623 - protein, 8 aa, Homo Sapiens
LYLTGGVW

SEQ ID NO: 161624 - protein, 8 aa, Homo Sapiens
LYMVRTML

SEQ ID NO: 161625 - protein, 8 aa, Homo Sapiens
LYMVSKEL

SEQ ID NO: 161626 - protein, 8 aa, Homo Sapiens
LYNIAFMY

SEQ ID NO: 161627 - protein, 8 aa, Homo Sapiens
LYNIGLTY

SEQ ID NO: 161628 - protein, 8 aa, Homo Sapiens
LYNIGNVY

SEQ ID NO: 161629 - protein, 8 aa, Homo Sapiens
LYQNTRSY

SEQ ID NO: 161630 - protein, 8 aa, Homo Sapiens
LYQTALHL

SEQ ID NO: 161631 - protein, 8 aa, Homo Sapiens
LYQTINSL

SEQ ID NO: 161632 - protein, 8 aa, Homo Sapiens
LYQTVTGL

SEQ ID NO: 161633 - protein, 8 aa, Homo Sapiens
LYQVGKEF

SEQ ID NO: 161634 - protein, 8 aa, Homo Sapiens
LYSTHAAL

SEQ ID NO: 161635 - protein, 8 aa, Homo Sapiens
LYYPGSNL

SEQ ID NO: 161636 - protein, 8 aa, Homo Sapiens
MFLTRSEY

SEQ ID NO: 161637 - protein, 8 aa, Homo Sapiens
MFNIHRGF

SEQ ID NO: 161638 - protein, 8 aa, Homo Sapiens
MFNNANVL

SEQ ID NO: 161639 - protein, 8 aa, Homo Sapiens
MYFIVRSL

SEQ ID NO: 161640 - protein, 8 aa, Homo Sapiens
MYFVIAAM

SEQ ID NO: 161641 - protein, 8 aa, Homo Sapiens
MYKVGPVL

SEQ ID NO: 161642 - protein, 8 aa, Homo Sapiens
MYTVAMAY

SEQ ID NO: 161643 - protein, 8 aa, Homo Sapiens
NFAYRLEL

SEQ ID NO: 161644 - protein, 8 aa, Homo Sapiens
NFFEGKEL

SEQ ID NO: 161645 - protein, 8 aa, Homo Sapiens
NFFTGCPK

SEQ ID NO: 161646 - protein, 8 aa, Homo Sapiens
NFLNRTSL

SEQ ID NO: 161647 - protein, 8 aa, Homo Sapiens
NFLVSEAL

SEQ ID NO: 161648 - protein, 8 aa, Homo Sapiens
NFNWGRVV

SEQ ID NO: 161649 - protein, 8 aa, Homo Sapiens
NFSIHMAL

SEQ ID NO: 161650 - protein, 8 aa, Homo Sapiens
NVDYFFNF

SEQ ID NO: 161651 - protein, 8 aa, Homo Sapiens
NVPVGKVL

SEQ ID NO: 161652 - protein, 8 aa, Homo Sapiens
NYHFGVTY

SEQ ID NO: 161653 - protein, 8 aa, Homo Sapiens
NYLFGCEL

SEQ ID NO: 161654 - protein, 8 aa, Homo Sapiens
NYLTRIHY

SEQ ID NO: 161655 - protein, 8 aa, Homo Sapiens
NYLVVAAM

SEQ ID NO: 161656 - protein, 8 aa, Homo Sapiens
NYMMGIEF

SEQ ID NO: 161657 - protein, 8 aa, Homo Sapiens
NYVNGKTF

SEQ ID NO: 161658 - protein, 8 aa, Homo Sapiens
NYYVRAVL

SEQ ID NO: 161659 - protein, 8 aa, Homo Sapiens
QFQFGHAL

SEQ ID NO: 161660 - protein, 8 aa, Homo Sapiens
QFRNAPPF

SEQ ID NO: 161661 - protein, 8 aa, Homo Sapiens
QFTTRSEL

SEQ ID NO: 161662 - protein, 8 aa, Homo Sapiens
QYMERLQL

SEQ ID NO: 161663 - protein, 8 aa, Homo Sapiens
QYYVGQSF

SEQ ID NO: 161664 - protein, 8 aa, Homo Sapiens
RFINGSAL

SEQ ID NO: 161665 - protein, 8 aa, Homo Sapiens
RFNVAKSL

SEQ ID NO: 161666 - protein, 8 aa, Homo Sapiens
RFQSSAVM

SEQ ID NO: 161667 - protein, 8 aa, Homo Sapiens
RYFISHVL

SEQ ID NO: 161668 - protein, 8 aa, Homo Sapiens
RYFTVTCY

SEQ ID NO: 161669 - protein, 8 aa, Homo Sapiens
RYHIAKVY

SEQ ID NO: 161670 - protein, 8 aa, Homo Sapiens
RYLVRAIL

SEQ ID NO: 161671 - protein, 8 aa, Homo Sapiens
RYMFSRPF

SEQ ID NO: 161672 - protein, 8 aa, Homo Sapiens
RYNLQSAL

SEQ ID NO: 161673 - protein, 8 aa, Homo Sapiens
RYQEALHL

SEQ ID NO: 161674 - protein, 8 aa, Homo Sapiens
RYQVGVHY

SEQ ID NO: 161675 - protein, 8 aa, Homo Sapiens
RYQVSWSL

SEQ ID NO: 161676 - protein, 8 aa, Homo Sapiens
SFFLGKEL

SEQ ID NO: 161677 - protein, 8 aa, Homo Sapiens
SFGARAEL

SEQ ID NO: 161678 - protein, 8 aa, Homo Sapiens
SFHVGLQL

SEQ ID NO: 161679 - protein, 8 aa, Homo Sapiens
SFLTAAHM

SEQ ID NO: 161680 - protein, 8 aa, Homo Sapiens
SFMINNVY

SEQ ID NO: 161681 - protein, 8 aa, Homo Sapiens
SFQEVREY

SEQ ID NO: 161682 - protein, 8 aa, Homo Sapiens
SFVDVMEF

SEQ ID NO: 161683 - protein, 8 aa, Homo Sapiens
SFYNGLSF

SEQ ID NO: 161684 - protein, 8 aa, Homo Sapiens
SYAVGHFL

SEQ ID NO: 161685 - protein, 8 aa, Homo Sapiens
SYGLNIEM

SEQ ID NO: 161686 - protein, 8 aa, Homo Sapiens
SYLVGSHM

SEQ ID NO: 161687 - protein, 8 aa, Homo Sapiens
SYMISVNM

SEQ ID NO: 161688 - protein, 8 aa, Homo Sapiens
SYNIGRAW

SEQ ID NO: 161689 - protein, 8 aa, Homo Sapiens
SYNISEVM

SEQ ID NO: 161690 - protein, 8 aa, Homo Sapiens
SYQVASTL

SEQ ID NO: 161691 - protein, 8 aa, Homo Sapiens
SYSVGVAY

SEQ ID NO: 161692 - protein, 8 aa, Homo Sapiens
SYTIQSEL

SEQ ID NO: 161693 - protein, 8 aa, Homo Sapiens
SYWNHREL

SEQ ID NO: 161694 - protein, 8 aa, Homo Sapiens
SYYSVAEL

SEQ ID NO: 161695 - protein, 8 aa, Homo Sapiens
TFLNHPAL

SEQ ID NO: 161696 - protein, 8 aa, Homo Sapiens
TFLVISHY

SEQ ID NO: 161697 - protein, 8 aa, Homo Sapiens
TFMNRVEV

SEQ ID NO: 161698 - protein, 8 aa, Homo Sapiens
TFNNGLCY

SEQ ID NO: 161699 - protein, 8 aa, Homo Sapiens
TFTNHMVF

SEQ ID NO: 161700 - protein, 8 aa, Homo Sapiens
TYFAHDAL

SEQ ID NO: 161701 - protein, 8 aa, Homo Sapiens
TYKEALEK

SEQ ID NO: 161702 - protein, 8 aa, Homo Sapiens
TYLNISQV

SEQ ID NO: 161703 - protein, 8 aa, Homo Sapiens
TYLTGDQF

SEQ ID NO: 161704 - protein, 8 aa, Homo Sapiens
TYLVAFAY

SEQ ID NO: 161705 - protein, 8 aa, Homo Sapiens
TYLVGNSL

SEQ ID NO: 161706 - protein, 8 aa, Homo Sapiens
TYSLGSAL

SEQ ID NO: 161707 - protein, 8 aa, Homo Sapiens
TYTTRIHL

SEQ ID NO: 161708 - protein, 8 aa, Homo Sapiens
VFFCHGEL

SEQ ID NO: 161709 - protein, 8 aa, Homo Sapiens
VFFVAHSY

SEQ ID NO: 161710 - protein, 8 aa, Homo Sapiens
VFFVGQSA

SEQ ID NO: 161711 - protein, 8 aa, Homo Sapiens
VFFVHEGY

SEQ ID NO: 161712 - protein, 8 aa, Homo Sapiens
VFHAGTAL

SEQ ID NO: 161713 - protein, 8 aa, Homo Sapiens
VFHPRQEL

SEQ ID NO: 161714 - protein, 8 aa, Homo Sapiens
VFIQRSEL

SEQ ID NO: 161715 - protein, 8 aa, Homo Sapiens
VFITKPPM

SEQ ID NO: 161716 - protein, 8 aa, Homo Sapiens
VFLAGIAL

SEQ ID NO: 161717 - protein, 8 aa, Homo Sapiens
VFLCARPR

SEQ ID NO: 161718 - protein, 8 aa, Homo Sapiens
VFLDHNAL

SEQ ID NO: 161719 - protein, 8 aa, Homo Sapiens
VFLLGHSM

SEQ ID NO: 161720 - protein, 8 aa, Homo Sapiens
VFLLGKVM

SEQ ID NO: 161721 - protein, 8 aa, Homo Sapiens
VFLNGNKL

SEQ ID NO: 161722 - protein, 8 aa, Homo Sapiens
VFMTHLEF

SEQ ID NO: 161723 - protein, 8 aa, Homo Sapiens
VFNAVTSF

SEQ ID NO: 161724 - protein, 8 aa, Homo Sapiens
VFNPAKEL

SEQ ID NO: 161725 - protein, 8 aa, Homo Sapiens
VFNTTSYL

SEQ ID NO: 161726 - protein, 8 aa, Homo Sapiens
VFQFKVDY

SEQ ID NO: 161727 - protein, 8 aa, Homo Sapiens
VFQLGKKY

SEQ ID NO: 161728 - protein, 8 aa, Homo Sapiens
VFQPVAEL

SEQ ID NO: 161729 - protein, 8 aa, Homo Sapiens
VFQSVKSL

SEQ ID NO: 161730 - protein, 8 aa, Homo Sapiens
VFQTMVQM

SEQ ID NO: 161731 - protein, 8 aa, Homo Sapiens
VFRNAASF

SEQ ID NO: 161732 - protein, 8 aa, Homo Sapiens
VFRVGISF

SEQ ID NO: 161733 - protein, 8 aa, Homo Sapiens
VFRVGSVL

SEQ ID NO: 161734 - protein, 8 aa, Homo Sapiens
VFRVSSSL

SEQ ID NO: 161735 - protein, 8 aa, Homo Sapiens
VFSIGPVF

SEQ ID NO: 161736 - protein, 8 aa, Homo Sapiens
VFSLSSEF

SEQ ID NO: 161737 - protein, 8 aa, Homo Sapiens
VFSVTIHM

SEQ ID NO: 161738 - protein, 8 aa, Homo Sapiens
VFTNAEVY

SEQ ID NO: 161739 - protein, 8 aa, Homo Sapiens
VFTNRTVL

SEQ ID NO: 161740 - protein, 8 aa, Homo Sapiens
VFTTRNLL

SEQ ID NO: 161741 - protein, 8 aa, Homo Sapiens
VFVTVKEL

SEQ ID NO: 161742 - protein, 8 aa, Homo Sapiens
VFVVGESY

SEQ ID NO: 161743 - protein, 8 aa, Homo Sapiens
VFVVGTER

SEQ ID NO: 161744 - protein, 8 aa, Homo Sapiens
VYEIGRQF

SEQ ID NO: 161745 - protein, 8 aa, Homo Sapiens
VYFCHLDI

SEQ ID NO: 161746 - protein, 8 aa, Homo Sapiens
VYFEGSDF

SEQ ID NO: 161747 - protein, 8 aa, Homo Sapiens
VYFEGSIY

SEQ ID NO: 161748 - protein, 8 aa, Homo Sapiens
VYFIVREV

SEQ ID NO: 161749 - protein, 8 aa, Homo Sapiens
VYFVHPTF

SEQ ID NO: 161750 - protein, 8 aa, Homo Sapiens
VYFVVTVY

SEQ ID NO: 161751 - protein, 8 aa, Homo Sapiens
VYHAVSVM

SEQ ID NO: 161752 - protein, 8 aa, Homo Sapiens
VYITGKEV

SEQ ID NO: 161753 - protein, 8 aa, Homo Sapiens
VYITRAQL

SEQ ID NO: 161754 - protein, 8 aa, Homo Sapiens
VYKVGIAF

SEQ ID NO: 161755 - protein, 8 aa, Homo Sapiens
VYLFTEAY

SEQ ID NO: 161756 - protein, 8 aa, Homo Sapiens
VYLNVMEL

SEQ ID NO: 161757 - protein, 8 aa, Homo Sapiens
VYLPTREY

SEQ ID NO: 161758 - protein, 8 aa, Homo Sapiens
VYLTGYNF

SEQ ID NO: 161759 - protein, 8 aa, Homo Sapiens
VYLTHLDY

SEQ ID NO: 161760 - protein, 8 aa, Homo Sapiens
VYLVHDEL

SEQ ID NO: 161761 - protein, 8 aa, Homo Sapiens
VYLVIRAL

SEQ ID NO: 161762 - protein, 8 aa, Homo Sapiens
VYLVSAML

SEQ ID NO: 161763 - protein, 8 aa, Homo Sapiens
VYLVTEVY

SEQ ID NO: 161764 - protein, 8 aa, Homo Sapiens
VYMIRVYL

SEQ ID NO: 161765 - protein, 8 aa, Homo Sapiens
VYMLAASL

SEQ ID NO: 161766 - protein, 8 aa, Homo Sapiens
VYMTGKEL

SEQ ID NO: 161767 - protein, 8 aa, Homo Sapiens
VYNIHLAV

SEQ ID NO: 161768 - protein, 8 aa, Homo Sapiens
VYNNSRML

SEQ ID NO: 161769 - protein, 8 aa, Homo Sapiens
VYQARPQL

SEQ ID NO: 161770 - protein, 8 aa, Homo Sapiens
VYQAVLSL

SEQ ID NO: 161771 - protein, 8 aa, Homo Sapiens
VYQAVQAL

SEQ ID NO: 161772 - protein, 8 aa, Homo Sapiens
VYQAVRQF

SEQ ID NO: 161773 - protein, 8 aa, Homo Sapiens
VYQETSEM

SEQ ID NO: 161774 - protein, 8 aa, Homo Sapiens
VYQLRFQF

SEQ ID NO: 161775 - protein, 8 aa, Homo Sapiens
VYSTGLAM

SEQ ID NO: 161776 - protein, 8 aa, Homo Sapiens
VYTLTSLY

SEQ ID NO: 161777 - protein, 8 aa, Homo Sapiens
VYVNTAHL

SEQ ID NO: 161778 - protein, 8 aa, Homo Sapiens
VYVVHDSL

SEQ ID NO: 161779 - protein, 8 aa, Homo Sapiens
WFNTHREL

SEQ ID NO: 161780 - protein, 8 aa, Homo Sapiens
YAAIQIFL

SEQ ID NO: 161781 - protein, 8 aa, Homo Sapiens
YFDEHYEY

SEQ ID NO: 161782 - protein, 8 aa, Homo Sapiens
YFFAVSTL

SEQ ID NO: 161783 - protein, 8 aa, Homo Sapiens
YFFPRADL

SEQ ID NO: 161784 - protein, 8 aa, Homo Sapiens
YFGARAIL

SEQ ID NO: 161785 - protein, 8 aa, Homo Sapiens
YFGSFSSL

SEQ ID NO: 161786 - protein, 8 aa, Homo Sapiens
YFIPNKEF

SEQ ID NO: 161787 - protein, 8 aa, Homo Sapiens
YFKGAIPL

SEQ ID NO: 161788 - protein, 8 aa, Homo Sapiens
YFLEHLAF

SEQ ID NO: 161789 - protein, 8 aa, Homo Sapiens
YFLIGKVY

SEQ ID NO: 161790 - protein, 8 aa, Homo Sapiens
YFLLARCF

SEQ ID NO: 161791 - protein, 8 aa, Homo Sapiens
YFLQRHEL

SEQ ID NO: 161792 - protein, 8 aa, Homo Sapiens
YFMVGTAF

SEQ ID NO: 161793 - protein, 8 aa, Homo Sapiens
YFNEGTVL

SEQ ID NO: 161794 - protein, 8 aa, Homo Sapiens
YFNFGNQL

SEQ ID NO: 161795 - protein, 8 aa, Homo Sapiens
YFQLHRAL

SEQ ID NO: 161796 - protein, 8 aa, Homo Sapiens
YFQVAKTV

SEQ ID NO: 161797 - protein, 8 aa, Homo Sapiens
YFSPFRPY

SEQ ID NO: 161798 - protein, 8 aa, Homo Sapiens
YFSSRPAL

SEQ ID NO: 161799 - protein, 8 aa, Homo Sapiens
YFYNYPAV

SEQ ID NO: 161800 - protein, 8 aa, Homo Sapiens
YVHMVTHF

SEQ ID NO: 161801 - protein, 8 aa, Homo Sapiens
YWQNHPEL

SEQ ID NO: 161802 - protein, 8 aa, Homo Sapiens
YWVPRNAL

SEQ ID NO: 161803 - protein, 8 aa, Homo Sapiens
YYASFLEV

SEQ ID NO: 161804 - protein, 8 aa, Homo Sapiens
YYCVRGTI

SEQ ID NO: 161805 - protein, 8 aa, Homo Sapiens
YYENRMYL

SEQ ID NO: 161806 - protein, 8 aa, Homo Sapiens
YYEVHKEL

SEQ ID NO: 161807 - protein, 8 aa, Homo Sapiens
YYFAVDTM

SEQ ID NO: 161808 - protein, 8 aa, Homo Sapiens
YYFLGRML

SEQ ID NO: 161809 - protein, 8 aa, Homo Sapiens
YYFNQHIF

SEQ ID NO: 161810 - protein, 8 aa, Homo Sapiens
YYFNRKTF

SEQ ID NO: 161811 - protein, 8 aa, Homo Sapiens
YYFPVREL

SEQ ID NO: 161812 - protein, 8 aa, Homo Sapiens
YYFSAHAL

SEQ ID NO: 161813 - protein, 8 aa, Homo Sapiens
YYFSVDNL

SEQ ID NO: 161814 - protein, 8 aa, Homo Sapiens
YYGLSNFY

SEQ ID NO: 161815 - protein, 8 aa, Homo Sapiens
YYHCAVTL

SEQ ID NO: 161816 - protein, 8 aa, Homo Sapiens
YYHWALSF

SEQ ID NO: 161817 - protein, 8 aa, Homo Sapiens
YYILRPEV

SEQ ID NO: 161818 - protein, 8 aa, Homo Sapiens
YYINSPEL

SEQ ID NO: 161819 - protein, 8 aa, Homo Sapiens
YYITRAKL

SEQ ID NO: 161820 - protein, 8 aa, Homo Sapiens
YYKPGLLM

SEQ ID NO: 161821 - protein, 8 aa, Homo Sapiens
YYLISRSL

SEQ ID NO: 161822 - protein, 8 aa, Homo Sapiens
YYLWVKSV

SEQ ID NO: 161823 - protein, 8 aa, Homo Sapiens
YYNANRAF

SEQ ID NO: 161824 - protein, 8 aa, Homo Sapiens
YYNTAVKL

SEQ ID NO: 161825 - protein, 8 aa, Homo Sapiens
YYQFINEL

SEQ ID NO: 161826 - protein, 8 aa, Homo Sapiens
YYQLSEEL

SEQ ID NO: 161827 - protein, 8 aa, Homo Sapiens
YYQPGLLY

SEQ ID NO: 161828 - protein, 8 aa, Homo Sapiens
YYSITINY

SEQ ID NO: 161829 - protein, 8 aa, Homo Sapiens
YYSVAKAL

SEQ ID NO: 161830 - protein, 8 aa, Homo Sapiens
YYTVAHAI

SEQ ID NO: 161831 - protein, 8 aa, Homo Sapiens
YYVNRDTL

SEQ ID NO: 161832 - protein, 8 aa, Homo Sapiens
YYYVGFAY

SEQ ID NO: 161833 - protein, 8 aa, Homo Sapiens
YYYYHRQY

SEQ ID NO: 161834 - protein, 9 aa, Homo Sapiens
AFACMGQTY

SEQ ID NO: 161835 - protein, 9 aa, Homo Sapiens
AFADHVECL

SEQ ID NO: 161836 - protein, 9 aa, Homo Sapiens
AFADIIHSL

SEQ ID NO: 161837 - protein, 9 aa, Homo Sapiens
AFADNVSGL

SEQ ID NO: 161838 - protein, 9 aa, Homo Sapiens
AFADYVSTM

SEQ ID NO: 161839 - protein, 9 aa, Homo Sapiens
AFAHHGRSL

SEQ ID NO: 161840 - protein, 9 aa, Homo Sapiens
AFALKALQF

SEQ ID NO: 161841 - protein, 9 aa, Homo Sapiens
AFALLFSEL

SEQ ID NO: 161842 - protein, 9 aa, Homo Sapiens
AFALVSQAY

SEQ ID NO: 161843 - protein, 9 aa, Homo Sapiens
AFATPTISL

SEQ ID NO: 161844 - protein, 9 aa, Homo Sapiens
AFDNMVTSM

SEQ ID NO: 161845 - protein, 9 aa, Homo Sapiens
AFEDYVQSM

SEQ ID NO: 161846 - protein, 9 aa, Homo Sapiens
AFEFMQRAL

SEQ ID NO: 161847 - protein, 9 aa, Homo Sapiens
AFFAAPNSI

SEQ ID NO: 161848 - protein, 9 aa, Homo Sapiens
AFFEAASMM

SEQ ID NO: 161849 - protein, 9 aa, Homo Sapiens
AFFGGSNPF

SEQ ID NO: 161850 - protein, 9 aa, Homo Sapiens
AFGAALEAF

SEQ ID NO: 161851 - protein, 9 aa, Homo Sapiens
AFGGLTRAL

SEQ ID NO: 161852 - protein, 9 aa, Homo Sapiens
AFHDNLRSL

SEQ ID NO: 161853 - protein, 9 aa, Homo Sapiens
AFHLRVLAH

SEQ ID NO: 161854 - protein, 9 aa, Homo Sapiens
AFHVCITSY

SEQ ID NO: 161855 - protein, 9 aa, Homo Sapiens
AFIAQALCL

SEQ ID NO: 161856 - protein, 9 aa, Homo Sapiens
AFIDQSQSL

SEQ ID NO: 161857 - protein, 9 aa, Homo Sapiens
AFIDTAQHM

SEQ ID NO: 161858 - protein, 9 aa, Homo Sapiens
AFIEESRQL

SEQ ID NO: 161859 - protein, 9 aa, Homo Sapiens
AFIETPSSL

SEQ ID NO: 161860 - protein, 9 aa, Homo Sapiens
AFIFLIHCL

SEQ ID NO: 161861 - protein, 9 aa, Homo Sapiens
AFIFRSLNL

SEQ ID NO: 161862 - protein, 9 aa, Homo Sapiens
AFIGVASNF

SEQ ID NO: 161863 - protein, 9 aa, Homo Sapiens
AFIHISTAY

SEQ ID NO: 161864 - protein, 9 aa, Homo Sapiens
AFIITGQTY

SEQ ID NO: 161865 - protein, 9 aa, Homo Sapiens
AFIITINSF

SEQ ID NO: 161866 - protein, 9 aa, Homo Sapiens
AFIPHSIVL

SEQ ID NO: 161867 - protein, 9 aa, Homo Sapiens
AFIQEAAAF

SEQ ID NO: 161868 - protein, 9 aa, Homo Sapiens
AFIQQNISF

SEQ ID NO: 161869 - protein, 9 aa, Homo Sapiens
AFISKVSTH

SEQ ID NO: 161870 - protein, 9 aa, Homo Sapiens
AFISLAKTL

SEQ ID NO: 161871 - protein, 9 aa, Homo Sapiens
AFIYDAAVL

SEQ ID NO: 161872 - protein, 9 aa, Homo Sapiens
AFKAIGTAY

SEQ ID NO: 161873 - protein, 9 aa, Homo Sapiens
AFKEVGIEF

SEQ ID NO: 161874 - protein, 9 aa, Homo Sapiens
AFLAEASVM

SEQ ID NO: 161875 - protein, 9 aa, Homo Sapiens
AFLAIIHAL

SEQ ID NO: 161876 - protein, 9 aa, Homo Sapiens
AFLEAADNL

SEQ ID NO: 161877 - protein, 9 aa, Homo Sapiens
AFLEARQSL

SEQ ID NO: 161878 - protein, 9 aa, Homo Sapiens
AFLEQAVSY

SEQ ID NO: 161879 - protein, 9 aa, Homo Sapiens
AFLGEANVM

SEQ ID NO: 161880 - protein, 9 aa, Homo Sapiens
AFLKTALEM

SEQ ID NO: 161881 - protein, 9 aa, Homo Sapiens
AFLPTLQTL

SEQ ID NO: 161882 - protein, 9 aa, Homo Sapiens
AFLTQSSQL

SEQ ID NO: 161883 - protein, 9 aa, Homo Sapiens
AFLTQTVCL

SEQ ID NO: 161884 - protein, 9 aa, Homo Sapiens
AFLTSGTQF

SEQ ID NO: 161885 - protein, 9 aa, Homo Sapiens
AFLVQISAH

SEQ ID NO: 161886 - protein, 9 aa, Homo Sapiens
AFMDQVRAF

SEQ ID NO: 161887 - protein, 9 aa, Homo Sapiens
AFMEKVRVL

SEQ ID NO: 161888 - protein, 9 aa, Homo Sapiens
AFMSQVHSV

SEQ ID NO: 161889 - protein, 9 aa, Homo Sapiens
AFNTQVTAL

SEQ ID NO: 161890 - protein, 9 aa, Homo Sapiens
AFNTTVAAL

SEQ ID NO: 161891 - protein, 9 aa, Homo Sapiens
AFNVMGEQF

SEQ ID NO: 161892 - protein, 9 aa, Homo Sapiens
AFPDGRSSF

SEQ ID NO: 161893 - protein, 9 aa, Homo Sapiens
AFPDSVNSL

SEQ ID NO: 161894 - protein, 9 aa, Homo Sapiens
AFPDYSTYL

SEQ ID NO: 161895 - protein, 9 aa, Homo Sapiens
AFPFNMQEL

SEQ ID NO: 161896 - protein, 9 aa, Homo Sapiens
AFPGASLYL

SEQ ID NO: 161897 - protein, 9 aa, Homo Sapiens
AFPGGAKEL

SEQ ID NO: 161898 - protein, 9 aa, Homo Sapiens
AFPIGSSGF

SEQ ID NO: 161899 - protein, 9 aa, Homo Sapiens
AFPKAVSVF

SEQ ID NO: 161900 - protein, 9 aa, Homo Sapiens
AFPKSITVF

SEQ ID NO: 161901 - protein, 9 aa, Homo Sapiens
AFPNLARVL

SEQ ID NO: 161902 - protein, 9 aa, Homo Sapiens
AFPYGNVAF

SEQ ID NO: 161903 - protein, 9 aa, Homo Sapiens
AFQAVTEFY

SEQ ID NO: 161904 - protein, 9 aa, Homo Sapiens
AFQERLNSY

SEQ ID NO: 161905 - protein, 9 aa, Homo Sapiens
AFQFFAEEY

SEQ ID NO: 161906 - protein, 9 aa, Homo Sapiens
AFQFSYTAV

SEQ ID NO: 161907 - protein, 9 aa, Homo Sapiens
AFQHVGKAF

SEQ ID NO: 161908 - protein, 9 aa, Homo Sapiens
AFQIMQEEL

SEQ ID NO: 161909 - protein, 9 aa, Homo Sapiens
AFQNAYLEL

SEQ ID NO: 161910 - protein, 9 aa, Homo Sapiens
AFQNDVYEW

SEQ ID NO: 161911 - protein, 9 aa, Homo Sapiens
AFQQQIQTL

SEQ ID NO: 161912 - protein, 9 aa, Homo Sapiens
AFQTILTEI

SEQ ID NO: 161913 - protein, 9 aa, Homo Sapiens
AFQTTISKY

SEQ ID NO: 161914 - protein, 9 aa, Homo Sapiens
AFQVLVKSL

SEQ ID NO: 161915 - protein, 9 aa, Homo Sapiens
AFQVSACAF

SEQ ID NO: 161916 - protein, 9 aa, Homo Sapiens
AFSQFVRPL

SEQ ID NO: 161917 - protein, 9 aa, Homo Sapiens
AFSSDTSFF

SEQ ID NO: 161918 - protein, 9 aa, Homo Sapiens
AFTDHVECL

SEQ ID NO: 161919 - protein, 9 aa, Homo Sapiens
AFTEKVSTF

SEQ ID NO: 161920 - protein, 9 aa, Homo Sapiens
AFTSHPQEL

SEQ ID NO: 161921 - protein, 9 aa, Homo Sapiens
AFVAKFMAL

SEQ ID NO: 161922 - protein, 9 aa, Homo Sapiens
AFVLSSNSL

SEQ ID NO: 161923 - protein, 9 aa, Homo Sapiens
AFYDPTHAW

SEQ ID NO: 161924 - protein, 9 aa, Homo Sapiens
AFYEHAQTY

SEQ ID NO: 161925 - protein, 9 aa, Homo Sapiens
AFYTLVREI

SEQ ID NO: 161926 - protein, 9 aa, Homo Sapiens
AFYTTDRVM

SEQ ID NO: 161927 - protein, 9 aa, Homo Sapiens
ASPVRLLSL

SEQ ID NO: 161928 - protein, 9 aa, Homo Sapiens
AVLASGATF

SEQ ID NO: 161929 - protein, 9 aa, Homo Sapiens
AVNIMHSSL

SEQ ID NO: 161930 - protein, 9 aa, Homo Sapiens
AWAEYVVEW

SEQ ID NO: 161931 - protein, 9 aa, Homo Sapiens
AWPEKRGEI

SEQ ID NO: 161932 - protein, 9 aa, Homo Sapiens
AWPGPLADM

SEQ ID NO: 161933 - protein, 9 aa, Homo Sapiens
AYADFYRNY

SEQ ID NO: 161934 - protein, 9 aa, Homo Sapiens
AYAIQVGSL

SEQ ID NO: 161935 - protein, 9 aa, Homo Sapiens
AYALAGVSF

SEQ ID NO: 161936 - protein, 9 aa, Homo Sapiens
AYALGATVL

SEQ ID NO: 161937 - protein, 9 aa, Homo Sapiens
AYALMAHAM

SEQ ID NO: 161938 - protein, 9 aa, Homo Sapiens
AYAPAAATV

SEQ ID NO: 161939 - protein, 9 aa, Homo Sapiens
AYEFMSQAF

SEQ ID NO: 161940 - protein, 9 aa, Homo Sapiens
AYFDAASEI

SEQ ID NO: 161941 - protein, 9 aa, Homo Sapiens
AYFELVSAL

SEQ ID NO: 161942 - protein, 9 aa, Homo Sapiens
AYFGTGFPH

SEQ ID NO: 161943 - protein, 9 aa, Homo Sapiens
AYFKKVLEK

SEQ ID NO: 161944 - protein, 9 aa, Homo Sapiens
AYFPDARDM

SEQ ID NO: 161945 - protein, 9 aa, Homo Sapiens
AYFPQIVSV

SEQ ID NO: 161946 - protein, 9 aa, Homo Sapiens
AYFPYFITY

SEQ ID NO: 161947 - protein, 9 aa, Homo Sapiens
AYFTETEKF

SEQ ID NO: 161948 - protein, 9 aa, Homo Sapiens
AYFTTPIFY

SEQ ID NO: 161949 - protein, 9 aa, Homo Sapiens
AYGASFLSF

SEQ ID NO: 161950 - protein, 9 aa, Homo Sapiens
AYGPPTRAV

SEQ ID NO: 161951 - protein, 9 aa, Homo Sapiens
AYGRMGLAL

SEQ ID NO: 161952 - protein, 9 aa, Homo Sapiens
AYHAVVLSY

SEQ ID NO: 161953 - protein, 9 aa, Homo Sapiens
AYHELAQVY

SEQ ID NO: 161954 - protein, 9 aa, Homo Sapiens
AYHGLTVPL

SEQ ID NO: 161955 - protein, 9 aa, Homo Sapiens
AYHNSVECL

SEQ ID NO: 161956 - protein, 9 aa, Homo Sapiens
AYHTQTTPL

SEQ ID NO: 161957 - protein, 9 aa, Homo Sapiens
AYIENAKQV

SEQ ID NO: 161958 - protein, 9 aa, Homo Sapiens
AYIFNSNVM

SEQ ID NO: 161959 - protein, 9 aa, Homo Sapiens
AYIGFIQSL

SEQ ID NO: 161960 - protein, 9 aa, Homo Sapiens
AYIGGICSL

SEQ ID NO: 161961 - protein, 9 aa, Homo Sapiens
AYIHCVSAF

SEQ ID NO: 161962 - protein, 9 aa, Homo Sapiens
AYIHLVADY

SEQ ID NO: 161963 - protein, 9 aa, Homo Sapiens
AYILDTLVF

SEQ ID NO: 161964 - protein, 9 aa, Homo Sapiens
AYIMKRMDM

SEQ ID NO: 161965 - protein, 9 aa, Homo Sapiens
AYINKVEEL

SEQ ID NO: 161966 - protein, 9 aa, Homo Sapiens
AYINRASLL

SEQ ID NO: 161967 - protein, 9 aa, Homo Sapiens
AYITQKVEF

SEQ ID NO: 161968 - protein, 9 aa, Homo Sapiens
AYKPPGFSL

SEQ ID NO: 161969 - protein, 9 aa, Homo Sapiens
AYLAALTQL

SEQ ID NO: 161970 - protein, 9 aa, Homo Sapiens
AYLALRISY

SEQ ID NO: 161971 - protein, 9 aa, Homo Sapiens
AYLEAHETF

SEQ ID NO: 161972 - protein, 9 aa, Homo Sapiens
AYLEALSHL

SEQ ID NO: 161973 - protein, 9 aa, Homo Sapiens
AYLEQLESL

SEQ ID NO: 161974 - protein, 9 aa, Homo Sapiens
AYLGSAIQL

SEQ ID NO: 161975 - protein, 9 aa, Homo Sapiens
AYLIMISAL

SEQ ID NO: 161976 - protein, 9 aa, Homo Sapiens
AYLNYKVCL

SEQ ID NO: 161977 - protein, 9 aa, Homo Sapiens
AYLPNGAAL

SEQ ID NO: 161978 - protein, 9 aa, Homo Sapiens
AYLPVNESF

SEQ ID NO: 161979 - protein, 9 aa, Homo Sapiens
AYLQSYLSY

SEQ ID NO: 161980 - protein, 9 aa, Homo Sapiens
AYLSKAMEI

SEQ ID NO: 161981 - protein, 9 aa, Homo Sapiens
AYLTLTSRM

SEQ ID NO: 161982 - protein, 9 aa, Homo Sapiens
AYLWTKQVL

SEQ ID NO: 161983 - protein, 9 aa, Homo Sapiens
AYMAAFNSI

SEQ ID NO: 161984 - protein, 9 aa, Homo Sapiens
AYMELVNNM

SEQ ID NO: 161985 - protein, 9 aa, Homo Sapiens
AYMKSLLSL

SEQ ID NO: 161986 - protein, 9 aa, Homo Sapiens
AYMPHTFFI

SEQ ID NO: 161987 - protein, 9 aa, Homo Sapiens
AYMPPTSEA

SEQ ID NO: 161988 - protein, 9 aa, Homo Sapiens
AYMSIMTQM

SEQ ID NO: 161989 - protein, 9 aa, Homo Sapiens
AYNAVVRYF

SEQ ID NO: 161990 - protein, 9 aa, Homo Sapiens
AYNFPVTAM

SEQ ID NO: 161991 - protein, 9 aa, Homo Sapiens
AYNNVKACL

SEQ ID NO: 161992 - protein, 9 aa, Homo Sapiens
AYNPMARDL

SEQ ID NO: 161993 - protein, 9 aa, Homo Sapiens
AYNYYTKAI

SEQ ID NO: 161994 - protein, 9 aa, Homo Sapiens
AYPEIVAVY

SEQ ID NO: 161995 - protein, 9 aa, Homo Sapiens
AYPEYLITF

SEQ ID NO: 161996 - protein, 9 aa, Homo Sapiens
AYPEYLITY

SEQ ID NO: 161997 - protein, 9 aa, Homo Sapiens
AYPHFMSIL

SEQ ID NO: 161998 - protein, 9 aa, Homo Sapiens
AYPHNLMTF

SEQ ID NO: 161999 - protein, 9 aa, Homo Sapiens
AYPLVGHAL

SEQ ID NO: 162000 - protein, 9 aa, Homo Sapiens
AYPPGVKEI

SEQ ID NO: 162001 - protein, 9 aa, Homo Sapiens
AYPVGGLCY

SEQ ID NO: 162002 - protein, 9 aa, Homo Sapiens
AYPYNFSNL

SEQ ID NO: 162003 - protein, 9 aa, Homo Sapiens
AYPYYASAF

SEQ ID NO: 162004 - protein, 9 aa, Homo Sapiens
AYQAKVLQL

SEQ ID NO: 162005 - protein, 9 aa, Homo Sapiens
AYQDRLAYL

SEQ ID NO: 162006 - protein, 9 aa, Homo Sapiens
AYQEAVRTL

SEQ ID NO: 162007 - protein, 9 aa, Homo Sapiens
AYQFFREAL

SEQ ID NO: 162008 - protein, 9 aa, Homo Sapiens
AYQGVLVEL

SEQ ID NO: 162009 - protein, 9 aa, Homo Sapiens
AYQLAGHSF

SEQ ID NO: 162010 - protein, 9 aa, Homo Sapiens
AYQLMTDVF

SEQ ID NO: 162011 - protein, 9 aa, Homo Sapiens
AYQLMVDVF

SEQ ID NO: 162012 - protein, 9 aa, Homo Sapiens
AYQQRVTAL

SEQ ID NO: 162013 - protein, 9 aa, Homo Sapiens
AYQSIQNYL

SEQ ID NO: 162014 - protein, 9 aa, Homo Sapiens
AYQVSVCAF

SEQ ID NO: 162015 - protein, 9 aa, Homo Sapiens
AYQYTIRAH

SEQ ID NO: 162016 - protein, 9 aa, Homo Sapiens
AYSDLFRSL

SEQ ID NO: 162017 - protein, 9 aa, Homo Sapiens
AYSHIYSSY

SEQ ID NO: 162018 - protein, 9 aa, Homo Sapiens
AYTLGVKQL

SEQ ID NO: 162019 - protein, 9 aa, Homo Sapiens
AYTPFHAVL

SEQ ID NO: 162020 - protein, 9 aa, Homo Sapiens
AYVDKYRHM

SEQ ID NO: 162021 - protein, 9 aa, Homo Sapiens
AYVDYKTVL

SEQ ID NO: 162022 - protein, 9 aa, Homo Sapiens
AYVHMVTHF

SEQ ID NO: 162023 - protein, 9 aa, Homo Sapiens
AYVPGFAHI

SEQ ID NO: 162024 - protein, 9 aa, Homo Sapiens
AYVPVSRAV

SEQ ID NO: 162025 - protein, 9 aa, Homo Sapiens
AYVSPRAPF

SEQ ID NO: 162026 - protein, 9 aa, Homo Sapiens
AYYEHRLQL

SEQ ID NO: 162027 - protein, 9 aa, Homo Sapiens
AYYEKGVAF

SEQ ID NO: 162028 - protein, 9 aa, Homo Sapiens
AYYERALQL

SEQ ID NO: 162029 - protein, 9 aa, Homo Sapiens
AYYFHLQTF

SEQ ID NO: 162030 - protein, 9 aa, Homo Sapiens
AYYGNISHF

SEQ ID NO: 162031 - protein, 9 aa, Homo Sapiens
AYYKKALEL

SEQ ID NO: 162032 - protein, 9 aa, Homo Sapiens
AYYPSSFPK

SEQ ID NO: 162033 - protein, 9 aa, Homo Sapiens
AYYQFINEL

SEQ ID NO: 162034 - protein, 9 aa, Homo Sapiens
AYYVSNEEL

SEQ ID NO: 162035 - protein, 9 aa, Homo Sapiens
AYYYSLQIY

SEQ ID NO: 162036 - protein, 9 aa, Homo Sapiens
CFFPNGNAF

SEQ ID NO: 162037 - protein, 9 aa, Homo Sapiens
CFNPMKSVL

SEQ ID NO: 162038 - protein, 9 aa, Homo Sapiens
CFRYYSSEY

SEQ ID NO: 162039 - protein, 9 aa, Homo Sapiens
CFYGFQIAM

SEQ ID NO: 162040 - protein, 9 aa, Homo Sapiens
CYQEGLRSL

SEQ ID NO: 162041 - protein, 9 aa, Homo Sapiens
EFNHYLTSM

SEQ ID NO: 162042 - protein, 9 aa, Homo Sapiens
EFPAAAREL

SEQ ID NO: 162043 - protein, 9 aa, Homo Sapiens
EWPPFVVTL

SEQ ID NO: 162044 - protein, 9 aa, Homo Sapiens
EYHIMSSCY

SEQ ID NO: 162045 - protein, 9 aa, Homo Sapiens
EYIPGTTSL

SEQ ID NO: 162046 - protein, 9 aa, Homo Sapiens
EYLEKALEY

SEQ ID NO: 162047 - protein, 9 aa, Homo Sapiens
FALNTKTSY

SEQ ID NO: 162048 - protein, 9 aa, Homo Sapiens
FAPYERRAM

SEQ ID NO: 162049 - protein, 9 aa, Homo Sapiens
FFAKQATEL

SEQ ID NO: 162050 - protein, 9 aa, Homo Sapiens
FFDEKLNSL

SEQ ID NO: 162051 - protein, 9 aa, Homo Sapiens
FFEDEKPAL

SEQ ID NO: 162052 - protein, 9 aa, Homo Sapiens
FFFAPASSY

SEQ ID NO: 162053 - protein, 9 aa, Homo Sapiens
FFFSLSSSL

SEQ ID NO: 162054 - protein, 9 aa, Homo Sapiens
FFFTARTSF

SEQ ID NO: 162055 - protein, 9 aa, Homo Sapiens
FFGTHETAF

SEQ ID NO: 162056 - protein, 9 aa, Homo Sapiens
FFHEYLVSV

SEQ ID NO: 162057 - protein, 9 aa, Homo Sapiens
FFHIQAQKL

SEQ ID NO: 162058 - protein, 9 aa, Homo Sapiens
FFHLVNSEM

SEQ ID NO: 162059 - protein, 9 aa, Homo Sapiens
FFHNVDVPF

SEQ ID NO: 162060 - protein, 9 aa, Homo Sapiens
FFHWVNNVL

SEQ ID NO: 162061 - protein, 9 aa, Homo Sapiens
FFHYAVDNL

SEQ ID NO: 162062 - protein, 9 aa, Homo Sapiens
FFIACVTSF

SEQ ID NO: 162063 - protein, 9 aa, Homo Sapiens
FFIAGRYEF

SEQ ID NO: 162064 - protein, 9 aa, Homo Sapiens
FFIDCMAAL

SEQ ID NO: 162065 - protein, 9 aa, Homo Sapiens
FFIDQANYF

SEQ ID NO: 162066 - protein, 9 aa, Homo Sapiens
FFIDSVLGL

SEQ ID NO: 162067 - protein, 9 aa, Homo Sapiens
FFINEAMEL

SEQ ID NO: 162068 - protein, 9 aa, Homo Sapiens
FFIPGVSVV

SEQ ID NO: 162069 - protein, 9 aa, Homo Sapiens
FFIQDQIAL

SEQ ID NO: 162070 - protein, 9 aa, Homo Sapiens
FFIRQGRSY

SEQ ID NO: 162071 - protein, 9 aa, Homo Sapiens
FFITLPLSL

SEQ ID NO: 162072 - protein, 9 aa, Homo Sapiens
FFKERVMEI

SEQ ID NO: 162073 - protein, 9 aa, Homo Sapiens
FFKLPGGEL

SEQ ID NO: 162074 - protein, 9 aa, Homo Sapiens
FFLARPTTF

SEQ ID NO: 162075 - protein, 9 aa, Homo Sapiens
FFLIVKTLY

SEQ ID NO: 162076 - protein, 9 aa, Homo Sapiens
FFLQKRLQL

SEQ ID NO: 162077 - protein, 9 aa, Homo Sapiens
FFLRMKCTL

SEQ ID NO: 162078 - protein, 9 aa, Homo Sapiens
FFLSHQTAL

SEQ ID NO: 162079 - protein, 9 aa, Homo Sapiens
FFLSKIRSH

SEQ ID NO: 162080 - protein, 9 aa, Homo Sapiens
FFLSQQASL

SEQ ID NO: 162081 - protein, 9 aa, Homo Sapiens
FFLVQTKEV

SEQ ID NO: 162082 - protein, 9 aa, Homo Sapiens
FFMEELNTY

SEQ ID NO: 162083 - protein, 9 aa, Homo Sapiens
FFMEKRAKY

SEQ ID NO: 162084 - protein, 9 aa, Homo Sapiens
FFMERSWSV

SEQ ID NO: 162085 - protein, 9 aa, Homo Sapiens
FFMLRSLSL

SEQ ID NO: 162086 - protein, 9 aa, Homo Sapiens
FFMPGFAPL

SEQ ID NO: 162087 - protein, 9 aa, Homo Sapiens
FFNAVMQNL

SEQ ID NO: 162088 - protein, 9 aa, Homo Sapiens
FFNDTTTAF

SEQ ID NO: 162089 - protein, 9 aa, Homo Sapiens
FFNGLRTEL

SEQ ID NO: 162090 - protein, 9 aa, Homo Sapiens
FFNLTVKEM

SEQ ID NO: 162091 - protein, 9 aa, Homo Sapiens
FFNNQIEEL

SEQ ID NO: 162092 - protein, 9 aa, Homo Sapiens
FFNNRIIAI

SEQ ID NO: 162093 - protein, 9 aa, Homo Sapiens
FFNSVRSVF

SEQ ID NO: 162094 - protein, 9 aa, Homo Sapiens
FFNYTVRTL

SEQ ID NO: 162095 - protein, 9 aa, Homo Sapiens
FFPALHESL

SEQ ID NO: 162096 - protein, 9 aa, Homo Sapiens
FFPDFIWTV

SEQ ID NO: 162097 - protein, 9 aa, Homo Sapiens
FFPEYTHQL

SEQ ID NO: 162098 - protein, 9 aa, Homo Sapiens
FFPFDTRQM

SEQ ID NO: 162099 - protein, 9 aa, Homo Sapiens
FFPFNPLDF

SEQ ID NO: 162100 - protein, 9 aa, Homo Sapiens
FFPGFPLAL

SEQ ID NO: 162101 - protein, 9 aa, Homo Sapiens
FFPIAGLEF

SEQ ID NO: 162102 - protein, 9 aa, Homo Sapiens
FFPKKLLEL

SEQ ID NO: 162103 - protein, 9 aa, Homo Sapiens
FFPLHPMMI

SEQ ID NO: 162104 - protein, 9 aa, Homo Sapiens
FFPMHFQAF

SEQ ID NO: 162105 - protein, 9 aa, Homo Sapiens
FFPPFVSCI

SEQ ID NO: 162106 - protein, 9 aa, Homo Sapiens
FFPSNVEQF

SEQ ID NO: 162107 - protein, 9 aa, Homo Sapiens
FFPTQGHDY

SEQ ID NO: 162108 - protein, 9 aa, Homo Sapiens
FFPVHFQEF

SEQ ID NO: 162109 - protein, 9 aa, Homo Sapiens
FFQDKARFY

SEQ ID NO: 162110 - protein, 9 aa, Homo Sapiens
FFQETNIPY

SEQ ID NO: 162111 - protein, 9 aa, Homo Sapiens
FFQFGGQSL

SEQ ID NO: 162112 - protein, 9 aa, Homo Sapiens
FFQNAFIFF

SEQ ID NO: 162113 - protein, 9 aa, Homo Sapiens
FFQPMAECL

SEQ ID NO: 162114 - protein, 9 aa, Homo Sapiens
FFQQTTTSF

SEQ ID NO: 162115 - protein, 9 aa, Homo Sapiens
FFSDSALCF

SEQ ID NO: 162116 - protein, 9 aa, Homo Sapiens
FFSEREASF

SEQ ID NO: 162117 - protein, 9 aa, Homo Sapiens
FFSEYEKLL

SEQ ID NO: 162118 - protein, 9 aa, Homo Sapiens
FFSPKVVSL

SEQ ID NO: 162119 - protein, 9 aa, Homo Sapiens
FFTARTSFF

SEQ ID NO: 162120 - protein, 9 aa, Homo Sapiens
FFTDNVPAL

SEQ ID NO: 162121 - protein, 9 aa, Homo Sapiens
FFTEQNLSY

SEQ ID NO: 162122 - protein, 9 aa, Homo Sapiens
FFTSKALNM

SEQ ID NO: 162123 - protein, 9 aa, Homo Sapiens
FFVENVSEL

SEQ ID NO: 162124 - protein, 9 aa, Homo Sapiens
FFVGYGVTL

SEQ ID NO: 162125 - protein, 9 aa, Homo Sapiens
FFVVMEHCL

SEQ ID NO: 162126 - protein, 9 aa, Homo Sapiens
FFWIQNVSL

SEQ ID NO: 162127 - protein, 9 aa, Homo Sapiens
FFWTARLAF

SEQ ID NO: 162128 - protein, 9 aa, Homo Sapiens
FFYEGSRVL

SEQ ID NO: 162129 - protein, 9 aa, Homo Sapiens
FFYEKISAW

SEQ ID NO: 162130 - protein, 9 aa, Homo Sapiens
FFYNAIKSY

SEQ ID NO: 162131 - protein, 9 aa, Homo Sapiens
FFYPGWKVL

SEQ ID NO: 162132 - protein, 9 aa, Homo Sapiens
FFYPLDFTF

SEQ ID NO: 162133 - protein, 9 aa, Homo Sapiens
FFYQRLVEF

SEQ ID NO: 162134 - protein, 9 aa, Homo Sapiens
FFYSEIMEL

SEQ ID NO: 162135 - protein, 9 aa, Homo Sapiens
FFYTHLINF

SEQ ID NO: 162136 - protein, 9 aa, Homo Sapiens
FFYVTETTF

SEQ ID NO: 162137 - protein, 9 aa, Homo Sapiens
FIAPTGHSL

SEQ ID NO: 162138 - protein, 9 aa, Homo Sapiens
FIISRTQAL

SEQ ID NO: 162139 - protein, 9 aa, Homo Sapiens
FIMDRAQAL

SEQ ID NO: 162140 - protein, 9 aa, Homo Sapiens
FIRVSGSEL

SEQ ID NO: 162141 - protein, 9 aa, Homo Sapiens
FIVEETLPL

SEQ ID NO: 162142 - protein, 9 aa, Homo Sapiens
FLPDHPIVL

SEQ ID NO: 162143 - protein, 9 aa, Homo Sapiens
FLPEMMVDH

SEQ ID NO: 162144 - protein, 9 aa, Homo Sapiens
FLPKGYLAL

SEQ ID NO: 162145 - protein, 9 aa, Homo Sapiens
FLPLFDRVL

SEQ ID NO: 162146 - protein, 9 aa, Homo Sapiens
FLPSHYNYL

SEQ ID NO: 162147 - protein, 9 aa, Homo Sapiens
FLYPFFGVL

SEQ ID NO: 162148 - protein, 9 aa, Homo Sapiens
FLYPFPLAL

SEQ ID NO: 162149 - protein, 9 aa, Homo Sapiens
FMHVQLEVM

SEQ ID NO: 162150 - protein, 9 aa, Homo Sapiens
FMLPKALAL

SEQ ID NO: 162151 - protein, 9 aa, Homo Sapiens
FTIFRTISV

SEQ ID NO: 162152 - protein, 9 aa, Homo Sapiens
FVRDMIREV

SEQ ID NO: 162153 - protein, 9 aa, Homo Sapiens
FVYITDNAY

SEQ ID NO: 162154 - protein, 9 aa, Homo Sapiens
FWPAVVKSV

SEQ ID NO: 162155 - protein, 9 aa, Homo Sapiens
FWPEAFSEV

SEQ ID NO: 162156 - protein, 9 aa, Homo Sapiens
FWPNPCSTF

SEQ ID NO: 162157 - protein, 9 aa, Homo Sapiens
FWPPQPKLY

SEQ ID NO: 162158 - protein, 9 aa, Homo Sapiens
FWPPYVELL

SEQ ID NO: 162159 - protein, 9 aa, Homo Sapiens
FYAEALRAV

SEQ ID NO: 162160 - protein, 9 aa, Homo Sapiens
FYAHSLVEL

SEQ ID NO: 162161 - protein, 9 aa, Homo Sapiens
FYAKGALQY

SEQ ID NO: 162162 - protein, 9 aa, Homo Sapiens
FYALVSQEL

SEQ ID NO: 162163 - protein, 9 aa, Homo Sapiens
FYCGGRLML

SEQ ID NO: 162164 - protein, 9 aa, Homo Sapiens
FYDDKKYTY

SEQ ID NO: 162165 - protein, 9 aa, Homo Sapiens
FYDNKGITY

SEQ ID NO: 162166 - protein, 9 aa, Homo Sapiens
FYEDNVLYM

SEQ ID NO: 162167 - protein, 9 aa, Homo Sapiens
FYEECKMEY

SEQ ID NO: 162168 - protein, 9 aa, Homo Sapiens
FYEERLTWH

SEQ ID NO: 162169 - protein, 9 aa, Homo Sapiens
FYEETKVKF

SEQ ID NO: 162170 - protein, 9 aa, Homo Sapiens
FYEGHITSL

SEQ ID NO: 162171 - protein, 9 aa, Homo Sapiens
FYEPYSREL

SEQ ID NO: 162172 - protein, 9 aa, Homo Sapiens
FYFALRDTL

SEQ ID NO: 162173 - protein, 9 aa, Homo Sapiens
FYFASKLVL

SEQ ID NO: 162174 - protein, 9 aa, Homo Sapiens
FYFDRNPYF

SEQ ID NO: 162175 - protein, 9 aa, Homo Sapiens
FYFPRCQGF

SEQ ID NO: 162176 - protein, 9 aa, Homo Sapiens
FYFTVRECY

SEQ ID NO: 162177 - protein, 9 aa, Homo Sapiens
FYGDLRKAL

SEQ ID NO: 162178 - protein, 9 aa, Homo Sapiens
FYHAYDSYL

SEQ ID NO: 162179 - protein, 9 aa, Homo Sapiens
FYHDAKEIF

SEQ ID NO: 162180 - protein, 9 aa, Homo Sapiens
FYHEAVVLF

SEQ ID NO: 162181 - protein, 9 aa, Homo Sapiens
FYHFVQIVH

SEQ ID NO: 162182 - protein, 9 aa, Homo Sapiens
FYHKGIASL

SEQ ID NO: 162183 - protein, 9 aa, Homo Sapiens
FYHPETQQY

SEQ ID NO: 162184 - protein, 9 aa, Homo Sapiens
FYHPETTQL

SEQ ID NO: 162185 - protein, 9 aa, Homo Sapiens
FYICHEVHL

SEQ ID NO: 162186 - protein, 9 aa, Homo Sapiens
FYIENQKEY

SEQ ID NO: 162187 - protein, 9 aa, Homo Sapiens
FYIESISYL

SEQ ID NO: 162188 - protein, 9 aa, Homo Sapiens
FYIFDRDVF

SEQ ID NO: 162189 - protein, 9 aa, Homo Sapiens
FYIIEREPL

SEQ ID NO: 162190 - protein, 9 aa, Homo Sapiens
FYIIGAITL

SEQ ID NO: 162191 - protein, 9 aa, Homo Sapiens
FYILTSKEL

SEQ ID NO: 162192 - protein, 9 aa, Homo Sapiens
FYIPKIQDL

SEQ ID NO: 162193 - protein, 9 aa, Homo Sapiens
FYIPQRPYM

SEQ ID NO: 162194 - protein, 9 aa, Homo Sapiens
FYISPRITF

SEQ ID NO: 162195 - protein, 9 aa, Homo Sapiens
FYISPVNKL

SEQ ID NO: 162196 - protein, 9 aa, Homo Sapiens
FYISWAEEY

SEQ ID NO: 162197 - protein, 9 aa, Homo Sapiens
FYITPSTSL

SEQ ID NO: 162198 - protein, 9 aa, Homo Sapiens
FYITSRTQF

SEQ ID NO: 162199 - protein, 9 aa, Homo Sapiens
FYIVDRDAF

SEQ ID NO: 162200 - protein, 9 aa, Homo Sapiens
FYIYGVSDL

SEQ ID NO: 162201 - protein, 9 aa, Homo Sapiens
FYLDNVIGH

SEQ ID NO: 162202 - protein, 9 aa, Homo Sapiens
FYLDTVSAL

SEQ ID NO: 162203 - protein, 9 aa, Homo Sapiens
FYLFHPLAY

SEQ ID NO: 162204 - protein, 9 aa, Homo Sapiens
FYLFHVQEV

SEQ ID NO: 162205 - protein, 9 aa, Homo Sapiens
FYLGKRCAY

SEQ ID NO: 162206 - protein, 9 aa, Homo Sapiens
FYLNQSTAY

SEQ ID NO: 162207 - protein, 9 aa, Homo Sapiens
FYLPHGLSI

SEQ ID NO: 162208 - protein, 9 aa, Homo Sapiens
FYLRDPIDL

SEQ ID NO: 162209 - protein, 9 aa, Homo Sapiens
FYLSKMISM

SEQ ID NO: 162210 - protein, 9 aa, Homo Sapiens
FYMDTSHLF

SEQ ID NO: 162211 - protein, 9 aa, Homo Sapiens
FYMEDYLTV

SEQ ID NO: 162212 - protein, 9 aa, Homo Sapiens
FYNCLQHAL

SEQ ID NO: 162213 - protein, 9 aa, Homo Sapiens
FYNEYVREL

SEQ ID NO: 162214 - protein, 9 aa, Homo Sapiens
FYNGPVSKF

SEQ ID NO: 162215 - protein, 9 aa, Homo Sapiens
FYNLIHPEY

SEQ ID NO: 162216 - protein, 9 aa, Homo Sapiens
FYNLSIQSF

SEQ ID NO: 162217 - protein, 9 aa, Homo Sapiens
FYNNRLQAY

SEQ ID NO: 162218 - protein, 9 aa, Homo Sapiens
FYNQVSTPL

SEQ ID NO: 162219 - protein, 9 aa, Homo Sapiens
FYNTSIEEM

SEQ ID NO: 162220 - protein, 9 aa, Homo Sapiens
FYPAKVTAV

SEQ ID NO: 162221 - protein, 9 aa, Homo Sapiens
FYPDAVEEW

SEQ ID NO: 162222 - protein, 9 aa, Homo Sapiens
FYPDKIDYA

SEQ ID NO: 162223 - protein, 9 aa, Homo Sapiens
FYPDLGPEL

SEQ ID NO: 162224 - protein, 9 aa, Homo Sapiens
FYPEEISSM

SEQ ID NO: 162225 - protein, 9 aa, Homo Sapiens
FYPEEVSSM

SEQ ID NO: 162226 - protein, 9 aa, Homo Sapiens
FYPELKLAY

SEQ ID NO: 162227 - protein, 9 aa, Homo Sapiens
FYPFAGHDL

SEQ ID NO: 162228 - protein, 9 aa, Homo Sapiens
FYPGLGLAL

SEQ ID NO: 162229 - protein, 9 aa, Homo Sapiens
FYPGQAPSL

SEQ ID NO: 162230 - protein, 9 aa, Homo Sapiens
FYPHHPQML

SEQ ID NO: 162231 - protein, 9 aa, Homo Sapiens
FYPIYFRPL

SEQ ID NO: 162232 - protein, 9 aa, Homo Sapiens
FYPPDPAQL

SEQ ID NO: 162233 - protein, 9 aa, Homo Sapiens
FYPPKVELF

SEQ ID NO: 162234 - protein, 9 aa, Homo Sapiens
FYPPLTSSL

SEQ ID NO: 162235 - protein, 9 aa, Homo Sapiens
FYPPPRITL

SEQ ID NO: 162236 - protein, 9 aa, Homo Sapiens
FYPSGGLEV

SEQ ID NO: 162237 - protein, 9 aa, Homo Sapiens
FYPTFKEGM

SEQ ID NO: 162238 - protein, 9 aa, Homo Sapiens
FYPYGLQTF

SEQ ID NO: 162239 - protein, 9 aa, Homo Sapiens
FYQDKLKSL

SEQ ID NO: 162240 - protein, 9 aa, Homo Sapiens
FYQGHVEGY

SEQ ID NO: 162241 - protein, 9 aa, Homo Sapiens
FYQGIVQQF

SEQ ID NO: 162242 - protein, 9 aa, Homo Sapiens
FYQHNVEKL

SEQ ID NO: 162243 - protein, 9 aa, Homo Sapiens
FYQPKIQQF

SEQ ID NO: 162244 - protein, 9 aa, Homo Sapiens
FYQPMPLKA

SEQ ID NO: 162245 - protein, 9 aa, Homo Sapiens
FYQPTCIVL

SEQ ID NO: 162246 - protein, 9 aa, Homo Sapiens
FYQRFPLSF

SEQ ID NO: 162247 - protein, 9 aa, Homo Sapiens
FYRPLAPEL

SEQ ID NO: 162248 - protein, 9 aa, Homo Sapiens
FYSEVHPHY

SEQ ID NO: 162249 - protein, 9 aa, Homo Sapiens
FYSGSPTSY

SEQ ID NO: 162250 - protein, 9 aa, Homo Sapiens
FYSNKEIFL

SEQ ID NO: 162251 - protein, 9 aa, Homo Sapiens
FYSPNIMAL

SEQ ID NO: 162252 - protein, 9 aa, Homo Sapiens
FYTVAVTSL

SEQ ID NO: 162253 - protein, 9 aa, Homo Sapiens
FYVASSRQL

SEQ ID NO: 162254 - protein, 9 aa, Homo Sapiens
FYVDTVRAF

SEQ ID NO: 162255 - protein, 9 aa, Homo Sapiens
FYVETVVTY

SEQ ID NO: 162256 - protein, 9 aa, Homo Sapiens
FYVGEIIGK

SEQ ID NO: 162257 - protein, 9 aa, Homo Sapiens
FYVLSTLAF

SEQ ID NO: 162258 - protein, 9 aa, Homo Sapiens
FYVPFAKAL

SEQ ID NO: 162259 - protein, 9 aa, Homo Sapiens
FYVRLIDSM

SEQ ID NO: 162260 - protein, 9 aa, Homo Sapiens
FYVVVTEGY

SEQ ID NO: 162261 - protein, 9 aa, Homo Sapiens
FYWARKTSH

SEQ ID NO: 162262 - protein, 9 aa, Homo Sapiens
FYYGGQVNY

SEQ ID NO: 162263 - protein, 9 aa, Homo Sapiens
FYYIRISEL

SEQ ID NO: 162264 - protein, 9 aa, Homo Sapiens
GFIDSFRPL

SEQ ID NO: 162265 - protein, 9 aa, Homo Sapiens
GFLGGAKAM

SEQ ID NO: 162266 - protein, 9 aa, Homo Sapiens
GFMPGAHVF

SEQ ID NO: 162267 - protein, 9 aa, Homo Sapiens
GFPEAASSF

SEQ ID NO: 162268 - protein, 9 aa, Homo Sapiens
GFPEQATAF

SEQ ID NO: 162269 - protein, 9 aa, Homo Sapiens
GFPFYDKPM

SEQ ID NO: 162270 - protein, 9 aa, Homo Sapiens
GFPFYGKPM

SEQ ID NO: 162271 - protein, 9 aa, Homo Sapiens
GFPSSVAAL

SEQ ID NO: 162272 - protein, 9 aa, Homo Sapiens
GFPWKTSDF

SEQ ID NO: 162273 - protein, 9 aa, Homo Sapiens
GFQTGTSSL

SEQ ID NO: 162274 - protein, 9 aa, Homo Sapiens
GFVNHALEL

SEQ ID NO: 162275 - protein, 9 aa, Homo Sapiens
GKEIIEYYL

SEQ ID NO: 162276 - protein, 9 aa, Homo Sapiens
GYAPYVNRI

SEQ ID NO: 162277 - protein, 9 aa, Homo Sapiens
GYFAGKLSY

SEQ ID NO: 162278 - protein, 9 aa, Homo Sapiens
GYHDIVECL

SEQ ID NO: 162279 - protein, 9 aa, Homo Sapiens
GYIGAALVL

SEQ ID NO: 162280 - protein, 9 aa, Homo Sapiens
GYLAANSRF

SEQ ID NO: 162281 - protein, 9 aa, Homo Sapiens
GYLAASQSF

SEQ ID NO: 162282 - protein, 9 aa, Homo Sapiens
GYLISGSSY

SEQ ID NO: 162283 - protein, 9 aa, Homo Sapiens
GYLPGTAEM

SEQ ID NO: 162284 - protein, 9 aa, Homo Sapiens
GYLPLAHVL

SEQ ID NO: 162285 - protein, 9 aa, Homo Sapiens
GYMDLASRL

SEQ ID NO: 162286 - protein, 9 aa, Homo Sapiens
GYMEKIKPM

SEQ ID NO: 162287 - protein, 9 aa, Homo Sapiens
GYPEVALHF

SEQ ID NO: 162288 - protein, 9 aa, Homo Sapiens
GYQLTGHAY

SEQ ID NO: 162289 - protein, 9 aa, Homo Sapiens
GYSFSLTTF

SEQ ID NO: 162290 - protein, 9 aa, Homo Sapiens
GYVLYASAM

SEQ ID NO: 162291 - protein, 9 aa, Homo Sapiens
GYVVVTSSM

SEQ ID NO: 162292 - protein, 9 aa, Homo Sapiens
GYYSHALYL

SEQ ID NO: 162293 - protein, 9 aa, Homo Sapiens
HAPFTATSL

SEQ ID NO: 162294 - protein, 9 aa, Homo Sapiens
HAPLTNIPL

SEQ ID NO: 162295 - protein, 9 aa, Homo Sapiens
HFFDGKTAL

SEQ ID NO: 162296 - protein, 9 aa, Homo Sapiens
HFHITNTTF

SEQ ID NO: 162297 - protein, 9 aa, Homo Sapiens
HFHTQTQSL

SEQ ID NO: 162298 - protein, 9 aa, Homo Sapiens
HFIAVAVCL

SEQ ID NO: 162299 - protein, 9 aa, Homo Sapiens
HFIEKAHTL

SEQ ID NO: 162300 - protein, 9 aa, Homo Sapiens
HFIFFVQEF

SEQ ID NO: 162301 - protein, 9 aa, Homo Sapiens
HFIRPGNAL

SEQ ID NO: 162302 - protein, 9 aa, Homo Sapiens
HFITPVSTL

SEQ ID NO: 162303 - protein, 9 aa, Homo Sapiens
HFLDRHLVF

SEQ ID NO: 162304 - protein, 9 aa, Homo Sapiens
HFLQQPRPL

SEQ ID NO: 162305 - protein, 9 aa, Homo Sapiens
HFNPTGSAF

SEQ ID NO: 162306 - protein, 9 aa, Homo Sapiens
HFNTVLEAY

SEQ ID NO: 162307 - protein, 9 aa, Homo Sapiens
HFNVTNTTF

SEQ ID NO: 162308 - protein, 9 aa, Homo Sapiens
HFPDLFHVM

SEQ ID NO: 162309 - protein, 9 aa, Homo Sapiens
HFPEFSQIL

SEQ ID NO: 162310 - protein, 9 aa, Homo Sapiens
HFPGLASEL

SEQ ID NO: 162311 - protein, 9 aa, Homo Sapiens
HFPLFESHM

SEQ ID NO: 162312 - protein, 9 aa, Homo Sapiens
HFPMQSREF

SEQ ID NO: 162313 - protein, 9 aa, Homo Sapiens
HFPPLYKEL

SEQ ID NO: 162314 - protein, 9 aa, Homo Sapiens
HFQEKVESL

SEQ ID NO: 162315 - protein, 9 aa, Homo Sapiens
HFQPSAASL

SEQ ID NO: 162316 - protein, 9 aa, Homo Sapiens
HFQPSTVEM

SEQ ID NO: 162317 - protein, 9 aa, Homo Sapiens
HFQPSVLDF

SEQ ID NO: 162318 - protein, 9 aa, Homo Sapiens
HFQTMYEHL

SEQ ID NO: 162319 - protein, 9 aa, Homo Sapiens
HFVEKAAAV

SEQ ID NO: 162320 - protein, 9 aa, Homo Sapiens
HFVPGTTAV

SEQ ID NO: 162321 - protein, 9 aa, Homo Sapiens
HFYGKAIEL

SEQ ID NO: 162322 - protein, 9 aa, Homo Sapiens
HFYLKALSL

SEQ ID NO: 162323 - protein, 9 aa, Homo Sapiens
HFYNVKSSL

SEQ ID NO: 162324 - protein, 9 aa, Homo Sapiens
HFYRSLVAH

SEQ ID NO: 162325 - protein, 9 aa, Homo Sapiens
HFYRSLVSH

SEQ ID NO: 162326 - protein, 9 aa, Homo Sapiens
HFYSSIPSM

SEQ ID NO: 162327 - protein, 9 aa, Homo Sapiens
HFYYFVKEF

SEQ ID NO: 162328 - protein, 9 aa, Homo Sapiens
HGLIRKYGL

SEQ ID NO: 162329 - protein, 9 aa, Homo Sapiens
HHPDYNNEL

SEQ ID NO: 162330 - protein, 9 aa, Homo Sapiens
HLPSGVKSL

SEQ ID NO: 162331 - protein, 9 aa, Homo Sapiens
HYFCALNTL

SEQ ID NO: 162332 - protein, 9 aa, Homo Sapiens
HYFERHLEF

SEQ ID NO: 162333 - protein, 9 aa, Homo Sapiens
HYFFAVSTL

SEQ ID NO: 162334 - protein, 9 aa, Homo Sapiens
HYFSKMKAL

SEQ ID NO: 162335 - protein, 9 aa, Homo Sapiens
HYFSPFRPY

SEQ ID NO: 162336 - protein, 9 aa, Homo Sapiens
HYFSQGLSV

SEQ ID NO: 162337 - protein, 9 aa, Homo Sapiens
HYHPIVQRF

SEQ ID NO: 162338 - protein, 9 aa, Homo Sapiens
HYHPSKVAA

SEQ ID NO: 162339 - protein, 9 aa, Homo Sapiens
HYIDRVRAL

SEQ ID NO: 162340 - protein, 9 aa, Homo Sapiens
HYIIAARAL

SEQ ID NO: 162341 - protein, 9 aa, Homo Sapiens
HYINEVLFL

SEQ ID NO: 162342 - protein, 9 aa, Homo Sapiens
HYIQMVKEL

SEQ ID NO: 162343 - protein, 9 aa, Homo Sapiens
HYITIVKSH

SEQ ID NO: 162344 - protein, 9 aa, Homo Sapiens
HYITPMMEL

SEQ ID NO: 162345 - protein, 9 aa, Homo Sapiens
HYLVSVMAV

SEQ ID NO: 162346 - protein, 9 aa, Homo Sapiens
HYLYIQMEY

SEQ ID NO: 162347 - protein, 9 aa, Homo Sapiens
HYMFEAICL

SEQ ID NO: 162348 - protein, 9 aa, Homo Sapiens
HYMSINDSF

SEQ ID NO: 162349 - protein, 9 aa, Homo Sapiens
HYNNIMALY

SEQ ID NO: 162350 - protein, 9 aa, Homo Sapiens
HYNTITDCY

SEQ ID NO: 162351 - protein, 9 aa, Homo Sapiens
HYPDFHQEL

SEQ ID NO: 162352 - protein, 9 aa, Homo Sapiens
HYPDYSWSA

SEQ ID NO: 162353 - protein, 9 aa, Homo Sapiens
HYPNWFKAL

SEQ ID NO: 162354 - protein, 9 aa, Homo Sapiens
HYQAIVTAY

SEQ ID NO: 162355 - protein, 9 aa, Homo Sapiens
HYQLQTTSL

SEQ ID NO: 162356 - protein, 9 aa, Homo Sapiens
HYQPVDVSL

SEQ ID NO: 162357 - protein, 9 aa, Homo Sapiens
HYQQAELAL

SEQ ID NO: 162358 - protein, 9 aa, Homo Sapiens
HYRYYVREM

SEQ ID NO: 162359 - protein, 9 aa, Homo Sapiens
HYSFYIETF

SEQ ID NO: 162360 - protein, 9 aa, Homo Sapiens
HYTVNLNTY

SEQ ID NO: 162361 - protein, 9 aa, Homo Sapiens
HYVFEAKEF

SEQ ID NO: 162362 - protein, 9 aa, Homo Sapiens
HYYGPALEF

SEQ ID NO: 162363 - protein, 9 aa, Homo Sapiens
HYYQKALEL

SEQ ID NO: 162364 - protein, 9 aa, Homo Sapiens
HYYSITINY

SEQ ID NO: 162365 - protein, 9 aa, Homo Sapiens
IAYDVTYSL

SEQ ID NO: 162366 - protein, 9 aa, Homo Sapiens
IFATGCSSI

SEQ ID NO: 162367 - protein, 9 aa, Homo Sapiens
IFDEFRTVL

SEQ ID NO: 162368 - protein, 9 aa, Homo Sapiens
IFEAKKSFY

SEQ ID NO: 162369 - protein, 9 aa, Homo Sapiens
IFEGGATEL

SEQ ID NO: 162370 - protein, 9 aa, Homo Sapiens
IFFPGVSEF

SEQ ID NO: 162371 - protein, 9 aa, Homo Sapiens
IFHITLVSL

SEQ ID NO: 162372 - protein, 9 aa, Homo Sapiens
IFHIVENDL

SEQ ID NO: 162373 - protein, 9 aa, Homo Sapiens
IFHNNWREM

SEQ ID NO: 162374 - protein, 9 aa, Homo Sapiens
IFIAAASEI

SEQ ID NO: 162375 - protein, 9 aa, Homo Sapiens
IFIAGSKQY

SEQ ID NO: 162376 - protein, 9 aa, Homo Sapiens
IFIDEIDSF

SEQ ID NO: 162377 - protein, 9 aa, Homo Sapiens
IFIDEIDSI

SEQ ID NO: 162378 - protein, 9 aa, Homo Sapiens
IFIDEVDSL

SEQ ID NO: 162379 - protein, 9 aa, Homo Sapiens
IFIKDSNSL

SEQ ID NO: 162380 - protein, 9 aa, Homo Sapiens
IFINLPRSM

SEQ ID NO: 162381 - protein, 9 aa, Homo Sapiens
IFIPKTEEM

SEQ ID NO: 162382 - protein, 9 aa, Homo Sapiens
IFIPSSIAF

SEQ ID NO: 162383 - protein, 9 aa, Homo Sapiens
IFLCMETHY

SEQ ID NO: 162384 - protein, 9 aa, Homo Sapiens
IFLETNMSM

SEQ ID NO: 162385 - protein, 9 aa, Homo Sapiens
IFLNLKTAL

SEQ ID NO: 162386 - protein, 9 aa, Homo Sapiens
IFMDEIDSI

SEQ ID NO: 162387 - protein, 9 aa, Homo Sapiens
IFMENRNEF

SEQ ID NO: 162388 - protein, 9 aa, Homo Sapiens
IFMERIKNM

SEQ ID NO: 162389 - protein, 9 aa, Homo Sapiens
IFNAVKASL

SEQ ID NO: 162390 - protein, 9 aa, Homo Sapiens
IFNTVNTSL

SEQ ID NO: 162391 - protein, 9 aa, Homo Sapiens
IFNVAGYSH

SEQ ID NO: 162392 - protein, 9 aa, Homo Sapiens
IFPAKTITY

SEQ ID NO: 162393 - protein, 9 aa, Homo Sapiens
IFPDRATLY

SEQ ID NO: 162394 - protein, 9 aa, Homo Sapiens
IFPEALRCL

SEQ ID NO: 162395 - protein, 9 aa, Homo Sapiens
IFPECPHVY

SEQ ID NO: 162396 - protein, 9 aa, Homo Sapiens
IFPEFLKEL

SEQ ID NO: 162397 - protein, 9 aa, Homo Sapiens
IFPEGFVEL

SEQ ID NO: 162398 - protein, 9 aa, Homo Sapiens
IFPEGRPVV

SEQ ID NO: 162399 - protein, 9 aa, Homo Sapiens
IFPLETPAF

SEQ ID NO: 162400 - protein, 9 aa, Homo Sapiens
IFPLIYSEM

SEQ ID NO: 162401 - protein, 9 aa, Homo Sapiens
IFPNQTEEL

SEQ ID NO: 162402 - protein, 9 aa, Homo Sapiens
IFPPSVGEF

SEQ ID NO: 162403 - protein, 9 aa, Homo Sapiens
IFPSSISAM

SEQ ID NO: 162404 - protein, 9 aa, Homo Sapiens
IFPTLTSPL

SEQ ID NO: 162405 - protein, 9 aa, Homo Sapiens
IFPTSTISF

SEQ ID NO: 162406 - protein, 9 aa, Homo Sapiens
IFPYAFKEV

SEQ ID NO: 162407 - protein, 9 aa, Homo Sapiens
IFQALNVYY

SEQ ID NO: 162408 - protein, 9 aa, Homo Sapiens
IFQAVETAI

SEQ ID NO: 162409 - protein, 9 aa, Homo Sapiens
IFQDPRSWF

SEQ ID NO: 162410 - protein, 9 aa, Homo Sapiens
IFQDPTAMM

SEQ ID NO: 162411 - protein, 9 aa, Homo Sapiens
IFQEPVSKY

SEQ ID NO: 162412 - protein, 9 aa, Homo Sapiens
IFQEQVEKL

SEQ ID NO: 162413 - protein, 9 aa, Homo Sapiens
IFQGNVHNF

SEQ ID NO: 162414 - protein, 9 aa, Homo Sapiens
IFQIGVLGF

SEQ ID NO: 162415 - protein, 9 aa, Homo Sapiens
IFQIHTSRM

SEQ ID NO: 162416 - protein, 9 aa, Homo Sapiens
IFQNIKQEY

SEQ ID NO: 162417 - protein, 9 aa, Homo Sapiens
IFQPHVRHL

SEQ ID NO: 162418 - protein, 9 aa, Homo Sapiens
IFQPPARCL

SEQ ID NO: 162419 - protein, 9 aa, Homo Sapiens
IFQTAKETL

SEQ ID NO: 162420 - protein, 9 aa, Homo Sapiens
IFQTGLVAY

SEQ ID NO: 162421 - protein, 9 aa, Homo Sapiens
IFSIREVSF

SEQ ID NO: 162422 - protein, 9 aa, Homo Sapiens
IFVPARNNM

SEQ ID NO: 162423 - protein, 9 aa, Homo Sapiens
IFVVASSSY

SEQ ID NO: 162424 - protein, 9 aa, Homo Sapiens
IFYDRAEYL

SEQ ID NO: 162425 - protein, 9 aa, Homo Sapiens
ILPEMVGSM

SEQ ID NO: 162426 - protein, 9 aa, Homo Sapiens
ILPKYVQQV

SEQ ID NO: 162427 - protein, 9 aa, Homo Sapiens
IPEEDAGKL

SEQ ID NO: 162428 - protein, 9 aa, Homo Sapiens
IWPEIQQEL

SEQ ID NO: 162429 - protein, 9 aa, Homo Sapiens
IWPEKVLDI

SEQ ID NO: 162430 - protein, 9 aa, Homo Sapiens
IWPLYLRFL

SEQ ID NO: 162431 - protein, 9 aa, Homo Sapiens
IWVDYINFL

SEQ ID NO: 162432 - protein, 9 aa, Homo Sapiens
IYADYARSL

SEQ ID NO: 162433 - protein, 9 aa, Homo Sapiens
IYAPKLQEF

SEQ ID NO: 162434 - protein, 9 aa, Homo Sapiens
IYATEAHVF

SEQ ID NO: 162435 - protein, 9 aa, Homo Sapiens
IYAVNGIAF

SEQ ID NO: 162436 - protein, 9 aa, Homo Sapiens
IYELMQTEF

SEQ ID NO: 162437 - protein, 9 aa, Homo Sapiens
IYFADGKVY

SEQ ID NO: 162438 - protein, 9 aa, Homo Sapiens
IYFDSSATY

SEQ ID NO: 162439 - protein, 9 aa, Homo Sapiens
IYFEYSHAF

SEQ ID NO: 162440 - protein, 9 aa, Homo Sapiens
IYFTRIIAF

SEQ ID NO: 162441 - protein, 9 aa, Homo Sapiens
IYGPHAVSL

SEQ ID NO: 162442 - protein, 9 aa, Homo Sapiens
IYHIQYDEY

SEQ ID NO: 162443 - protein, 9 aa, Homo Sapiens
IYHNGVLEF

SEQ ID NO: 162444 - protein, 9 aa, Homo Sapiens
IYHQTASIL

SEQ ID NO: 162445 - protein, 9 aa, Homo Sapiens
IYIDRGVVF

SEQ ID NO: 162446 - protein, 9 aa, Homo Sapiens
IYIINVHSM

SEQ ID NO: 162447 - protein, 9 aa, Homo Sapiens
IYILTNVAY

SEQ ID NO: 162448 - protein, 9 aa, Homo Sapiens
IYLAIQSSL

SEQ ID NO: 162449 - protein, 9 aa, Homo Sapiens
IYLDMLNVY

SEQ ID NO: 162450 - protein, 9 aa, Homo Sapiens
IYLDSVMCL

SEQ ID NO: 162451 - protein, 9 aa, Homo Sapiens
IYLEGKIDY

SEQ ID NO: 162452 - protein, 9 aa, Homo Sapiens
IYLIGHVAA

SEQ ID NO: 162453 - protein, 9 aa, Homo Sapiens
IYLIKGSAL

SEQ ID NO: 162454 - protein, 9 aa, Homo Sapiens
IYLLIHNNF

SEQ ID NO: 162455 - protein, 9 aa, Homo Sapiens
IYLPAAQTM

SEQ ID NO: 162456 - protein, 9 aa, Homo Sapiens
IYLTFPVAM

SEQ ID NO: 162457 - protein, 9 aa, Homo Sapiens
IYMDTLNIF

SEQ ID NO: 162458 - protein, 9 aa, Homo Sapiens
IYMFNMTGL

SEQ ID NO: 162459 - protein, 9 aa, Homo Sapiens
IYMGHVKGY

SEQ ID NO: 162460 - protein, 9 aa, Homo Sapiens
IYMQKVIYY

SEQ ID NO: 162461 - protein, 9 aa, Homo Sapiens
IYNEVNQTY

SEQ ID NO: 162462 - protein, 9 aa, Homo Sapiens
IYPDSFTVL

SEQ ID NO: 162463 - protein, 9 aa, Homo Sapiens
IYPEAVTMF

SEQ ID NO: 162464 - protein, 9 aa, Homo Sapiens
IYPETAAIL

SEQ ID NO: 162465 - protein, 9 aa, Homo Sapiens
IYPEVVHMF

SEQ ID NO: 162466 - protein, 9 aa, Homo Sapiens
IYPGHGMMF

SEQ ID NO: 162467 - protein, 9 aa, Homo Sapiens
IYPLGSKSL

SEQ ID NO: 162468 - protein, 9 aa, Homo Sapiens
IYPPEVAEF

SEQ ID NO: 162469 - protein, 9 aa, Homo Sapiens
IYPVGWCEL

SEQ ID NO: 162470 - protein, 9 aa, Homo Sapiens
IYPVLPKLL

SEQ ID NO: 162471 - protein, 9 aa, Homo Sapiens
IYPVNAISF

SEQ ID NO: 162472 - protein, 9 aa, Homo Sapiens
IYPYAAISY

SEQ ID NO: 162473 - protein, 9 aa, Homo Sapiens
IYPYVIQEL

SEQ ID NO: 162474 - protein, 9 aa, Homo Sapiens
IYQEKVLDL

SEQ ID NO: 162475 - protein, 9 aa, Homo Sapiens
IYQELVTKY

SEQ ID NO: 162476 - protein, 9 aa, Homo Sapiens
IYQIHKEYL

SEQ ID NO: 162477 - protein, 9 aa, Homo Sapiens
IYQNAATSF

SEQ ID NO: 162478 - protein, 9 aa, Homo Sapiens
IYQQIIQTY

SEQ ID NO: 162479 - protein, 9 aa, Homo Sapiens
IYQQQVSSL

SEQ ID NO: 162480 - protein, 9 aa, Homo Sapiens
IYQSKVREL

SEQ ID NO: 162481 - protein, 9 aa, Homo Sapiens
IYQSMPRML

SEQ ID NO: 162482 - protein, 9 aa, Homo Sapiens
IYQYMEEIY

SEQ ID NO: 162483 - protein, 9 aa, Homo Sapiens
IYQYVLNSM

SEQ ID NO: 162484 - protein, 9 aa, Homo Sapiens
IYSFHTLSF

SEQ ID NO: 162485 - protein, 9 aa, Homo Sapiens
IYSPEGHVL

SEQ ID NO: 162486 - protein, 9 aa, Homo Sapiens
IYSSKTLEL

SEQ ID NO: 162487 - protein, 9 aa, Homo Sapiens
IYTSSVNRL

SEQ ID NO: 162488 - protein, 9 aa, Homo Sapiens
IYVAYCTVY

SEQ ID NO: 162489 - protein, 9 aa, Homo Sapiens
IYVISAETF

SEQ ID NO: 162490 - protein, 9 aa, Homo Sapiens
IYVNMKTDF

SEQ ID NO: 162491 - protein, 9 aa, Homo Sapiens
IYVSERTEL

SEQ ID NO: 162492 - protein, 9 aa, Homo Sapiens
IYVTGGYSY

SEQ ID NO: 162493 - protein, 9 aa, Homo Sapiens
IYVTGITNH

SEQ ID NO: 162494 - protein, 9 aa, Homo Sapiens
IYWDGPLAL

SEQ ID NO: 162495 - protein, 9 aa, Homo Sapiens
IYYFAAVAH

SEQ ID NO: 162496 - protein, 9 aa, Homo Sapiens
IYYFKANVF

SEQ ID NO: 162497 - protein, 9 aa, Homo Sapiens
IYYQSPLSL

SEQ ID NO: 162498 - protein, 9 aa, Homo Sapiens
IYYWHVIAA

SEQ ID NO: 162499 - protein, 9 aa, Homo Sapiens
KAPEPLSSL

SEQ ID NO: 162500 - protein, 9 aa, Homo Sapiens
KFFDSACTM

SEQ ID NO: 162501 - protein, 9 aa, Homo Sapiens
KFIDKQLEL

SEQ ID NO: 162502 - protein, 9 aa, Homo Sapiens
KFIDTTSKF

SEQ ID NO: 162503 - protein, 9 aa, Homo Sapiens
KFIEKAQNM

SEQ ID NO: 162504 - protein, 9 aa, Homo Sapiens
KFISGILAA

SEQ ID NO: 162505 - protein, 9 aa, Homo Sapiens
KFISSVTSH

SEQ ID NO: 162506 - protein, 9 aa, Homo Sapiens
KFKEVGEAF

SEQ ID NO: 162507 - protein, 9 aa, Homo Sapiens
KFLAAGTHL

SEQ ID NO: 162508 - protein, 9 aa, Homo Sapiens
KFLANVSTV

SEQ ID NO: 162509 - protein, 9 aa, Homo Sapiens
KFLASDVVF

SEQ ID NO: 162510 - protein, 9 aa, Homo Sapiens
KFLERFTSM

SEQ ID NO: 162511 - protein, 9 aa, Homo Sapiens
KFLNAESYY

SEQ ID NO: 162512 - protein, 9 aa, Homo Sapiens
KFLPDAQAL

SEQ ID NO: 162513 - protein, 9 aa, Homo Sapiens
KFLVAVESM

SEQ ID NO: 162514 - protein, 9 aa, Homo Sapiens
KFMDKKLSL

SEQ ID NO: 162515 - protein, 9 aa, Homo Sapiens
KFMQDVNTL

SEQ ID NO: 162516 - protein, 9 aa, Homo Sapiens
KFNPCGKVF

SEQ ID NO: 162517 - protein, 9 aa, Homo Sapiens
KFNVLLTTY

SEQ ID NO: 162518 - protein, 9 aa, Homo Sapiens
KFNVTTVDM

SEQ ID NO: 162519 - protein, 9 aa, Homo Sapiens
KFPAYERVL

SEQ ID NO: 162520 - protein, 9 aa, Homo Sapiens
KFPDGFEKF

SEQ ID NO: 162521 - protein, 9 aa, Homo Sapiens
KFPDSVEEL

SEQ ID NO: 162522 - protein, 9 aa, Homo Sapiens
KFPDYKSTW

SEQ ID NO: 162523 - protein, 9 aa, Homo Sapiens
KFPEIVAPL

SEQ ID NO: 162524 - protein, 9 aa, Homo Sapiens
KFPEVIINF

SEQ ID NO: 162525 - protein, 9 aa, Homo Sapiens
KFPIVNAEL

SEQ ID NO: 162526 - protein, 9 aa, Homo Sapiens
KFPTYPVPH

SEQ ID NO: 162527 - protein, 9 aa, Homo Sapiens
KFQAMDISL

SEQ ID NO: 162528 - protein, 9 aa, Homo Sapiens
KFSPNTSQF

SEQ ID NO: 162529 - protein, 9 aa, Homo Sapiens
KFVEKMTSF

SEQ ID NO: 162530 - protein, 9 aa, Homo Sapiens
KFYATLVRY

SEQ ID NO: 162531 - protein, 9 aa, Homo Sapiens
KFYNAGLAY

SEQ ID NO: 162532 - protein, 9 aa, Homo Sapiens
KFYSVNVDY

SEQ ID NO: 162533 - protein, 9 aa, Homo Sapiens
KFYYSKIEY

SEQ ID NO: 162534 - protein, 9 aa, Homo Sapiens
KIVKWDRDM

SEQ ID NO: 162535 - protein, 9 aa, Homo Sapiens
KLPANHPLL

SEQ ID NO: 162536 - protein, 9 aa, Homo Sapiens
KLPDYNNRL

SEQ ID NO: 162537 - protein, 9 aa, Homo Sapiens
KLPGNISSL

SEQ ID NO: 162538 - protein, 9 aa, Homo Sapiens
KWPETPLLL

SEQ ID NO: 162539 - protein, 9 aa, Homo Sapiens
KYAMMFAEL

SEQ ID NO: 162540 - protein, 9 aa, Homo Sapiens
KYAVQLVEM

SEQ ID NO: 162541 - protein, 9 aa, Homo Sapiens
KYFGRSLEL

SEQ ID NO: 162542 - protein, 9 aa, Homo Sapiens
KYFPSRVSI

SEQ ID NO: 162543 - protein, 9 aa, Homo Sapiens
KYFSSLTTH

SEQ ID NO: 162544 - protein, 9 aa, Homo Sapiens
KYFSSMAEF

SEQ ID NO: 162545 - protein, 9 aa, Homo Sapiens
KYFTQGNCV

SEQ ID NO: 162546 - protein, 9 aa, Homo Sapiens
KYHVSEKPY

SEQ ID NO: 162547 - protein, 9 aa, Homo Sapiens
KYIDFTSDY

SEQ ID NO: 162548 - protein, 9 aa, Homo Sapiens
KYIEGVSDF

SEQ ID NO: 162549 - protein, 9 aa, Homo Sapiens
KYIGYARQY

SEQ ID NO: 162550 - protein, 9 aa, Homo Sapiens
KYIHSANVL

SEQ ID NO: 162551 - protein, 9 aa, Homo Sapiens
KYIQEAEML

SEQ ID NO: 162552 - protein, 9 aa, Homo Sapiens
KYISGPHEL

SEQ ID NO: 162553 - protein, 9 aa, Homo Sapiens
KYKASITAL

SEQ ID NO: 162554 - protein, 9 aa, Homo Sapiens
KYLALRIAL

SEQ ID NO: 162555 - protein, 9 aa, Homo Sapiens
KYLAVRLAL

SEQ ID NO: 162556 - protein, 9 aa, Homo Sapiens
KYLNMRSTY

SEQ ID NO: 162557 - protein, 9 aa, Homo Sapiens
KYLTSNVAY

SEQ ID NO: 162558 - protein, 9 aa, Homo Sapiens
KYMAEVKKY

SEQ ID NO: 162559 - protein, 9 aa, Homo Sapiens
KYMDVQFDF

SEQ ID NO: 162560 - protein, 9 aa, Homo Sapiens
KYMLTHQEL

SEQ ID NO: 162561 - protein, 9 aa, Homo Sapiens
KYMNNITYY

SEQ ID NO: 162562 - protein, 9 aa, Homo Sapiens
KYMPNVKVA

SEQ ID NO: 162563 - protein, 9 aa, Homo Sapiens
KYMQKSLEL

SEQ ID NO: 162564 - protein, 9 aa, Homo Sapiens
KYMSVIAEL

SEQ ID NO: 162565 - protein, 9 aa, Homo Sapiens
KYMYFTVVM

SEQ ID NO: 162566 - protein, 9 aa, Homo Sapiens
KYNACILEY

SEQ ID NO: 162567 - protein, 9 aa, Homo Sapiens
KYNIMLVRL

SEQ ID NO: 162568 - protein, 9 aa, Homo Sapiens
KYPASSSVF

SEQ ID NO: 162569 - protein, 9 aa, Homo Sapiens
KYPDYEVTW

SEQ ID NO: 162570 - protein, 9 aa, Homo Sapiens
KYPEAAACY

SEQ ID NO: 162571 - protein, 9 aa, Homo Sapiens
KYPHYFPLL

SEQ ID NO: 162572 - protein, 9 aa, Homo Sapiens
KYPHYFPVM

SEQ ID NO: 162573 - protein, 9 aa, Homo Sapiens
KYPNFDVEY

SEQ ID NO: 162574 - protein, 9 aa, Homo Sapiens
KYQAQDNFM

SEQ ID NO: 162575 - protein, 9 aa, Homo Sapiens
KYQAVTATL

SEQ ID NO: 162576 - protein, 9 aa, Homo Sapiens
KYQEVTNNL

SEQ ID NO: 162577 - protein, 9 aa, Homo Sapiens
KYQEYTNEL

SEQ ID NO: 162578 - protein, 9 aa, Homo Sapiens
KYQHTGAVL

SEQ ID NO: 162579 - protein, 9 aa, Homo Sapiens
KYQIINEEF

SEQ ID NO: 162580 - protein, 9 aa, Homo Sapiens
KYQIQQVDM

SEQ ID NO: 162581 - protein, 9 aa, Homo Sapiens
KYQPRIAVF

SEQ ID NO: 162582 - protein, 9 aa, Homo Sapiens
KYQSPVRVY

SEQ ID NO: 162583 - protein, 9 aa, Homo Sapiens
KYTEGVQSL

SEQ ID NO: 162584 - protein, 9 aa, Homo Sapiens
KYYAKKILY

SEQ ID NO: 162585 - protein, 9 aa, Homo Sapiens
KYYDAIACL

SEQ ID NO: 162586 - protein, 9 aa, Homo Sapiens
KYYFAVDTM

SEQ ID NO: 162587 - protein, 9 aa, Homo Sapiens
KYYFILSPY

SEQ ID NO: 162588 - protein, 9 aa, Homo Sapiens
KYYFYDNYF

SEQ ID NO: 162589 - protein, 9 aa, Homo Sapiens
KYYIPEVVY

SEQ ID NO: 162590 - protein, 9 aa, Homo Sapiens
KYYSADINL

SEQ ID NO: 162591 - protein, 9 aa, Homo Sapiens
LFALHASQF

SEQ ID NO: 162592 - protein, 9 aa, Homo Sapiens
LFAPFIVYY

SEQ ID NO: 162593 - protein, 9 aa, Homo Sapiens
LFAPYGTVM

SEQ ID NO: 162594 - protein, 9 aa, Homo Sapiens
LFEGRRIEF

SEQ ID NO: 162595 - protein, 9 aa, Homo Sapiens
LFFDSKQSL

SEQ ID NO: 162596 - protein, 9 aa, Homo Sapiens
LFGPGAGGL

SEQ ID NO: 162597 - protein, 9 aa, Homo Sapiens
LFHEMETCL

SEQ ID NO: 162598 - protein, 9 aa, Homo Sapiens
LFHEVVQAF

SEQ ID NO: 162599 - protein, 9 aa, Homo Sapiens
LFHNAVSAY

SEQ ID NO: 162600 - protein, 9 aa, Homo Sapiens
LFHTIGVEF

SEQ ID NO: 162601 - protein, 9 aa, Homo Sapiens
LFIEHSVEV

SEQ ID NO: 162602 - protein, 9 aa, Homo Sapiens
LFIFSVANM

SEQ ID NO: 162603 - protein, 9 aa, Homo Sapiens
LFIHFANVY

SEQ ID NO: 162604 - protein, 9 aa, Homo Sapiens
LFIPRETTY

SEQ ID NO: 162605 - protein, 9 aa, Homo Sapiens
LFKEREKPL

SEQ ID NO: 162606 - protein, 9 aa, Homo Sapiens
LFLDTVSTF

SEQ ID NO: 162607 - protein, 9 aa, Homo Sapiens
LFLEHAHNL

SEQ ID NO: 162608 - protein, 9 aa, Homo Sapiens
LFLEKAMQL

SEQ ID NO: 162609 - protein, 9 aa, Homo Sapiens
LFLPGRMAY

SEQ ID NO: 162610 - protein, 9 aa, Homo Sapiens
LFLPTAAAY

SEQ ID NO: 162611 - protein, 9 aa, Homo Sapiens
LFLTSLHSM

SEQ ID NO: 162612 - protein, 9 aa, Homo Sapiens
LFMDNKNEL

SEQ ID NO: 162613 - protein, 9 aa, Homo Sapiens
LFMIEIMEM

SEQ ID NO: 162614 - protein, 9 aa, Homo Sapiens
LFMPRSTEF

SEQ ID NO: 162615 - protein, 9 aa, Homo Sapiens
LFMPSTSSM

SEQ ID NO: 162616 - protein, 9 aa, Homo Sapiens
LFMSSFQSY

SEQ ID NO: 162617 - protein, 9 aa, Homo Sapiens
LFNDSRVTF

SEQ ID NO: 162618 - protein, 9 aa, Homo Sapiens
LFPANYVEL

SEQ ID NO: 162619 - protein, 9 aa, Homo Sapiens
LFPDQATQL

SEQ ID NO: 162620 - protein, 9 aa, Homo Sapiens
LFPDTPLAL

SEQ ID NO: 162621 - protein, 9 aa, Homo Sapiens
LFPDVVNCM

SEQ ID NO: 162622 - protein, 9 aa, Homo Sapiens
LFPEGIKGM

SEQ ID NO: 162623 - protein, 9 aa, Homo Sapiens
LFPGKVHSL

SEQ ID NO: 162624 - protein, 9 aa, Homo Sapiens
LFPGPSKPF

SEQ ID NO: 162625 - protein, 9 aa, Homo Sapiens
LFPGSNATF

SEQ ID NO: 162626 - protein, 9 aa, Homo Sapiens
LFPGSPAIY

SEQ ID NO: 162627 - protein, 9 aa, Homo Sapiens
LFPHHIGEL

SEQ ID NO: 162628 - protein, 9 aa, Homo Sapiens
LFPKHFVEY

SEQ ID NO: 162629 - protein, 9 aa, Homo Sapiens
LFPLWPAEM

SEQ ID NO: 162630 - protein, 9 aa, Homo Sapiens
LFPVPGSGL

SEQ ID NO: 162631 - protein, 9 aa, Homo Sapiens
LFQDKASEL

SEQ ID NO: 162632 - protein, 9 aa, Homo Sapiens
LFQEMNIEL

SEQ ID NO: 162633 - protein, 9 aa, Homo Sapiens
LFQHICTAY

SEQ ID NO: 162634 - protein, 9 aa, Homo Sapiens
LFTENVLAH

SEQ ID NO: 162635 - protein, 9 aa, Homo Sapiens
LFVDKIREY

SEQ ID NO: 162636 - protein, 9 aa, Homo Sapiens
LFVPRRAPF

SEQ ID NO: 162637 - protein, 9 aa, Homo Sapiens
LFYEAAQEL

SEQ ID NO: 162638 - protein, 9 aa, Homo Sapiens
LFYFSNEKY

SEQ ID NO: 162639 - protein, 9 aa, Homo Sapiens
LFYPYCQAL

SEQ ID NO: 162640 - protein, 9 aa, Homo Sapiens
LLPHYPNWF

SEQ ID NO: 162641 - protein, 9 aa, Homo Sapiens
LLPPYLRVI

SEQ ID NO: 162642 - protein, 9 aa, Homo Sapiens
LSHLQYFYP

SEQ ID NO: 162643 - protein, 9 aa, Homo Sapiens
LSPMSVNAV

SEQ ID NO: 162644 - protein, 9 aa, Homo Sapiens
LSWNKTVEL

SEQ ID NO: 162645 - protein, 9 aa, Homo Sapiens
LTISFGSWM

SEQ ID NO: 162646 - protein, 9 aa, Homo Sapiens
LYAAAAGVL

SEQ ID NO: 162647 - protein, 9 aa, Homo Sapiens
LYAIRTQEY

SEQ ID NO: 162648 - protein, 9 aa, Homo Sapiens
LYAISAVYF

SEQ ID NO: 162649 - protein, 9 aa, Homo Sapiens
LYALQVHCY

SEQ ID NO: 162650 - protein, 9 aa, Homo Sapiens
LYASKIISY

SEQ ID NO: 162651 - protein, 9 aa, Homo Sapiens
LYATVHQSY

SEQ ID NO: 162652 - protein, 9 aa, Homo Sapiens
LYDQISLPF

SEQ ID NO: 162653 - protein, 9 aa, Homo Sapiens
LYFIAPSGH

SEQ ID NO: 162654 - protein, 9 aa, Homo Sapiens
LYFIAPTGH

SEQ ID NO: 162655 - protein, 9 aa, Homo Sapiens
LYFQSKENL

SEQ ID NO: 162656 - protein, 9 aa, Homo Sapiens
LYGPKYTFF

SEQ ID NO: 162657 - protein, 9 aa, Homo Sapiens
LYHAGAVAF

SEQ ID NO: 162658 - protein, 9 aa, Homo Sapiens
LYHEHIIKY

SEQ ID NO: 162659 - protein, 9 aa, Homo Sapiens
LYHFSSSEL

SEQ ID NO: 162660 - protein, 9 aa, Homo Sapiens
LYHLLRQEL

SEQ ID NO: 162661 - protein, 9 aa, Homo Sapiens
LYHWSVESY

SEQ ID NO: 162662 - protein, 9 aa, Homo Sapiens
LYHYYIMEL

SEQ ID NO: 162663 - protein, 9 aa, Homo Sapiens
LYIDDTLTM

SEQ ID NO: 162664 - protein, 9 aa, Homo Sapiens
LYIGSSKTF

SEQ ID NO: 162665 - protein, 9 aa, Homo Sapiens
LYIHHAIDL

SEQ ID NO: 162666 - protein, 9 aa, Homo Sapiens
LYIQRTKSM

SEQ ID NO: 162667 - protein, 9 aa, Homo Sapiens
LYKERMTEL

SEQ ID NO: 162668 - protein, 9 aa, Homo Sapiens
LYLDESNAL

SEQ ID NO: 162669 - protein, 9 aa, Homo Sapiens
LYLFHLITM

SEQ ID NO: 162670 - protein, 9 aa, Homo Sapiens
LYLPATTPY

SEQ ID NO: 162671 - protein, 9 aa, Homo Sapiens
LYLPKETCL

SEQ ID NO: 162672 - protein, 9 aa, Homo Sapiens
LYLPMAQSV

SEQ ID NO: 162673 - protein, 9 aa, Homo Sapiens
LYLSSKTEL

SEQ ID NO: 162674 - protein, 9 aa, Homo Sapiens
LYLTSCVNY

SEQ ID NO: 162675 - protein, 9 aa, Homo Sapiens
LYMNGMYAF

SEQ ID NO: 162676 - protein, 9 aa, Homo Sapiens
LYMPAVGFL

SEQ ID NO: 162677 - protein, 9 aa, Homo Sapiens
LYNIMKEGL

SEQ ID NO: 162678 - protein, 9 aa, Homo Sapiens
LYPAVSAVY

SEQ ID NO: 162679 - protein, 9 aa, Homo Sapiens
LYPDHFHLL

SEQ ID NO: 162680 - protein, 9 aa, Homo Sapiens
LYPEGLAQL

SEQ ID NO: 162681 - protein, 9 aa, Homo Sapiens
LYPEYGAAF

SEQ ID NO: 162682 - protein, 9 aa, Homo Sapiens
LYPIKNLEM

SEQ ID NO: 162683 - protein, 9 aa, Homo Sapiens
LYPKSTHAL

SEQ ID NO: 162684 - protein, 9 aa, Homo Sapiens
LYPLVAKSL

SEQ ID NO: 162685 - protein, 9 aa, Homo Sapiens
LYPPFMIAL

SEQ ID NO: 162686 - protein, 9 aa, Homo Sapiens
LYPSIIQEF

SEQ ID NO: 162687 - protein, 9 aa, Homo Sapiens
LYPTPSNPF

SEQ ID NO: 162688 - protein, 9 aa, Homo Sapiens
LYPWGVVEV

SEQ ID NO: 162689 - protein, 9 aa, Homo Sapiens
LYPYWISAL

SEQ ID NO: 162690 - protein, 9 aa, Homo Sapiens
LYQARIVSH

SEQ ID NO: 162691 - protein, 9 aa, Homo Sapiens
LYQDFVRDY

SEQ ID NO: 162692 - protein, 9 aa, Homo Sapiens
LYQDTHQEY

SEQ ID NO: 162693 - protein, 9 aa, Homo Sapiens
LYQENKREY

SEQ ID NO: 162694 - protein, 9 aa, Homo Sapiens
LYQFNPAFF

SEQ ID NO: 162695 - protein, 9 aa, Homo Sapiens
LYQHAVEYF

SEQ ID NO: 162696 - protein, 9 aa, Homo Sapiens
LYQIQQVTM

SEQ ID NO: 162697 - protein, 9 aa, Homo Sapiens
LYQKEVSHL

SEQ ID NO: 162698 - protein, 9 aa, Homo Sapiens
LYQLQVNTL

SEQ ID NO: 162699 - protein, 9 aa, Homo Sapiens
LYQPRASEM

SEQ ID NO: 162700 - protein, 9 aa, Homo Sapiens
LYQPSAESL

SEQ ID NO: 162701 - protein, 9 aa, Homo Sapiens
LYQSPVKEL

SEQ ID NO: 162702 - protein, 9 aa, Homo Sapiens
LYSDRISEL

SEQ ID NO: 162703 - protein, 9 aa, Homo Sapiens
LYSPQYISY

SEQ ID NO: 162704 - protein, 9 aa, Homo Sapiens
LYTVTGQSW

SEQ ID NO: 162705 - protein, 9 aa, Homo Sapiens
LYYIGGEVF

SEQ ID NO: 162706 - protein, 9 aa, Homo Sapiens
LYYNANRAF

SEQ ID NO: 162707 - protein, 9 aa, Homo Sapiens
LYYQYMETY

SEQ ID NO: 162708 - protein, 9 aa, Homo Sapiens
LYYRDARSY

SEQ ID NO: 162709 - protein, 9 aa, Homo Sapiens
LYYTTVRAL

SEQ ID NO: 162710 - protein, 9 aa, Homo Sapiens
LYYVGGEVY

SEQ ID NO: 162711 - protein, 9 aa, Homo Sapiens
MFCEKAMEL

SEQ ID NO: 162712 - protein, 9 aa, Homo Sapiens
MFFFSRLEY

SEQ ID NO: 162713 - protein, 9 aa, Homo Sapiens
MFHWQATIM

SEQ ID NO: 162714 - protein, 9 aa, Homo Sapiens
MFNIHRGFY

SEQ ID NO: 162715 - protein, 9 aa, Homo Sapiens
MFPDICASH

SEQ ID NO: 162716 - protein, 9 aa, Homo Sapiens
MFPPPGQSY

SEQ ID NO: 162717 - protein, 9 aa, Homo Sapiens
MFQHIEESF

SEQ ID NO: 162718 - protein, 9 aa, Homo Sapiens
MTQIMFETF

SEQ ID NO: 162719 - protein, 9 aa, Homo Sapiens
MYFTYKVRY

SEQ ID NO: 162720 - protein, 9 aa, Homo Sapiens
MYIARQLSF

SEQ ID NO: 162721 - protein, 9 aa, Homo Sapiens
MYIYSGNSL

SEQ ID NO: 162722 - protein, 9 aa, Homo Sapiens
MYLHRPEEY

SEQ ID NO: 162723 - protein, 9 aa, Homo Sapiens
MYNFQLVTL

SEQ ID NO: 162724 - protein, 9 aa, Homo Sapiens
MYPAFAEEY

SEQ ID NO: 162725 - protein, 9 aa, Homo Sapiens
MYPDQVQLL

SEQ ID NO: 162726 - protein, 9 aa, Homo Sapiens
MYPGIADRM

SEQ ID NO: 162727 - protein, 9 aa, Homo Sapiens
MYPKAVQDL

SEQ ID NO: 162728 - protein, 9 aa, Homo Sapiens
MYQDKLASL

SEQ ID NO: 162729 - protein, 9 aa, Homo Sapiens
MYSIMVHAL

SEQ ID NO: 162730 - protein, 9 aa, Homo Sapiens
MYYGLSNFY

SEQ ID NO: 162731 - protein, 9 aa, Homo Sapiens
NFCGKSISY

SEQ ID NO: 162732 - protein, 9 aa, Homo Sapiens
NFFPSGIDF

SEQ ID NO: 162733 - protein, 9 aa, Homo Sapiens
NFFTKATPL

SEQ ID NO: 162734 - protein, 9 aa, Homo Sapiens
NFHASNTHL

SEQ ID NO: 162735 - protein, 9 aa, Homo Sapiens
NFHGEWLEV

SEQ ID NO: 162736 - protein, 9 aa, Homo Sapiens
NFIATVREV

SEQ ID NO: 162737 - protein, 9 aa, Homo Sapiens
NFICPALEF

SEQ ID NO: 162738 - protein, 9 aa, Homo Sapiens
NFIEDVLGY

SEQ ID NO: 162739 - protein, 9 aa, Homo Sapiens
NFIEKVEAL

SEQ ID NO: 162740 - protein, 9 aa, Homo Sapiens
NFIKAIQAY

SEQ ID NO: 162741 - protein, 9 aa, Homo Sapiens
NFIKAMVSY

SEQ ID NO: 162742 - protein, 9 aa, Homo Sapiens
NFIPTGSAF

SEQ ID NO: 162743 - protein, 9 aa, Homo Sapiens
NFIRVLVSY

SEQ ID NO: 162744 - protein, 9 aa, Homo Sapiens
NFITGVGIL

SEQ ID NO: 162745 - protein, 9 aa, Homo Sapiens
NFKTPRGPV

SEQ ID NO: 162746 - protein, 9 aa, Homo Sapiens
NFLAQTEAL

SEQ ID NO: 162747 - protein, 9 aa, Homo Sapiens
NFLESKFSL

SEQ ID NO: 162748 - protein, 9 aa, Homo Sapiens
NFLGAENAF

SEQ ID NO: 162749 - protein, 9 aa, Homo Sapiens
NFLLHVTAL

SEQ ID NO: 162750 - protein, 9 aa, Homo Sapiens
NFLNMSRSM

SEQ ID NO: 162751 - protein, 9 aa, Homo Sapiens
NFLPEALDF

SEQ ID NO: 162752 - protein, 9 aa, Homo Sapiens
NFLSTLTSF

SEQ ID NO: 162753 - protein, 9 aa, Homo Sapiens
NFMKPTQEM

SEQ ID NO: 162754 - protein, 9 aa, Homo Sapiens
NFMLHLVSM

SEQ ID NO: 162755 - protein, 9 aa, Homo Sapiens
NFNTSVQAL

SEQ ID NO: 162756 - protein, 9 aa, Homo Sapiens
NFPEHIFPA

SEQ ID NO: 162757 - protein, 9 aa, Homo Sapiens
NFPGIVTSF

SEQ ID NO: 162758 - protein, 9 aa, Homo Sapiens
NFPIKARSL

SEQ ID NO: 162759 - protein, 9 aa, Homo Sapiens
NFPKVATSF

SEQ ID NO: 162760 - protein, 9 aa, Homo Sapiens
NFPNGVTDF

SEQ ID NO: 162761 - protein, 9 aa, Homo Sapiens
NFPNIRDAI

SEQ ID NO: 162762 - protein, 9 aa, Homo Sapiens
NFPQYVMDV

SEQ ID NO: 162763 - protein, 9 aa, Homo Sapiens
NFPTNLHPM

SEQ ID NO: 162764 - protein, 9 aa, Homo Sapiens
NFPVGQRVL

SEQ ID NO: 162765 - protein, 9 aa, Homo Sapiens
NFQAIRVTL

SEQ ID NO: 162766 - protein, 9 aa, Homo Sapiens
NFQAIVISL

SEQ ID NO: 162767 - protein, 9 aa, Homo Sapiens
NFQALAAEF

SEQ ID NO: 162768 - protein, 9 aa, Homo Sapiens
NFQDTVNTL

SEQ ID NO: 162769 - protein, 9 aa, Homo Sapiens
NFQEPVQPL

SEQ ID NO: 162770 - protein, 9 aa, Homo Sapiens
NFQEYVTFL

SEQ ID NO: 162771 - protein, 9 aa, Homo Sapiens
NFQPFALNH

SEQ ID NO: 162772 - protein, 9 aa, Homo Sapiens
NFQTAKEAL

SEQ ID NO: 162773 - protein, 9 aa, Homo Sapiens
NFQTAKESL

SEQ ID NO: 162774 - protein, 9 aa, Homo Sapiens
NFQWPVLAF

SEQ ID NO: 162775 - protein, 9 aa, Homo Sapiens
NFYCPGSAL

SEQ ID NO: 162776 - protein, 9 aa, Homo Sapiens
NFYNFASSF

SEQ ID NO: 162777 - protein, 9 aa, Homo Sapiens
NFYSTEVSV

SEQ ID NO: 162778 - protein, 9 aa, Homo Sapiens
NMNTMGHMM

SEQ ID NO: 162779 - protein, 9 aa, Homo Sapiens
NYAEYQVCL

SEQ ID NO: 162780 - protein, 9 aa, Homo Sapiens
NYETMGRAL

SEQ ID NO: 162781 - protein, 9 aa, Homo Sapiens
NYFFDAAKL

SEQ ID NO: 162782 - protein, 9 aa, Homo Sapiens
NYFGAAGRL

SEQ ID NO: 162783 - protein, 9 aa, Homo Sapiens
NYFLRLCSF

SEQ ID NO: 162784 - protein, 9 aa, Homo Sapiens
NYFPGGVAL

SEQ ID NO: 162785 - protein, 9 aa, Homo Sapiens
NYFQQANEL

SEQ ID NO: 162786 - protein, 9 aa, Homo Sapiens
NYHAMTEFL

SEQ ID NO: 162787 - protein, 9 aa, Homo Sapiens
NYHATTEFL

SEQ ID NO: 162788 - protein, 9 aa, Homo Sapiens
NYHWQETAY

SEQ ID NO: 162789 - protein, 9 aa, Homo Sapiens
NYIDKVRFL

SEQ ID NO: 162790 - protein, 9 aa, Homo Sapiens
NYIEFTRIL

SEQ ID NO: 162791 - protein, 9 aa, Homo Sapiens
NYIEGTKML

SEQ ID NO: 162792 - protein, 9 aa, Homo Sapiens
NYIEKVVAI

SEQ ID NO: 162793 - protein, 9 aa, Homo Sapiens
NYIHVGAQL

SEQ ID NO: 162794 - protein, 9 aa, Homo Sapiens
NYIMQSHSL

SEQ ID NO: 162795 - protein, 9 aa, Homo Sapiens
NYIPEVRIM

SEQ ID NO: 162796 - protein, 9 aa, Homo Sapiens
NYIRDRLAL

SEQ ID NO: 162797 - protein, 9 aa, Homo Sapiens
NYITPVNSL

SEQ ID NO: 162798 - protein, 9 aa, Homo Sapiens
NYLNQGVVH

SEQ ID NO: 162799 - protein, 9 aa, Homo Sapiens
NYMAHLVEV

SEQ ID NO: 162800 - protein, 9 aa, Homo Sapiens
NYMMRNAVL

SEQ ID NO: 162801 - protein, 9 aa, Homo Sapiens
NYMPGQLTI

SEQ ID NO: 162802 - protein, 9 aa, Homo Sapiens
NYNFQYISL

SEQ ID NO: 162803 - protein, 9 aa, Homo Sapiens
NYNPAQQAF

SEQ ID NO: 162804 - protein, 9 aa, Homo Sapiens
NYNTIFQYY

SEQ ID NO: 162805 - protein, 9 aa, Homo Sapiens
NYPAFMMEM

SEQ ID NO: 162806 - protein, 9 aa, Homo Sapiens
NYPDTTIDL

SEQ ID NO: 162807 - protein, 9 aa, Homo Sapiens
NYPFPGETF

SEQ ID NO: 162808 - protein, 9 aa, Homo Sapiens
NYPGLSISL

SEQ ID NO: 162809 - protein, 9 aa, Homo Sapiens
NYPHFFLDF

SEQ ID NO: 162810 - protein, 9 aa, Homo Sapiens
NYPIGTNAI

SEQ ID NO: 162811 - protein, 9 aa, Homo Sapiens
NYPSAFHSV

SEQ ID NO: 162812 - protein, 9 aa, Homo Sapiens
NYPVTGLAF

SEQ ID NO: 162813 - protein, 9 aa, Homo Sapiens
NYQAYRSYL

SEQ ID NO: 162814 - protein, 9 aa, Homo Sapiens
NYQEVSRTL

SEQ ID NO: 162815 - protein, 9 aa, Homo Sapiens
NYQIVVSNL

SEQ ID NO: 162816 - protein, 9 aa, Homo Sapiens
NYQTLKTSL

SEQ ID NO: 162817 - protein, 9 aa, Homo Sapiens
NYQVQFVTL

SEQ ID NO: 162818 - protein, 9 aa, Homo Sapiens
NYQVTNSMF

SEQ ID NO: 162819 - protein, 9 aa, Homo Sapiens
NYSPYVNYF

SEQ ID NO: 162820 - protein, 9 aa, Homo Sapiens
NYTDRIQVL

SEQ ID NO: 162821 - protein, 9 aa, Homo Sapiens
NYVDLVSSL

SEQ ID NO: 162822 - protein, 9 aa, Homo Sapiens
NYVESIMHY

SEQ ID NO: 162823 - protein, 9 aa, Homo Sapiens
NYVPEVSAL

SEQ ID NO: 162824 - protein, 9 aa, Homo Sapiens
NYYPGSLFL

SEQ ID NO: 162825 - protein, 9 aa, Homo Sapiens
NYYTKAIDM

SEQ ID NO: 162826 - protein, 9 aa, Homo Sapiens
NYYTPITPH

SEQ ID NO: 162827 - protein, 9 aa, Homo Sapiens
PIRLLAAAA

SEQ ID NO: 162828 - protein, 9 aa, Homo Sapiens
PNYFLSIPI

SEQ ID NO: 162829 - protein, 9 aa, Homo Sapiens
PYNTSLVEM

SEQ ID NO: 162830 - protein, 9 aa, Homo Sapiens
PYYASAFSM

SEQ ID NO: 162831 - protein, 9 aa, Homo Sapiens
QFIDGRLDL

SEQ ID NO: 162832 - protein, 9 aa, Homo Sapiens
QFLAAIESL

SEQ ID NO: 162833 - protein, 9 aa, Homo Sapiens
QFLDAAKAL

SEQ ID NO: 162834 - protein, 9 aa, Homo Sapiens
QFLEQALQM

SEQ ID NO: 162835 - protein, 9 aa, Homo Sapiens
QFLFSLVEH

SEQ ID NO: 162836 - protein, 9 aa, Homo Sapiens
QFLPRTITL

SEQ ID NO: 162837 - protein, 9 aa, Homo Sapiens
QFLRGARAM

SEQ ID NO: 162838 - protein, 9 aa, Homo Sapiens
QFPAWISQF

SEQ ID NO: 162839 - protein, 9 aa, Homo Sapiens
QFPDFNNYL

SEQ ID NO: 162840 - protein, 9 aa, Homo Sapiens
QFPDMILSA

SEQ ID NO: 162841 - protein, 9 aa, Homo Sapiens
QFPELMGVF

SEQ ID NO: 162842 - protein, 9 aa, Homo Sapiens
QFPLYNNDI

SEQ ID NO: 162843 - protein, 9 aa, Homo Sapiens
QFQKVITEY

SEQ ID NO: 162844 - protein, 9 aa, Homo Sapiens
QFQPKLTDF

SEQ ID NO: 162845 - protein, 9 aa, Homo Sapiens
QYFARMCSL

SEQ ID NO: 162846 - protein, 9 aa, Homo Sapiens
QYFTARTSL

SEQ ID NO: 162847 - protein, 9 aa, Homo Sapiens
QYLELAHSL

SEQ ID NO: 162848 - protein, 9 aa, Homo Sapiens
QYLSQKKTI

SEQ ID NO: 162849 - protein, 9 aa, Homo Sapiens
QYMEEIYHR

SEQ ID NO: 162850 - protein, 9 aa, Homo Sapiens
QYMERLQLL

SEQ ID NO: 162851 - protein, 9 aa, Homo Sapiens
QYPDFNNYL

SEQ ID NO: 162852 - protein, 9 aa, Homo Sapiens
QYPEGYLEA

SEQ ID NO: 162853 - protein, 9 aa, Homo Sapiens
QYPENILSF

SEQ ID NO: 162854 - protein, 9 aa, Homo Sapiens
QYPGDIGCF

SEQ ID NO: 162855 - protein, 9 aa, Homo Sapiens
QYPGRSLVF

SEQ ID NO: 162856 - protein, 9 aa, Homo Sapiens
QYPWGVAEV

SEQ ID NO: 162857 - protein, 9 aa, Homo Sapiens
QYQDNIKEL

SEQ ID NO: 162858 - protein, 9 aa, Homo Sapiens
QYQPPAPAL

SEQ ID NO: 162859 - protein, 9 aa, Homo Sapiens
QYQRMLSTL

SEQ ID NO: 162860 - protein, 9 aa, Homo Sapiens
QYVCQQTGL

SEQ ID NO: 162861 - protein, 9 aa, Homo Sapiens
QYVIQLTSM

SEQ ID NO: 162862 - protein, 9 aa, Homo Sapiens
QYYALEVSY

SEQ ID NO: 162863 - protein, 9 aa, Homo Sapiens
QYYQNDIPY

SEQ ID NO: 162864 - protein, 9 aa, Homo Sapiens
QYYSYFTSH

SEQ ID NO: 162865 - protein, 9 aa, Homo Sapiens
RFFAQSQSL

SEQ ID NO: 162866 - protein, 9 aa, Homo Sapiens
RFFDGAKDV

SEQ ID NO: 162867 - protein, 9 aa, Homo Sapiens
RFFESFGDL

SEQ ID NO: 162868 - protein, 9 aa, Homo Sapiens
RFFTSSTSL

SEQ ID NO: 162869 - protein, 9 aa, Homo Sapiens
RFHEMHVAL

SEQ ID NO: 162870 - protein, 9 aa, Homo Sapiens
RFHTITTSY

SEQ ID NO: 162871 - protein, 9 aa, Homo Sapiens
RFIAGTGCL

SEQ ID NO: 162872 - protein, 9 aa, Homo Sapiens
RFIAVVHPL

SEQ ID NO: 162873 - protein, 9 aa, Homo Sapiens
RFIEATKQY

SEQ ID NO: 162874 - protein, 9 aa, Homo Sapiens
RFIGATANF

SEQ ID NO: 162875 - protein, 9 aa, Homo Sapiens
RFIGAVNNM

SEQ ID NO: 162876 - protein, 9 aa, Homo Sapiens
RFIGLTNSF

SEQ ID NO: 162877 - protein, 9 aa, Homo Sapiens
RFIPSAYPY

SEQ ID NO: 162878 - protein, 9 aa, Homo Sapiens
RFIPYTEEF

SEQ ID NO: 162879 - protein, 9 aa, Homo Sapiens
RFLDKALEL

SEQ ID NO: 162880 - protein, 9 aa, Homo Sapiens
RFLENALAV

SEQ ID NO: 162881 - protein, 9 aa, Homo Sapiens
RFLPEALFL

SEQ ID NO: 162882 - protein, 9 aa, Homo Sapiens
RFLVGTQSL

SEQ ID NO: 162883 - protein, 9 aa, Homo Sapiens
RFLYSNIAF

SEQ ID NO: 162884 - protein, 9 aa, Homo Sapiens
RFMDGHITF

SEQ ID NO: 162885 - protein, 9 aa, Homo Sapiens
RFMEETANF

SEQ ID NO: 162886 - protein, 9 aa, Homo Sapiens
RFNSITSAY

SEQ ID NO: 162887 - protein, 9 aa, Homo Sapiens
RFPDFVRDF

SEQ ID NO: 162888 - protein, 9 aa, Homo Sapiens
RFPDGTNGL

SEQ ID NO: 162889 - protein, 9 aa, Homo Sapiens
RFPDLTVEL

SEQ ID NO: 162890 - protein, 9 aa, Homo Sapiens
RFPDPRMHY

SEQ ID NO: 162891 - protein, 9 aa, Homo Sapiens
RFPDTVKQM

SEQ ID NO: 162892 - protein, 9 aa, Homo Sapiens
RFPDTVSTV

SEQ ID NO: 162893 - protein, 9 aa, Homo Sapiens
RFPDVANGF

SEQ ID NO: 162894 - protein, 9 aa, Homo Sapiens
RFPEAFSSI

SEQ ID NO: 162895 - protein, 9 aa, Homo Sapiens
RFPEHVREI

SEQ ID NO: 162896 - protein, 9 aa, Homo Sapiens
RFPELSLAL

SEQ ID NO: 162897 - protein, 9 aa, Homo Sapiens
RFPLNILPM

SEQ ID NO: 162898 - protein, 9 aa, Homo Sapiens
RFPNFTNQL

SEQ ID NO: 162899 - protein, 9 aa, Homo Sapiens
RFPQHYKSL

SEQ ID NO: 162900 - protein, 9 aa, Homo Sapiens
RFQDLIREL

SEQ ID NO: 162901 - protein, 9 aa, Homo Sapiens
RFQDQVLDL

SEQ ID NO: 162902 - protein, 9 aa, Homo Sapiens
RFQEILNCL

SEQ ID NO: 162903 - protein, 9 aa, Homo Sapiens
RFQNYMVAL

SEQ ID NO: 162904 - protein, 9 aa, Homo Sapiens
RFQSLGVAF

SEQ ID NO: 162905 - protein, 9 aa, Homo Sapiens
RFSLNTVEL

SEQ ID NO: 162906 - protein, 9 aa, Homo Sapiens
RFYAFGRVF

SEQ ID NO: 162907 - protein, 9 aa, Homo Sapiens
RFYEGVVEL

SEQ ID NO: 162908 - protein, 9 aa, Homo Sapiens
RIIEETLAL

SEQ ID NO: 162909 - protein, 9 aa, Homo Sapiens
RLPPYSSQL

SEQ ID NO: 162910 - protein, 9 aa, Homo Sapiens
RMLAAATAF

SEQ ID NO: 162911 - protein, 9 aa, Homo Sapiens
RMMEIAKAM

SEQ ID NO: 162912 - protein, 9 aa, Homo Sapiens
RMPPFTQAF

SEQ ID NO: 162913 - protein, 9 aa, Homo Sapiens
RWMDEAQAL

SEQ ID NO: 162914 - protein, 9 aa, Homo Sapiens
RWPDYVREL

SEQ ID NO: 162915 - protein, 9 aa, Homo Sapiens
RWPKKSAEF

SEQ ID NO: 162916 - protein, 9 aa, Homo Sapiens
RYADRVKEL

SEQ ID NO: 162917 - protein, 9 aa, Homo Sapiens
RYAEAVQLL

SEQ ID NO: 162918 - protein, 9 aa, Homo Sapiens
RYAEFSSAL

SEQ ID NO: 162919 - protein, 9 aa, Homo Sapiens
RYAFSGVAF

SEQ ID NO: 162920 - protein, 9 aa, Homo Sapiens
RYCFQITSF

SEQ ID NO: 162921 - protein, 9 aa, Homo Sapiens
RYFDHALTL

SEQ ID NO: 162922 - protein, 9 aa, Homo Sapiens
RYFGPAAAL

SEQ ID NO: 162923 - protein, 9 aa, Homo Sapiens
RYFIPVSCF

SEQ ID NO: 162924 - protein, 9 aa, Homo Sapiens
RYFSTAVSR

SEQ ID NO: 162925 - protein, 9 aa, Homo Sapiens
RYHTGSLAF

SEQ ID NO: 162926 - protein, 9 aa, Homo Sapiens
RYIANTVEL

SEQ ID NO: 162927 - protein, 9 aa, Homo Sapiens
RYIEQATVH

SEQ ID NO: 162928 - protein, 9 aa, Homo Sapiens
RYIGKTMDY

SEQ ID NO: 162929 - protein, 9 aa, Homo Sapiens
RYIPDAMNL

SEQ ID NO: 162930 - protein, 9 aa, Homo Sapiens
RYIPTAAAF

SEQ ID NO: 162931 - protein, 9 aa, Homo Sapiens
RYIQGILNV

SEQ ID NO: 162932 - protein, 9 aa, Homo Sapiens
RYLEKCIAY

SEQ ID NO: 162933 - protein, 9 aa, Homo Sapiens
RYLESARCY

SEQ ID NO: 162934 - protein, 9 aa, Homo Sapiens
RYLGGSMDL

SEQ ID NO: 162935 - protein, 9 aa, Homo Sapiens
RYLGKVLEL

SEQ ID NO: 162936 - protein, 9 aa, Homo Sapiens
RYLPQCSYF

SEQ ID NO: 162937 - protein, 9 aa, Homo Sapiens
RYLSKVLEL

SEQ ID NO: 162938 - protein, 9 aa, Homo Sapiens
RYLTVAAVF

SEQ ID NO: 162939 - protein, 9 aa, Homo Sapiens
RYLYMVMEY

SEQ ID NO: 162940 - protein, 9 aa, Homo Sapiens
RYMAFAHDL

SEQ ID NO: 162941 - protein, 9 aa, Homo Sapiens
RYMEVSGNL

SEQ ID NO: 162942 - protein, 9 aa, Homo Sapiens
RYMKPGKEL

SEQ ID NO: 162943 - protein, 9 aa, Homo Sapiens
RYMNHMQSL

SEQ ID NO: 162944 - protein, 9 aa, Homo Sapiens
RYMSINTHL

SEQ ID NO: 162945 - protein, 9 aa, Homo Sapiens
RYMVHLLEL

SEQ ID NO: 162946 - protein, 9 aa, Homo Sapiens
RYNSQLLSF

SEQ ID NO: 162947 - protein, 9 aa, Homo Sapiens
RYNVMHVAA

SEQ ID NO: 162948 - protein, 9 aa, Homo Sapiens
RYPCFFNTL

SEQ ID NO: 162949 - protein, 9 aa, Homo Sapiens
RYPDIQASY

SEQ ID NO: 162950 - protein, 9 aa, Homo Sapiens
RYPDNLKHL

SEQ ID NO: 162951 - protein, 9 aa, Homo Sapiens
RYPDSILEH

SEQ ID NO: 162952 - protein, 9 aa, Homo Sapiens
RYPEETLSL

SEQ ID NO: 162953 - protein, 9 aa, Homo Sapiens
RYPPAANEL

SEQ ID NO: 162954 - protein, 9 aa, Homo Sapiens
RYPTSIASL

SEQ ID NO: 162955 - protein, 9 aa, Homo Sapiens
RYQATGLHF

SEQ ID NO: 162956 - protein, 9 aa, Homo Sapiens
RYQDAIRVF

SEQ ID NO: 162957 - protein, 9 aa, Homo Sapiens
RYQEALSEL

SEQ ID NO: 162958 - protein, 9 aa, Homo Sapiens
RYQEDVQQL

SEQ ID NO: 162959 - protein, 9 aa, Homo Sapiens
RYQEFVRAL

SEQ ID NO: 162960 - protein, 9 aa, Homo Sapiens
RYQEKISAL

SEQ ID NO: 162961 - protein, 9 aa, Homo Sapiens
RYQEVIQEL

SEQ ID NO: 162962 - protein, 9 aa, Homo Sapiens
RYQFIEEAF

SEQ ID NO: 162963 - protein, 9 aa, Homo Sapiens
RYRPGTVAL

SEQ ID NO: 162964 - protein, 9 aa, Homo Sapiens
RYSEAVFYY

SEQ ID NO: 162965 - protein, 9 aa, Homo Sapiens
RYSEYAEEF

SEQ ID NO: 162966 - protein, 9 aa, Homo Sapiens
RYSVFVNEL

SEQ ID NO: 162967 - protein, 9 aa, Homo Sapiens
RYTFYVLEF

SEQ ID NO: 162968 - protein, 9 aa, Homo Sapiens
RYTLQASTF

SEQ ID NO: 162969 - protein, 9 aa, Homo Sapiens
RYTVQFTTM

SEQ ID NO: 162970 - protein, 9 aa, Homo Sapiens
RYTVSNLSM

SEQ ID NO: 162971 - protein, 9 aa, Homo Sapiens
RYVAIARAL

SEQ ID NO: 162972 - protein, 9 aa, Homo Sapiens
RYVDQVLQL

SEQ ID NO: 162973 - protein, 9 aa, Homo Sapiens
RYVDRVTEF

SEQ ID NO: 162974 - protein, 9 aa, Homo Sapiens
RYVPRASYF

SEQ ID NO: 162975 - protein, 9 aa, Homo Sapiens
RYVWDYTEL

SEQ ID NO: 162976 - protein, 9 aa, Homo Sapiens
RYWNSYTEF

SEQ ID NO: 162977 - protein, 9 aa, Homo Sapiens
RYWSAVTSH

SEQ ID NO: 162978 - protein, 9 aa, Homo Sapiens
RYYAFDEAF

SEQ ID NO: 162979 - protein, 9 aa, Homo Sapiens
RYYDDPREY

SEQ ID NO: 162980 - protein, 9 aa, Homo Sapiens
RYYHCAVTL

SEQ ID NO: 162981 - protein, 9 aa, Homo Sapiens
RYYPSGDAF

SEQ ID NO: 162982 - protein, 9 aa, Homo Sapiens
RYYSSEYHY

SEQ ID NO: 162983 - protein, 9 aa, Homo Sapiens
SFAAEAIAM

SEQ ID NO: 162984 - protein, 9 aa, Homo Sapiens
SFAAKQREL

SEQ ID NO: 162985 - protein, 9 aa, Homo Sapiens
SFAAVIQAL

SEQ ID NO: 162986 - protein, 9 aa, Homo Sapiens
SFADFGSAL

SEQ ID NO: 162987 - protein, 9 aa, Homo Sapiens
SFFGAASQY

SEQ ID NO: 162988 - protein, 9 aa, Homo Sapiens
SFFGGSNPF

SEQ ID NO: 162989 - protein, 9 aa, Homo Sapiens
SFFGNVMSM

SEQ ID NO: 162990 - protein, 9 aa, Homo Sapiens
SFFLGKVCF

SEQ ID NO: 162991 - protein, 9 aa, Homo Sapiens
SFFPKSPAL

SEQ ID NO: 162992 - protein, 9 aa, Homo Sapiens
SFFPKVLEM

SEQ ID NO: 162993 - protein, 9 aa, Homo Sapiens
SFFSTPSEL

SEQ ID NO: 162994 - protein, 9 aa, Homo Sapiens
SFFTNANSY

SEQ ID NO: 162995 - protein, 9 aa, Homo Sapiens
SFGSGFSSF

SEQ ID NO: 162996 - protein, 9 aa, Homo Sapiens
SFGYQITSF

SEQ ID NO: 162997 - protein, 9 aa, Homo Sapiens
SFHAAGLQM

SEQ ID NO: 162998 - protein, 9 aa, Homo Sapiens
SFHHNVAAL

SEQ ID NO: 162999 - protein, 9 aa, Homo Sapiens
SFHNIHNTF

SEQ ID NO: 163000 - protein, 9 aa, Homo Sapiens
SFHQPTQPV

SEQ ID NO: 163001 - protein, 9 aa, Homo Sapiens
SFHTHVKEL

SEQ ID NO: 163002 - protein, 9 aa, Homo Sapiens
SFIAAGICF

SEQ ID NO: 163003 - protein, 9 aa, Homo Sapiens
SFIAFARVF

SEQ ID NO: 163004 - protein, 9 aa, Homo Sapiens
SFIENSSAL

SEQ ID NO: 163005 - protein, 9 aa, Homo Sapiens
SFIERLVEM

SEQ ID NO: 163006 - protein, 9 aa, Homo Sapiens
SFIFGVTNF

SEQ ID NO: 163007 - protein, 9 aa, Homo Sapiens
SFIHAAMGM

SEQ ID NO: 163008 - protein, 9 aa, Homo Sapiens
SFIKEANTL

SEQ ID NO: 163009 - protein, 9 aa, Homo Sapiens
SFIKRNTPL

SEQ ID NO: 163010 - protein, 9 aa, Homo Sapiens
SFILKANEL

SEQ ID NO: 163011 - protein, 9 aa, Homo Sapiens
SFIPAVNDL

SEQ ID NO: 163012 - protein, 9 aa, Homo Sapiens
SFIQGTTTM

SEQ ID NO: 163013 - protein, 9 aa, Homo Sapiens
SFISEAESL

SEQ ID NO: 163014 - protein, 9 aa, Homo Sapiens
SFISFANSR

SEQ ID NO: 163015 - protein, 9 aa, Homo Sapiens
SFISVIKEM

SEQ ID NO: 163016 - protein, 9 aa, Homo Sapiens
SFKNQIATH

SEQ ID NO: 163017 - protein, 9 aa, Homo Sapiens
SFLAAAETL

SEQ ID NO: 163018 - protein, 9 aa, Homo Sapiens
SFLATGSNL

SEQ ID NO: 163019 - protein, 9 aa, Homo Sapiens
SFLATITSF

SEQ ID NO: 163020 - protein, 9 aa, Homo Sapiens
SFLDLARNI

SEQ ID NO: 163021 - protein, 9 aa, Homo Sapiens
SFLDSCNSL

SEQ ID NO: 163022 - protein, 9 aa, Homo Sapiens
SFLEDARAY

SEQ ID NO: 163023 - protein, 9 aa, Homo Sapiens
SFLEKTAVL

SEQ ID NO: 163024 - protein, 9 aa, Homo Sapiens
SFLETNVPL

SEQ ID NO: 163025 - protein, 9 aa, Homo Sapiens
SFLFTVITF

SEQ ID NO: 163026 - protein, 9 aa, Homo Sapiens
SFLNKASAV

SEQ ID NO: 163027 - protein, 9 aa, Homo Sapiens
SFLNRYLSL

SEQ ID NO: 163028 - protein, 9 aa, Homo Sapiens
SFLPLAHMF

SEQ ID NO: 163029 - protein, 9 aa, Homo Sapiens
SFLPSGSEM

SEQ ID NO: 163030 - protein, 9 aa, Homo Sapiens
SFLSEARSL

SEQ ID NO: 163031 - protein, 9 aa, Homo Sapiens
SFMDPASAL

SEQ ID NO: 163032 - protein, 9 aa, Homo Sapiens
SFMDVSNPF

SEQ ID NO: 163033 - protein, 9 aa, Homo Sapiens
SFMEGAIIY

SEQ ID NO: 163034 - protein, 9 aa, Homo Sapiens
SFMGMVISH

SEQ ID NO: 163035 - protein, 9 aa, Homo Sapiens
SFMIMKTNF

SEQ ID NO: 163036 - protein, 9 aa, Homo Sapiens
SFMKNTKSV

SEQ ID NO: 163037 - protein, 9 aa, Homo Sapiens
SFMSGADSF

SEQ ID NO: 163038 - protein, 9 aa, Homo Sapiens
SFMYAHLAF

SEQ ID NO: 163039 - protein, 9 aa, Homo Sapiens
SFNAYENHL

SEQ ID NO: 163040 - protein, 9 aa, Homo Sapiens
SFNKMSIEY

SEQ ID NO: 163041 - protein, 9 aa, Homo Sapiens
SFNSSFTSL

SEQ ID NO: 163042 - protein, 9 aa, Homo Sapiens
SFPAHRAVL

SEQ ID NO: 163043 - protein, 9 aa, Homo Sapiens
SFPDNPRKL

SEQ ID NO: 163044 - protein, 9 aa, Homo Sapiens
SFPEHMANV

SEQ ID NO: 163045 - protein, 9 aa, Homo Sapiens
SFPELGAAL

SEQ ID NO: 163046 - protein, 9 aa, Homo Sapiens
SFPELNAAF

SEQ ID NO: 163047 - protein, 9 aa, Homo Sapiens
SFPENLRHL

SEQ ID NO: 163048 - protein, 9 aa, Homo Sapiens
SFPEVFTTY

SEQ ID NO: 163049 - protein, 9 aa, Homo Sapiens
SFPHMVLSL

SEQ ID NO: 163050 - protein, 9 aa, Homo Sapiens
SFPHPLPSL

SEQ ID NO: 163051 - protein, 9 aa, Homo Sapiens
SFPHTTPSM

SEQ ID NO: 163052 - protein, 9 aa, Homo Sapiens
SFPIFISAL

SEQ ID NO: 163053 - protein, 9 aa, Homo Sapiens
SFPNYGLSH

SEQ ID NO: 163054 - protein, 9 aa, Homo Sapiens
SFPPETQAL

SEQ ID NO: 163055 - protein, 9 aa, Homo Sapiens
SFPQLRATM

SEQ ID NO: 163056 - protein, 9 aa, Homo Sapiens
SFPQPAAVY

SEQ ID NO: 163057 - protein, 9 aa, Homo Sapiens
SFPQYSPKM

SEQ ID NO: 163058 - protein, 9 aa, Homo Sapiens
SFPTSIKCL

SEQ ID NO: 163059 - protein, 9 aa, Homo Sapiens
SFPVNYKSL

SEQ ID NO: 163060 - protein, 9 aa, Homo Sapiens
SFPVRGTPM

SEQ ID NO: 163061 - protein, 9 aa, Homo Sapiens
SFQDFVSHF

SEQ ID NO: 163062 - protein, 9 aa, Homo Sapiens
SFQENIAQL

SEQ ID NO: 163063 - protein, 9 aa, Homo Sapiens
SFQEVREYM

SEQ ID NO: 163064 - protein, 9 aa, Homo Sapiens
SFQFAHLEF

SEQ ID NO: 163065 - protein, 9 aa, Homo Sapiens
SFQGMVTSF

SEQ ID NO: 163066 - protein, 9 aa, Homo Sapiens
SFRSQMLAM

SEQ ID NO: 163067 - protein, 9 aa, Homo Sapiens
SFSEFTSSL

SEQ ID NO: 163068 - protein, 9 aa, Homo Sapiens
SFSHSFSAL

SEQ ID NO: 163069 - protein, 9 aa, Homo Sapiens
SFSNAARVL

SEQ ID NO: 163070 - protein, 9 aa, Homo Sapiens
SFSPGAGAF

SEQ ID NO: 163071 - protein, 9 aa, Homo Sapiens
SFVDQVREI

SEQ ID NO: 163072 - protein, 9 aa, Homo Sapiens
SFVDSVGVM

SEQ ID NO: 163073 - protein, 9 aa, Homo Sapiens
SFVIRALGF

SEQ ID NO: 163074 - protein, 9 aa, Homo Sapiens
SFVWHALDY

SEQ ID NO: 163075 - protein, 9 aa, Homo Sapiens
SFYDHALHL

SEQ ID NO: 163076 - protein, 9 aa, Homo Sapiens
SHREPPLEL

SEQ ID NO: 163077 - protein, 9 aa, Homo Sapiens
SLPAYLNSL

SEQ ID NO: 163078 - protein, 9 aa, Homo Sapiens
SMIENVLAF

SEQ ID NO: 163079 - protein, 9 aa, Homo Sapiens
SMITGVAAL

SEQ ID NO: 163080 - protein, 9 aa, Homo Sapiens
SMPLYAVMY

SEQ ID NO: 163081 - protein, 9 aa, Homo Sapiens
SPGAAVVML

SEQ ID NO: 163082 - protein, 9 aa, Homo Sapiens
SVPAFASSL

SEQ ID NO: 163083 - protein, 9 aa, Homo Sapiens
SWIDDTSAF

SEQ ID NO: 163084 - protein, 9 aa, Homo Sapiens
SWIQGVLSH

SEQ ID NO: 163085 - protein, 9 aa, Homo Sapiens
SWPDGMLSM

SEQ ID NO: 163086 - protein, 9 aa, Homo Sapiens
SWPTYPQLY

SEQ ID NO: 163087 - protein, 9 aa, Homo Sapiens
SYADNILSF

SEQ ID NO: 163088 - protein, 9 aa, Homo Sapiens
SYAVGLAAL

SEQ ID NO: 163089 - protein, 9 aa, Homo Sapiens
SYAVMQISM

SEQ ID NO: 163090 - protein, 9 aa, Homo Sapiens
SYEAQITAL

SEQ ID NO: 163091 - protein, 9 aa, Homo Sapiens
SYEFMRRSL

SEQ ID NO: 163092 - protein, 9 aa, Homo Sapiens
SYENMVTEI

SEQ ID NO: 163093 - protein, 9 aa, Homo Sapiens
SYFDPREAY

SEQ ID NO: 163094 - protein, 9 aa, Homo Sapiens
SYFGSFSSL

SEQ ID NO: 163095 - protein, 9 aa, Homo Sapiens
SYFMATNSL

SEQ ID NO: 163096 - protein, 9 aa, Homo Sapiens
SYFPKILTF

SEQ ID NO: 163097 - protein, 9 aa, Homo Sapiens
SYFSAPNSY

SEQ ID NO: 163098 - protein, 9 aa, Homo Sapiens
SYFSSTKTL

SEQ ID NO: 163099 - protein, 9 aa, Homo Sapiens
SYGAAGLAF

SEQ ID NO: 163100 - protein, 9 aa, Homo Sapiens
SYGLQHNCL

SEQ ID NO: 163101 - protein, 9 aa, Homo Sapiens
SYHDGALVV

SEQ ID NO: 163102 - protein, 9 aa, Homo Sapiens
SYHLVGISF

SEQ ID NO: 163103 - protein, 9 aa, Homo Sapiens
SYHPALNAI

SEQ ID NO: 163104 - protein, 9 aa, Homo Sapiens
SYHPSGLSL

SEQ ID NO: 163105 - protein, 9 aa, Homo Sapiens
SYHSYVIGF

SEQ ID NO: 163106 - protein, 9 aa, Homo Sapiens
SYHVKTAFF

SEQ ID NO: 163107 - protein, 9 aa, Homo Sapiens
SYHVSAQNL

SEQ ID NO: 163108 - protein, 9 aa, Homo Sapiens
SYICALIAM

SEQ ID NO: 163109 - protein, 9 aa, Homo Sapiens
SYIEFPAVM

SEQ ID NO: 163110 - protein, 9 aa, Homo Sapiens
SYIGSHREL

SEQ ID NO: 163111 - protein, 9 aa, Homo Sapiens
SYIHTSASL

SEQ ID NO: 163112 - protein, 9 aa, Homo Sapiens
SYIIGTSSV

SEQ ID NO: 163113 - protein, 9 aa, Homo Sapiens
SYIQGGRPF

SEQ ID NO: 163114 - protein, 9 aa, Homo Sapiens
SYISEVKEV

SEQ ID NO: 163115 - protein, 9 aa, Homo Sapiens
SYISKVDVL

SEQ ID NO: 163116 - protein, 9 aa, Homo Sapiens
SYISRTNQL

SEQ ID NO: 163117 - protein, 9 aa, Homo Sapiens
SYIYGAQHL

SEQ ID NO: 163118 - protein, 9 aa, Homo Sapiens
SYLAESLEL

SEQ ID NO: 163119 - protein, 9 aa, Homo Sapiens
SYLDFTNPK

SEQ ID NO: 163120 - protein, 9 aa, Homo Sapiens
SYLDRTEQL

SEQ ID NO: 163121 - protein, 9 aa, Homo Sapiens
SYLEKVSEV

SEQ ID NO: 163122 - protein, 9 aa, Homo Sapiens
SYLELVKSL

SEQ ID NO: 163123 - protein, 9 aa, Homo Sapiens
SYLHSLLEM

SEQ ID NO: 163124 - protein, 9 aa, Homo Sapiens
SYLIARIAL

SEQ ID NO: 163125 - protein, 9 aa, Homo Sapiens
SYLLQSTEL

SEQ ID NO: 163126 - protein, 9 aa, Homo Sapiens
SYLPEAGQY

SEQ ID NO: 163127 - protein, 9 aa, Homo Sapiens
SYLPGSTAF

SEQ ID NO: 163128 - protein, 9 aa, Homo Sapiens
SYLPHAPPF

SEQ ID NO: 163129 - protein, 9 aa, Homo Sapiens
SYLPHSSEY

SEQ ID NO: 163130 - protein, 9 aa, Homo Sapiens
SYLPLAHMF

SEQ ID NO: 163131 - protein, 9 aa, Homo Sapiens
SYLTSASSL

SEQ ID NO: 163132 - protein, 9 aa, Homo Sapiens
SYMAYMTQY

SEQ ID NO: 163133 - protein, 9 aa, Homo Sapiens
SYMDPMNEY

SEQ ID NO: 163134 - protein, 9 aa, Homo Sapiens
SYMESVVTF

SEQ ID NO: 163135 - protein, 9 aa, Homo Sapiens
SYMEVPTYL

SEQ ID NO: 163136 - protein, 9 aa, Homo Sapiens
SYMISVNMH

SEQ ID NO: 163137 - protein, 9 aa, Homo Sapiens
SYMKDVCYV

SEQ ID NO: 163138 - protein, 9 aa, Homo Sapiens
SYMPTILWL

SEQ ID NO: 163139 - protein, 9 aa, Homo Sapiens
SYMPTVSHL

SEQ ID NO: 163140 - protein, 9 aa, Homo Sapiens
SYMTTVIEY

SEQ ID NO: 163141 - protein, 9 aa, Homo Sapiens
SYMVKGMAF

SEQ ID NO: 163142 - protein, 9 aa, Homo Sapiens
SYMWTINNF

SEQ ID NO: 163143 - protein, 9 aa, Homo Sapiens
SYNAIRTGL

SEQ ID NO: 163144 - protein, 9 aa, Homo Sapiens
SYNDYVREF

SEQ ID NO: 163145 - protein, 9 aa, Homo Sapiens
SYNLFSREF

SEQ ID NO: 163146 - protein, 9 aa, Homo Sapiens
SYNLTVREL

SEQ ID NO: 163147 - protein, 9 aa, Homo Sapiens
SYPDAILQA

SEQ ID NO: 163148 - protein, 9 aa, Homo Sapiens
SYPDFLHKM

SEQ ID NO: 163149 - protein, 9 aa, Homo Sapiens
SYPDFLRMM

SEQ ID NO: 163150 - protein, 9 aa, Homo Sapiens
SYPDNFLHI

SEQ ID NO: 163151 - protein, 9 aa, Homo Sapiens
SYPFLVLQM

SEQ ID NO: 163152 - protein, 9 aa, Homo Sapiens
SYPHHATQL

SEQ ID NO: 163153 - protein, 9 aa, Homo Sapiens
SYPLFSQEF

SEQ ID NO: 163154 - protein, 9 aa, Homo Sapiens
SYPLNSYEL

SEQ ID NO: 163155 - protein, 9 aa, Homo Sapiens
SYPNPVAHL

SEQ ID NO: 163156 - protein, 9 aa, Homo Sapiens
SYPSVVSTL

SEQ ID NO: 163157 - protein, 9 aa, Homo Sapiens
SYPTTTISY

SEQ ID NO: 163158 - protein, 9 aa, Homo Sapiens
SYQDLVKCF

SEQ ID NO: 163159 - protein, 9 aa, Homo Sapiens
SYQDLVQRL

SEQ ID NO: 163160 - protein, 9 aa, Homo Sapiens
SYQEHVKQL

SEQ ID NO: 163161 - protein, 9 aa, Homo Sapiens
SYQEMIANL

SEQ ID NO: 163162 - protein, 9 aa, Homo Sapiens
SYQESTKQL

SEQ ID NO: 163163 - protein, 9 aa, Homo Sapiens
SYQILTRQL

SEQ ID NO: 163164 - protein, 9 aa, Homo Sapiens
SYQLWADNL

SEQ ID NO: 163165 - protein, 9 aa, Homo Sapiens
SYQNNITHL

SEQ ID NO: 163166 - protein, 9 aa, Homo Sapiens
SYQRAFNEF

SEQ ID NO: 163167 - protein, 9 aa, Homo Sapiens
SYQRFTDCY

SEQ ID NO: 163168 - protein, 9 aa, Homo Sapiens
SYSPYVTEL

SEQ ID NO: 163169 - protein, 9 aa, Homo Sapiens
SYSSIASEF

SEQ ID NO: 163170 - protein, 9 aa, Homo Sapiens
SYVQVTSNF

SEQ ID NO: 163171 - protein, 9 aa, Homo Sapiens
SYVTFPREL

SEQ ID NO: 163172 - protein, 9 aa, Homo Sapiens
SYYAVAHAV

SEQ ID NO: 163173 - protein, 9 aa, Homo Sapiens
SYYAYVVEL

SEQ ID NO: 163174 - protein, 9 aa, Homo Sapiens
SYYEEALEL

SEQ ID NO: 163175 - protein, 9 aa, Homo Sapiens
SYYKDALRF

SEQ ID NO: 163176 - protein, 9 aa, Homo Sapiens
SYYKKALAL

SEQ ID NO: 163177 - protein, 9 aa, Homo Sapiens
SYYKNGWIV

SEQ ID NO: 163178 - protein, 9 aa, Homo Sapiens
SYYNSHDSL

SEQ ID NO: 163179 - protein, 9 aa, Homo Sapiens
SYYQSSVQY

SEQ ID NO: 163180 - protein, 9 aa, Homo Sapiens
SYYSPSIGF

SEQ ID NO: 163181 - protein, 9 aa, Homo Sapiens
SYYTVAHAI

SEQ ID NO: 163182 - protein, 9 aa, Homo Sapiens
SYYWNAQRH

SEQ ID NO: 163183 - protein, 9 aa, Homo Sapiens
TFAEIVTPF

SEQ ID NO: 163184 - protein, 9 aa, Homo Sapiens
TFASRVSSL

SEQ ID NO: 163185 - protein, 9 aa, Homo Sapiens
TFATMVSSL

SEQ ID NO: 163186 - protein, 9 aa, Homo Sapiens
TFFFQPRPL

SEQ ID NO: 163187 - protein, 9 aa, Homo Sapiens
TFFPACVSL

SEQ ID NO: 163188 - protein, 9 aa, Homo Sapiens
TFGERVVAF

SEQ ID NO: 163189 - protein, 9 aa, Homo Sapiens
TFGTMGVGL

SEQ ID NO: 163190 - protein, 9 aa, Homo Sapiens
TFIDDISAY

SEQ ID NO: 163191 - protein, 9 aa, Homo Sapiens
TFIDPRIPL

SEQ ID NO: 163192 - protein, 9 aa, Homo Sapiens
TFIGRANHF

SEQ ID NO: 163193 - protein, 9 aa, Homo Sapiens
TFINNVISH

SEQ ID NO: 163194 - protein, 9 aa, Homo Sapiens
TFIQRVQSL

SEQ ID NO: 163195 - protein, 9 aa, Homo Sapiens
TFIRNSRPL

SEQ ID NO: 163196 - protein, 9 aa, Homo Sapiens
TFLEAGVEM

SEQ ID NO: 163197 - protein, 9 aa, Homo Sapiens
TFLVQLENY

SEQ ID NO: 163198 - protein, 9 aa, Homo Sapiens
TFLYTGNCF

SEQ ID NO: 163199 - protein, 9 aa, Homo Sapiens
TFMDHVLRY

SEQ ID NO: 163200 - protein, 9 aa, Homo Sapiens
TFMDRAGSL

SEQ ID NO: 163201 - protein, 9 aa, Homo Sapiens
TFMEQKITY

SEQ ID NO: 163202 - protein, 9 aa, Homo Sapiens
TFMPKQRSL

SEQ ID NO: 163203 - protein, 9 aa, Homo Sapiens
TFMPVASGL

SEQ ID NO: 163204 - protein, 9 aa, Homo Sapiens
TFNEDVQAL

SEQ ID NO: 163205 - protein, 9 aa, Homo Sapiens
TFNNPTTEF

SEQ ID NO: 163206 - protein, 9 aa, Homo Sapiens
TFPASVLQF

SEQ ID NO: 163207 - protein, 9 aa, Homo Sapiens
TFPKEIQML

SEQ ID NO: 163208 - protein, 9 aa, Homo Sapiens
TFPLQVLGF

SEQ ID NO: 163209 - protein, 9 aa, Homo Sapiens
TFPNNPVEL

SEQ ID NO: 163210 - protein, 9 aa, Homo Sapiens
TFPSDITEF

SEQ ID NO: 163211 - protein, 9 aa, Homo Sapiens
TFQDKTLNF

SEQ ID NO: 163212 - protein, 9 aa, Homo Sapiens
TFQENLSAF

SEQ ID NO: 163213 - protein, 9 aa, Homo Sapiens
TFQNDIHVY

SEQ ID NO: 163214 - protein, 9 aa, Homo Sapiens
TFQSRTLAL

SEQ ID NO: 163215 - protein, 9 aa, Homo Sapiens
TFQSTKAVY

SEQ ID NO: 163216 - protein, 9 aa, Homo Sapiens
TFTFSHATF

SEQ ID NO: 163217 - protein, 9 aa, Homo Sapiens
TFVEPVSAF

SEQ ID NO: 163218 - protein, 9 aa, Homo Sapiens
TLPHEILEM

SEQ ID NO: 163219 - protein, 9 aa, Homo Sapiens
TSPEAFLAL

SEQ ID NO: 163220 - protein, 9 aa, Homo Sapiens
TVGVFIVSI

SEQ ID NO: 163221 - protein, 9 aa, Homo Sapiens
TVYVSMIAL

SEQ ID NO: 163222 - protein, 9 aa, Homo Sapiens
TWPDGWTAV

SEQ ID NO: 163223 - protein, 9 aa, Homo Sapiens
TWPKEVRQL

SEQ ID NO: 163224 - protein, 9 aa, Homo Sapiens
TYASFTRAY

SEQ ID NO: 163225 - protein, 9 aa, Homo Sapiens
TYFAVNANY

SEQ ID NO: 163226 - protein, 9 aa, Homo Sapiens
TYFIVGTAM

SEQ ID NO: 163227 - protein, 9 aa, Homo Sapiens
TYFQRAQSL

SEQ ID NO: 163228 - protein, 9 aa, Homo Sapiens
TYGERVVAF

SEQ ID NO: 163229 - protein, 9 aa, Homo Sapiens
TYGFRGEAL

SEQ ID NO: 163230 - protein, 9 aa, Homo Sapiens
TYIDKSTQL

SEQ ID NO: 163231 - protein, 9 aa, Homo Sapiens
TYIGPSTVF

SEQ ID NO: 163232 - protein, 9 aa, Homo Sapiens
TYIGSVEPL

SEQ ID NO: 163233 - protein, 9 aa, Homo Sapiens
TYIKRVIAH

SEQ ID NO: 163234 - protein, 9 aa, Homo Sapiens
TYINHVVSV

SEQ ID NO: 163235 - protein, 9 aa, Homo Sapiens
TYLDPALEL

SEQ ID NO: 163236 - protein, 9 aa, Homo Sapiens
TYLDVRSCL

SEQ ID NO: 163237 - protein, 9 aa, Homo Sapiens
TYLEKAVEV

SEQ ID NO: 163238 - protein, 9 aa, Homo Sapiens
TYLFTYSSV

SEQ ID NO: 163239 - protein, 9 aa, Homo Sapiens
TYLGVAASL

SEQ ID NO: 163240 - protein, 9 aa, Homo Sapiens
TYLPAGQSV

SEQ ID NO: 163241 - protein, 9 aa, Homo Sapiens
TYLPRIKEY

SEQ ID NO: 163242 - protein, 9 aa, Homo Sapiens
TYLVKRLEY

SEQ ID NO: 163243 - protein, 9 aa, Homo Sapiens
TYMAMYLTY

SEQ ID NO: 163244 - protein, 9 aa, Homo Sapiens
TYNILTHDY

SEQ ID NO: 163245 - protein, 9 aa, Homo Sapiens
TYNTQVNFM

SEQ ID NO: 163246 - protein, 9 aa, Homo Sapiens
TYNYPVHYF

SEQ ID NO: 163247 - protein, 9 aa, Homo Sapiens
TYPAGFMDV

SEQ ID NO: 163248 - protein, 9 aa, Homo Sapiens
TYPDVNNSI

SEQ ID NO: 163249 - protein, 9 aa, Homo Sapiens
TYPENWRAF

SEQ ID NO: 163250 - protein, 9 aa, Homo Sapiens
TYPPFVNFF

SEQ ID NO: 163251 - protein, 9 aa, Homo Sapiens
TYPPYVPEY

SEQ ID NO: 163252 - protein, 9 aa, Homo Sapiens
TYPSLPKSL

SEQ ID NO: 163253 - protein, 9 aa, Homo Sapiens
TYPSNILSH

SEQ ID NO: 163254 - protein, 9 aa, Homo Sapiens
TYQAMVHEL

SEQ ID NO: 163255 - protein, 9 aa, Homo Sapiens
TYQDIQNTI

SEQ ID NO: 163256 - protein, 9 aa, Homo Sapiens
TYQEKITHL

SEQ ID NO: 163257 - protein, 9 aa, Homo Sapiens
TYQFSGVYV

SEQ ID NO: 163258 - protein, 9 aa, Homo Sapiens
TYQKLARAL

SEQ ID NO: 163259 - protein, 9 aa, Homo Sapiens
TYQRSVLAL

SEQ ID NO: 163260 - protein, 9 aa, Homo Sapiens
TYQVLAVTF

SEQ ID NO: 163261 - protein, 9 aa, Homo Sapiens
TYSEFAREL

SEQ ID NO: 163262 - protein, 9 aa, Homo Sapiens
TYSPALNKM

SEQ ID NO: 163263 - protein, 9 aa, Homo Sapiens
TYVSWAIAY

SEQ ID NO: 163264 - protein, 9 aa, Homo Sapiens
TYVTEVREL

SEQ ID NO: 163265 - protein, 9 aa, Homo Sapiens
TYVTPRRPF

SEQ ID NO: 163266 - protein, 9 aa, Homo Sapiens
TYYGSFVTR

SEQ ID NO: 163267 - protein, 9 aa, Homo Sapiens
TYYVSTVLF

SEQ ID NO: 163268 - protein, 9 aa, Homo Sapiens
VALLRVTPF

SEQ ID NO: 163269 - protein, 9 aa, Homo Sapiens
VANTMRTSL

SEQ ID NO: 163270 - protein, 9 aa, Homo Sapiens
VAPEEHPVL

SEQ ID NO: 163271 - protein, 9 aa, Homo Sapiens
VAPLPRSAL

SEQ ID NO: 163272 - protein, 9 aa, Homo Sapiens
VAYVSSVAL

SEQ ID NO: 163273 - protein, 9 aa, Homo Sapiens
VFAAFCRAL

SEQ ID NO: 163274 - protein, 9 aa, Homo Sapiens
VFADYEAYM

SEQ ID NO: 163275 - protein, 9 aa, Homo Sapiens
VFAEKITSL

SEQ ID NO: 163276 - protein, 9 aa, Homo Sapiens
VFAPPAEAY

SEQ ID NO: 163277 - protein, 9 aa, Homo Sapiens
VFAPTPSAM

SEQ ID NO: 163278 - protein, 9 aa, Homo Sapiens
VFCGRILSM

SEQ ID NO: 163279 - protein, 9 aa, Homo Sapiens
VFFTHVQEL

SEQ ID NO: 163280 - protein, 9 aa, Homo Sapiens
VFGGQRLTL

SEQ ID NO: 163281 - protein, 9 aa, Homo Sapiens
VFGTAISAF

SEQ ID NO: 163282 - protein, 9 aa, Homo Sapiens
VFHCQSAVM

SEQ ID NO: 163283 - protein, 9 aa, Homo Sapiens
VFHPKRAVF

SEQ ID NO: 163284 - protein, 9 aa, Homo Sapiens
VFHVSNLEF

SEQ ID NO: 163285 - protein, 9 aa, Homo Sapiens
VFIDEIDAI

SEQ ID NO: 163286 - protein, 9 aa, Homo Sapiens
VFIDGPLAL

SEQ ID NO: 163287 - protein, 9 aa, Homo Sapiens
VFIDKQTNL

SEQ ID NO: 163288 - protein, 9 aa, Homo Sapiens
VFIEDAIQY

SEQ ID NO: 163289 - protein, 9 aa, Homo Sapiens
VFIHQPRAL

SEQ ID NO: 163290 - protein, 9 aa, Homo Sapiens
VFIPHGLIM

SEQ ID NO: 163291 - protein, 9 aa, Homo Sapiens
VFISVCTAL

SEQ ID NO: 163292 - protein, 9 aa, Homo Sapiens
VFIWKISDF

SEQ ID NO: 163293 - protein, 9 aa, Homo Sapiens
VFKERISDM

SEQ ID NO: 163294 - protein, 9 aa, Homo Sapiens
VFLEAAKAL

SEQ ID NO: 163295 - protein, 9 aa, Homo Sapiens
VFLERGEVM

SEQ ID NO: 163296 - protein, 9 aa, Homo Sapiens
VFLLDLGKV

SEQ ID NO: 163297 - protein, 9 aa, Homo Sapiens
VFLPRALAL

SEQ ID NO: 163298 - protein, 9 aa, Homo Sapiens
VFLPRVTEL

SEQ ID NO: 163299 - protein, 9 aa, Homo Sapiens
VFLSTGSEL

SEQ ID NO: 163300 - protein, 9 aa, Homo Sapiens
VFLSTRQVL

SEQ ID NO: 163301 - protein, 9 aa, Homo Sapiens
VFLTTRQTL

SEQ ID NO: 163302 - protein, 9 aa, Homo Sapiens
VFMDKPEEF

SEQ ID NO: 163303 - protein, 9 aa, Homo Sapiens
VFMDVCQNF

SEQ ID NO: 163304 - protein, 9 aa, Homo Sapiens
VFMHVSTAY

SEQ ID NO: 163305 - protein, 9 aa, Homo Sapiens
VFMISSHEL

SEQ ID NO: 163306 - protein, 9 aa, Homo Sapiens
VFMPHVTEA

SEQ ID NO: 163307 - protein, 9 aa, Homo Sapiens
VFMTPGNSF

SEQ ID NO: 163308 - protein, 9 aa, Homo Sapiens
VFNEATSSF

SEQ ID NO: 163309 - protein, 9 aa, Homo Sapiens
VFNFTIHEI

SEQ ID NO: 163310 - protein, 9 aa, Homo Sapiens
VFNPMSQDL

SEQ ID NO: 163311 - protein, 9 aa, Homo Sapiens
VFNSMLVSI

SEQ ID NO: 163312 - protein, 9 aa, Homo Sapiens
VFPAIAQEI

SEQ ID NO: 163313 - protein, 9 aa, Homo Sapiens
VFPDDMPTL

SEQ ID NO: 163314 - protein, 9 aa, Homo Sapiens
VFPDFYLHL

SEQ ID NO: 163315 - protein, 9 aa, Homo Sapiens
VFPDKGYSF

SEQ ID NO: 163316 - protein, 9 aa, Homo Sapiens
VFPEDMAKY

SEQ ID NO: 163317 - protein, 9 aa, Homo Sapiens
VFPEFAAAH

SEQ ID NO: 163318 - protein, 9 aa, Homo Sapiens
VFPEKGYSF

SEQ ID NO: 163319 - protein, 9 aa, Homo Sapiens
VFPETVPSL

SEQ ID NO: 163320 - protein, 9 aa, Homo Sapiens
VFPKPVTAL

SEQ ID NO: 163321 - protein, 9 aa, Homo Sapiens
VFPKVRITA

SEQ ID NO: 163322 - protein, 9 aa, Homo Sapiens
VFPLKVFGY

SEQ ID NO: 163323 - protein, 9 aa, Homo Sapiens
VFPSSAATY

SEQ ID NO: 163324 - protein, 9 aa, Homo Sapiens
VFPTRTARF

SEQ ID NO: 163325 - protein, 9 aa, Homo Sapiens
VFPWHKNLL

SEQ ID NO: 163326 - protein, 9 aa, Homo Sapiens
VFQDMVIVF

SEQ ID NO: 163327 - protein, 9 aa, Homo Sapiens
VFQDRTLHV

SEQ ID NO: 163328 - protein, 9 aa, Homo Sapiens
VFQERINCL

SEQ ID NO: 163329 - protein, 9 aa, Homo Sapiens
VFQEVGINY

SEQ ID NO: 163330 - protein, 9 aa, Homo Sapiens
VFQGAVESI

SEQ ID NO: 163331 - protein, 9 aa, Homo Sapiens
VFQLRDSVY

SEQ ID NO: 163332 - protein, 9 aa, Homo Sapiens
VFQPETSTL

SEQ ID NO: 163333 - protein, 9 aa, Homo Sapiens
VFQPSVKSL

SEQ ID NO: 163334 - protein, 9 aa, Homo Sapiens
VFQPSVRSL

SEQ ID NO: 163335 - protein, 9 aa, Homo Sapiens
VFQQIALSY

SEQ ID NO: 163336 - protein, 9 aa, Homo Sapiens
VFQQVGVSM

SEQ ID NO: 163337 - protein, 9 aa, Homo Sapiens
VFQSTDTCY

SEQ ID NO: 163338 - protein, 9 aa, Homo Sapiens
VFQTKIQEF

SEQ ID NO: 163339 - protein, 9 aa, Homo Sapiens
VFQVKTLSL

SEQ ID NO: 163340 - protein, 9 aa, Homo Sapiens
VFQYRLVEY

SEQ ID NO: 163341 - protein, 9 aa, Homo Sapiens
VFSDGAVSL

SEQ ID NO: 163342 - protein, 9 aa, Homo Sapiens
VFSFKMVSY

SEQ ID NO: 163343 - protein, 9 aa, Homo Sapiens
VFSHRLSVY

SEQ ID NO: 163344 - protein, 9 aa, Homo Sapiens
VFSVRGTSF

SEQ ID NO: 163345 - protein, 9 aa, Homo Sapiens
VFTIQSIVM

SEQ ID NO: 163346 - protein, 9 aa, Homo Sapiens
VFVDRAACF

SEQ ID NO: 163347 - protein, 9 aa, Homo Sapiens
VFVDRAGEW

SEQ ID NO: 163348 - protein, 9 aa, Homo Sapiens
VFVDRTLDL

SEQ ID NO: 163349 - protein, 9 aa, Homo Sapiens
VFVEATHVL

SEQ ID NO: 163350 - protein, 9 aa, Homo Sapiens
VFVEDVDSF

SEQ ID NO: 163351 - protein, 9 aa, Homo Sapiens
VFVVDSAAF

SEQ ID NO: 163352 - protein, 9 aa, Homo Sapiens
VFYELAHQL

SEQ ID NO: 163353 - protein, 9 aa, Homo Sapiens
VFYGFAVHM

SEQ ID NO: 163354 - protein, 9 aa, Homo Sapiens
VFYNPVQEF

SEQ ID NO: 163355 - protein, 9 aa, Homo Sapiens
VFYPSSLAF

SEQ ID NO: 163356 - protein, 9 aa, Homo Sapiens
VFYPYPQYF

SEQ ID NO: 163357 - protein, 9 aa, Homo Sapiens
VFYYFVSAL

SEQ ID NO: 163358 - protein, 9 aa, Homo Sapiens
VGHVMGSAL

SEQ ID NO: 163359 - protein, 9 aa, Homo Sapiens
VGPAAFLYF

SEQ ID NO: 163360 - protein, 9 aa, Homo Sapiens
VLPNIHPEL

SEQ ID NO: 163361 - protein, 9 aa, Homo Sapiens
VLPVYMNCL

SEQ ID NO: 163362 - protein, 9 aa, Homo Sapiens
VMINKATPY

SEQ ID NO: 163363 - protein, 9 aa, Homo Sapiens
VPDTITEWK

SEQ ID NO: 163364 - protein, 9 aa, Homo Sapiens
VTNLFNLDF

SEQ ID NO: 163365 - protein, 9 aa, Homo Sapiens
VVNIQTIAM

SEQ ID NO: 163366 - protein, 9 aa, Homo Sapiens
VWPSSRLEA

SEQ ID NO: 163367 - protein, 9 aa, Homo Sapiens
VYADGSICL

SEQ ID NO: 163368 - protein, 9 aa, Homo Sapiens
VYADQPHIF

SEQ ID NO: 163369 - protein, 9 aa, Homo Sapiens
VYAFSARPL

SEQ ID NO: 163370 - protein, 9 aa, Homo Sapiens
VYALPTIAF

SEQ ID NO: 163371 - protein, 9 aa, Homo Sapiens
VYALQQTAL

SEQ ID NO: 163372 - protein, 9 aa, Homo Sapiens
VYALVVVSY

SEQ ID NO: 163373 - protein, 9 aa, Homo Sapiens
VYCARFVEL

SEQ ID NO: 163374 - protein, 9 aa, Homo Sapiens
VYFASLLTV

SEQ ID NO: 163375 - protein, 9 aa, Homo Sapiens
VYFGIAASL

SEQ ID NO: 163376 - protein, 9 aa, Homo Sapiens
VYFLIGKVY

SEQ ID NO: 163377 - protein, 9 aa, Homo Sapiens
VYFPALTSL

SEQ ID NO: 163378 - protein, 9 aa, Homo Sapiens
VYFPQISSV

SEQ ID NO: 163379 - protein, 9 aa, Homo Sapiens
VYFPWVSQY

SEQ ID NO: 163380 - protein, 9 aa, Homo Sapiens
VYFQMQSTY

SEQ ID NO: 163381 - protein, 9 aa, Homo Sapiens
VYFQMQTTY

SEQ ID NO: 163382 - protein, 9 aa, Homo Sapiens
VYFSAAHAL

SEQ ID NO: 163383 - protein, 9 aa, Homo Sapiens
VYFTQGLGL

SEQ ID NO: 163384 - protein, 9 aa, Homo Sapiens
VYFVQKNSL

SEQ ID NO: 163385 - protein, 9 aa, Homo Sapiens
VYFYTFNSL

SEQ ID NO: 163386 - protein, 9 aa, Homo Sapiens
VYHEILIGY

SEQ ID NO: 163387 - protein, 9 aa, Homo Sapiens
VYHVVGVDV

SEQ ID NO: 163388 - protein, 9 aa, Homo Sapiens
VYIAYSTFY

SEQ ID NO: 163389 - protein, 9 aa, Homo Sapiens
VYIDKVRSL

SEQ ID NO: 163390 - protein, 9 aa, Homo Sapiens
VYIDQTMVL

SEQ ID NO: 163391 - protein, 9 aa, Homo Sapiens
VYIDRVRSL

SEQ ID NO: 163392 - protein, 9 aa, Homo Sapiens
VYIDTESAF

SEQ ID NO: 163393 - protein, 9 aa, Homo Sapiens
VYIEAAIRF

SEQ ID NO: 163394 - protein, 9 aa, Homo Sapiens
VYIEFTEYY

SEQ ID NO: 163395 - protein, 9 aa, Homo Sapiens
VYIEHRLMM

SEQ ID NO: 163396 - protein, 9 aa, Homo Sapiens
VYIGVHVPF

SEQ ID NO: 163397 - protein, 9 aa, Homo Sapiens
VYIIAGACL

SEQ ID NO: 163398 - protein, 9 aa, Homo Sapiens
VYINTAQEF

SEQ ID NO: 163399 - protein, 9 aa, Homo Sapiens
VYIPFSAIY

SEQ ID NO: 163400 - protein, 9 aa, Homo Sapiens
VYIPSKTDL

SEQ ID NO: 163401 - protein, 9 aa, Homo Sapiens
VYIPSRVAL

SEQ ID NO: 163402 - protein, 9 aa, Homo Sapiens
VYISNGQVL

SEQ ID NO: 163403 - protein, 9 aa, Homo Sapiens
VYISSRPPL

SEQ ID NO: 163404 - protein, 9 aa, Homo Sapiens
VYITGKEVF

SEQ ID NO: 163405 - protein, 9 aa, Homo Sapiens
VYITPMEAL

SEQ ID NO: 163406 - protein, 9 aa, Homo Sapiens
VYITRAQLM

SEQ ID NO: 163407 - protein, 9 aa, Homo Sapiens
VYLERLLTY

SEQ ID NO: 163408 - protein, 9 aa, Homo Sapiens
VYLFTEAYY

SEQ ID NO: 163409 - protein, 9 aa, Homo Sapiens
VYLPGVIAA

SEQ ID NO: 163410 - protein, 9 aa, Homo Sapiens
VYLPMSYCY

SEQ ID NO: 163411 - protein, 9 aa, Homo Sapiens
VYLPTHTSL

SEQ ID NO: 163412 - protein, 9 aa, Homo Sapiens
VYLYYKLAY

SEQ ID NO: 163413 - protein, 9 aa, Homo Sapiens
VYMGLLAVF

SEQ ID NO: 163414 - protein, 9 aa, Homo Sapiens
VYMNRVKEI

SEQ ID NO: 163415 - protein, 9 aa, Homo Sapiens
VYMPCLYVY

SEQ ID NO: 163416 - protein, 9 aa, Homo Sapiens
VYNASNNEL

SEQ ID NO: 163417 - protein, 9 aa, Homo Sapiens
VYNEAGVTF

SEQ ID NO: 163418 - protein, 9 aa, Homo Sapiens
VYNFSLVAL

SEQ ID NO: 163419 - protein, 9 aa, Homo Sapiens
VYNITKWSI

SEQ ID NO: 163420 - protein, 9 aa, Homo Sapiens
VYNLVKETM

SEQ ID NO: 163421 - protein, 9 aa, Homo Sapiens
VYNNIMRHY

SEQ ID NO: 163422 - protein, 9 aa, Homo Sapiens
VYNVQYSFI

SEQ ID NO: 163423 - protein, 9 aa, Homo Sapiens
VYNVTQHAV

SEQ ID NO: 163424 - protein, 9 aa, Homo Sapiens
VYNYAEQTL

SEQ ID NO: 163425 - protein, 9 aa, Homo Sapiens
VYPDGIRHI

SEQ ID NO: 163426 - protein, 9 aa, Homo Sapiens
VYPERSTSY

SEQ ID NO: 163427 - protein, 9 aa, Homo Sapiens
VYPEYVIQY

SEQ ID NO: 163428 - protein, 9 aa, Homo Sapiens
VYPGIAVFF

SEQ ID NO: 163429 - protein, 9 aa, Homo Sapiens
VYPGYYLTF

SEQ ID NO: 163430 - protein, 9 aa, Homo Sapiens
VYPLYTIVF

SEQ ID NO: 163431 - protein, 9 aa, Homo Sapiens
VYPMPRVIF

SEQ ID NO: 163432 - protein, 9 aa, Homo Sapiens
VYPNWAIGL

SEQ ID NO: 163433 - protein, 9 aa, Homo Sapiens
VYPPGFMGL

SEQ ID NO: 163434 - protein, 9 aa, Homo Sapiens
VYPPPHQVF

SEQ ID NO: 163435 - protein, 9 aa, Homo Sapiens
VYPQYVIEY

SEQ ID NO: 163436 - protein, 9 aa, Homo Sapiens
VYPSGTVCL

SEQ ID NO: 163437 - protein, 9 aa, Homo Sapiens
VYPTAVHVL

SEQ ID NO: 163438 - protein, 9 aa, Homo Sapiens
VYPYLCRAL

SEQ ID NO: 163439 - protein, 9 aa, Homo Sapiens
VYQAVQALY

SEQ ID NO: 163440 - protein, 9 aa, Homo Sapiens
VYQEIWIGM

SEQ ID NO: 163441 - protein, 9 aa, Homo Sapiens
VYQEMPAQL

SEQ ID NO: 163442 - protein, 9 aa, Homo Sapiens
VYQHGLTGF

SEQ ID NO: 163443 - protein, 9 aa, Homo Sapiens
VYQIAMVHY

SEQ ID NO: 163444 - protein, 9 aa, Homo Sapiens
VYQNHVQHL

SEQ ID NO: 163445 - protein, 9 aa, Homo Sapiens
VYQNIFTAM

SEQ ID NO: 163446 - protein, 9 aa, Homo Sapiens
VYQNQIAEL

SEQ ID NO: 163447 - protein, 9 aa, Homo Sapiens
VYQPKRSVL

SEQ ID NO: 163448 - protein, 9 aa, Homo Sapiens
VYQPMEKLY

SEQ ID NO: 163449 - protein, 9 aa, Homo Sapiens
VYQPVRYYY

SEQ ID NO: 163450 - protein, 9 aa, Homo Sapiens
VYQSMVLFF

SEQ ID NO: 163451 - protein, 9 aa, Homo Sapiens
VYQTYVNAM

SEQ ID NO: 163452 - protein, 9 aa, Homo Sapiens
VYQYMHETI

SEQ ID NO: 163453 - protein, 9 aa, Homo Sapiens
VYQYWNTKA

SEQ ID NO: 163454 - protein, 9 aa, Homo Sapiens
VYSCMRDFL

SEQ ID NO: 163455 - protein, 9 aa, Homo Sapiens
VYSNPVSSL

SEQ ID NO: 163456 - protein, 9 aa, Homo Sapiens
VYSPHVLNL

SEQ ID NO: 163457 - protein, 9 aa, Homo Sapiens
VYTDWIMAL

SEQ ID NO: 163458 - protein, 9 aa, Homo Sapiens
VYTEKVLEA

SEQ ID NO: 163459 - protein, 9 aa, Homo Sapiens
VYTTNIQEL

SEQ ID NO: 163460 - protein, 9 aa, Homo Sapiens
VYTTTVHWL

SEQ ID NO: 163461 - protein, 9 aa, Homo Sapiens
VYTYIQEFY

SEQ ID NO: 163462 - protein, 9 aa, Homo Sapiens
VYVAAVREF

SEQ ID NO: 163463 - protein, 9 aa, Homo Sapiens
VYVERAEVL

SEQ ID NO: 163464 - protein, 9 aa, Homo Sapiens
VYVKHSISF

SEQ ID NO: 163465 - protein, 9 aa, Homo Sapiens
VYVMGGVAM

SEQ ID NO: 163466 - protein, 9 aa, Homo Sapiens
VYVVGTAHF

SEQ ID NO: 163467 - protein, 9 aa, Homo Sapiens
VYWDYMKAI

SEQ ID NO: 163468 - protein, 9 aa, Homo Sapiens
VYWVARKPM

SEQ ID NO: 163469 - protein, 9 aa, Homo Sapiens
VYYASPRSY

SEQ ID NO: 163470 - protein, 9 aa, Homo Sapiens
VYYEVAGHL

SEQ ID NO: 163471 - protein, 9 aa, Homo Sapiens
VYYFSKGTL

SEQ ID NO: 163472 - protein, 9 aa, Homo Sapiens
VYYPELFVW

SEQ ID NO: 163473 - protein, 9 aa, Homo Sapiens
WFHYTLVAF

SEQ ID NO: 163474 - protein, 9 aa, Homo Sapiens
WFIPFVQSL

SEQ ID NO: 163475 - protein, 9 aa, Homo Sapiens
WYMDNPQNL

SEQ ID NO: 163476 - protein, 9 aa, Homo Sapiens
WYQRVYQSL

SEQ ID NO: 163477 - protein, 9 aa, Homo Sapiens
WYYSTKVQL

SEQ ID NO: 163478 - protein, 9 aa, Homo Sapiens
YFADGVLSL

SEQ ID NO: 163479 - protein, 9 aa, Homo Sapiens
YFEDVANAM

SEQ ID NO: 163480 - protein, 9 aa, Homo Sapiens
YFEEIKQFY

SEQ ID NO: 163481 - protein, 9 aa, Homo Sapiens
YFEGGVSSV

SEQ ID NO: 163482 - protein, 9 aa, Homo Sapiens
YFEPKDITA

SEQ ID NO: 163483 - protein, 9 aa, Homo Sapiens
YFFAVDTAY

SEQ ID NO: 163484 - protein, 9 aa, Homo Sapiens
YFHCTLIGY

SEQ ID NO: 163485 - protein, 9 aa, Homo Sapiens
YFHDATRVY

SEQ ID NO: 163486 - protein, 9 aa, Homo Sapiens
YFHDRFLEL

SEQ ID NO: 163487 - protein, 9 aa, Homo Sapiens
YFHDRVASF

SEQ ID NO: 163488 - protein, 9 aa, Homo Sapiens
YFHEALRAF

SEQ ID NO: 163489 - protein, 9 aa, Homo Sapiens
YFHEFGHVM

SEQ ID NO: 163490 - protein, 9 aa, Homo Sapiens
YFHIGSNAL

SEQ ID NO: 163491 - protein, 9 aa, Homo Sapiens
YFHTLTSEY

SEQ ID NO: 163492 - protein, 9 aa, Homo Sapiens
YFHTMVESL

SEQ ID NO: 163493 - protein, 9 aa, Homo Sapiens
YFIIILNHM

SEQ ID NO: 163494 - protein, 9 aa, Homo Sapiens
YFIRDVKSL

SEQ ID NO: 163495 - protein, 9 aa, Homo Sapiens
YFISHILAF

SEQ ID NO: 163496 - protein, 9 aa, Homo Sapiens
YFISHVLAF

SEQ ID NO: 163497 - protein, 9 aa, Homo Sapiens
YFISILQHL

SEQ ID NO: 163498 - protein, 9 aa, Homo Sapiens
YFISYGIEH

SEQ ID NO: 163499 - protein, 9 aa, Homo Sapiens
YFITQDSAF

SEQ ID NO: 163500 - protein, 9 aa, Homo Sapiens
YFIVTRQDY

SEQ ID NO: 163501 - protein, 9 aa, Homo Sapiens
YFKGDTIAL

SEQ ID NO: 163502 - protein, 9 aa, Homo Sapiens
YFKPMMKEF

SEQ ID NO: 163503 - protein, 9 aa, Homo Sapiens
YFLDKIDVI

SEQ ID NO: 163504 - protein, 9 aa, Homo Sapiens
YFLEMQEKL

SEQ ID NO: 163505 - protein, 9 aa, Homo Sapiens
YFLETSRDV

SEQ ID NO: 163506 - protein, 9 aa, Homo Sapiens
YFLEWRSVL

SEQ ID NO: 163507 - protein, 9 aa, Homo Sapiens
YFLHRLLHH

SEQ ID NO: 163508 - protein, 9 aa, Homo Sapiens
YFLPDTAHF

SEQ ID NO: 163509 - protein, 9 aa, Homo Sapiens
YFLPLANTL

SEQ ID NO: 163510 - protein, 9 aa, Homo Sapiens
YFLQQRDTL

SEQ ID NO: 163511 - protein, 9 aa, Homo Sapiens
YFLSRAQSL

SEQ ID NO: 163512 - protein, 9 aa, Homo Sapiens
YFLTKSQSL

SEQ ID NO: 163513 - protein, 9 aa, Homo Sapiens
YFLTTRQTL

SEQ ID NO: 163514 - protein, 9 aa, Homo Sapiens
YFMDHTVAF

SEQ ID NO: 163515 - protein, 9 aa, Homo Sapiens
YFMDVKCPG

SEQ ID NO: 163516 - protein, 9 aa, Homo Sapiens
YFMTMIVSL

SEQ ID NO: 163517 - protein, 9 aa, Homo Sapiens
YFMTYHTVL

SEQ ID NO: 163518 - protein, 9 aa, Homo Sapiens
YFPDARDMV

SEQ ID NO: 163519 - protein, 9 aa, Homo Sapiens
YFPDKVALL

SEQ ID NO: 163520 - protein, 9 aa, Homo Sapiens
YFPDRNVAL

SEQ ID NO: 163521 - protein, 9 aa, Homo Sapiens
YFPELIANF

SEQ ID NO: 163522 - protein, 9 aa, Homo Sapiens
YFPENVKAM

SEQ ID NO: 163523 - protein, 9 aa, Homo Sapiens
YFPEYAEKI

SEQ ID NO: 163524 - protein, 9 aa, Homo Sapiens
YFPGQAIAM

SEQ ID NO: 163525 - protein, 9 aa, Homo Sapiens
YFPHYEVPL

SEQ ID NO: 163526 - protein, 9 aa, Homo Sapiens
YFPKKISEL

SEQ ID NO: 163527 - protein, 9 aa, Homo Sapiens
YFPSWLSQL

SEQ ID NO: 163528 - protein, 9 aa, Homo Sapiens
YFPTQALNF

SEQ ID NO: 163529 - protein, 9 aa, Homo Sapiens
YFPVQVVTH

SEQ ID NO: 163530 - protein, 9 aa, Homo Sapiens
YFQAHKAVL

SEQ ID NO: 163531 - protein, 9 aa, Homo Sapiens
YFQAKIRAL

SEQ ID NO: 163532 - protein, 9 aa, Homo Sapiens
YFQALVNNM

SEQ ID NO: 163533 - protein, 9 aa, Homo Sapiens
YFQDERHPY

SEQ ID NO: 163534 - protein, 9 aa, Homo Sapiens
YFQDGRAVL

SEQ ID NO: 163535 - protein, 9 aa, Homo Sapiens
YFQHREFSF

SEQ ID NO: 163536 - protein, 9 aa, Homo Sapiens
YFQTTSTNL

SEQ ID NO: 163537 - protein, 9 aa, Homo Sapiens
YFQYLSKTY

SEQ ID NO: 163538 - protein, 9 aa, Homo Sapiens
YFQYVGTDF

SEQ ID NO: 163539 - protein, 9 aa, Homo Sapiens
YFRDNPSEL

SEQ ID NO: 163540 - protein, 9 aa, Homo Sapiens
YFRPIDTTM

SEQ ID NO: 163541 - protein, 9 aa, Homo Sapiens
YFRVMVDSL

SEQ ID NO: 163542 - protein, 9 aa, Homo Sapiens
YFSDNILCH

SEQ ID NO: 163543 - protein, 9 aa, Homo Sapiens
YFSEKAYAY

SEQ ID NO: 163544 - protein, 9 aa, Homo Sapiens
YFSPYPQEL

SEQ ID NO: 163545 - protein, 9 aa, Homo Sapiens
YFTDKAASY

SEQ ID NO: 163546 - protein, 9 aa, Homo Sapiens
YFVDDRLVM

SEQ ID NO: 163547 - protein, 9 aa, Homo Sapiens
YFVTGNHEY

SEQ ID NO: 163548 - protein, 9 aa, Homo Sapiens
YFYAAIVAV

SEQ ID NO: 163549 - protein, 9 aa, Homo Sapiens
YFYHGVHKI

SEQ ID NO: 163550 - protein, 9 aa, Homo Sapiens
YFYVIGSSY

SEQ ID NO: 163551 - protein, 9 aa, Homo Sapiens
YIPHGYMEL

SEQ ID NO: 163552 - protein, 9 aa, Homo Sapiens
YLPESRRPL

SEQ ID NO: 163553 - protein, 9 aa, Homo Sapiens
YMLDCRTSL

SEQ ID NO: 163554 - protein, 9 aa, Homo Sapiens
YMNVMLENY

SEQ ID NO: 163555 - protein, 9 aa, Homo Sapiens
YMPAKIGAF

SEQ ID NO: 163556 - protein, 9 aa, Homo Sapiens
YMPQNPHII

SEQ ID NO: 163557 - protein, 9 aa, Homo Sapiens
YNMPYPPVY

SEQ ID NO: 163558 - protein, 9 aa, Homo Sapiens
YSKLVMIPF

SEQ ID NO: 163559 - protein, 9 aa, Homo Sapiens
YVLMPFKLA

SEQ ID NO: 163560 - protein, 9 aa, Homo Sapiens
YVRDLRSIV

SEQ ID NO: 163561 - protein, 9 aa, Homo Sapiens
YVSLDNAVL

SEQ ID NO: 163562 - protein, 9 aa, Homo Sapiens
YWPDVIHSF

SEQ ID NO: 163563 - protein, 9 aa, Homo Sapiens
YYALEVSYF

SEQ ID NO: 163564 - protein, 9 aa, Homo Sapiens
YYALRAAGF

SEQ ID NO: 163565 - protein, 9 aa, Homo Sapiens
YYAVCQNLL

SEQ ID NO: 163566 - protein, 9 aa, Homo Sapiens
YYEDNKQFF

SEQ ID NO: 163567 - protein, 9 aa, Homo Sapiens
YYEEQHPEL

SEQ ID NO: 163568 - protein, 9 aa, Homo Sapiens
YYEFREEAY

SEQ ID NO: 163569 - protein, 9 aa, Homo Sapiens
YYEIRYQFY

SEQ ID NO: 163570 - protein, 9 aa, Homo Sapiens
YYFALAHTV

SEQ ID NO: 163571 - protein, 9 aa, Homo Sapiens
YYFDSYAHF

SEQ ID NO: 163572 - protein, 9 aa, Homo Sapiens
YYFDYKEQL

SEQ ID NO: 163573 - protein, 9 aa, Homo Sapiens
YYFFTPYVY

SEQ ID NO: 163574 - protein, 9 aa, Homo Sapiens
YYFLTNLSF

SEQ ID NO: 163575 - protein, 9 aa, Homo Sapiens
YYFPDSGFF

SEQ ID NO: 163576 - protein, 9 aa, Homo Sapiens
YYFSKLIEF

SEQ ID NO: 163577 - protein, 9 aa, Homo Sapiens
YYFVFDHAL

SEQ ID NO: 163578 - protein, 9 aa, Homo Sapiens
YYFVTREVM

SEQ ID NO: 163579 - protein, 9 aa, Homo Sapiens
YYHARVYEF

SEQ ID NO: 163580 - protein, 9 aa, Homo Sapiens
YYHPARLGA

SEQ ID NO: 163581 - protein, 9 aa, Homo Sapiens
YYHSYWHSM

SEQ ID NO: 163582 - protein, 9 aa, Homo Sapiens
YYHVYKLTL

SEQ ID NO: 163583 - protein, 9 aa, Homo Sapiens
YYHYSYSVV

SEQ ID NO: 163584 - protein, 9 aa, Homo Sapiens
YYIAGSLST

SEQ ID NO: 163585 - protein, 9 aa, Homo Sapiens
YYIDCIRQV

SEQ ID NO: 163586 - protein, 9 aa, Homo Sapiens
YYIDDVFHA

SEQ ID NO: 163587 - protein, 9 aa, Homo Sapiens
YYIEGINQL

SEQ ID NO: 163588 - protein, 9 aa, Homo Sapiens
YYIFRVANH

SEQ ID NO: 163589 - protein, 9 aa, Homo Sapiens
YYINKISST

SEQ ID NO: 163590 - protein, 9 aa, Homo Sapiens
YYIPEITSV

SEQ ID NO: 163591 - protein, 9 aa, Homo Sapiens
YYIRFFITY

SEQ ID NO: 163592 - protein, 9 aa, Homo Sapiens
YYISPRITF

SEQ ID NO: 163593 - protein, 9 aa, Homo Sapiens
YYITTRAQF

SEQ ID NO: 163594 - protein, 9 aa, Homo Sapiens
YYITTRVQF

SEQ ID NO: 163595 - protein, 9 aa, Homo Sapiens
YYIYSKVQL

SEQ ID NO: 163596 - protein, 9 aa, Homo Sapiens
YYKERLLYL

SEQ ID NO: 163597 - protein, 9 aa, Homo Sapiens
YYKPDSPEY

SEQ ID NO: 163598 - protein, 9 aa, Homo Sapiens
YYKPGLLMM

SEQ ID NO: 163599 - protein, 9 aa, Homo Sapiens
YYLARLLGL

SEQ ID NO: 163600 - protein, 9 aa, Homo Sapiens
YYLAWIREH

SEQ ID NO: 163601 - protein, 9 aa, Homo Sapiens
YYLCEQVRL

SEQ ID NO: 163602 - protein, 9 aa, Homo Sapiens
YYLGKILEM

SEQ ID NO: 163603 - protein, 9 aa, Homo Sapiens
YYLHDVLDL

SEQ ID NO: 163604 - protein, 9 aa, Homo Sapiens
YYLKALRSL

SEQ ID NO: 163605 - protein, 9 aa, Homo Sapiens
YYLLTKLES

SEQ ID NO: 163606 - protein, 9 aa, Homo Sapiens
YYLNEIQSF

SEQ ID NO: 163607 - protein, 9 aa, Homo Sapiens
YYLPKDDEY

SEQ ID NO: 163608 - protein, 9 aa, Homo Sapiens
YYLPKLLSY

SEQ ID NO: 163609 - protein, 9 aa, Homo Sapiens
YYLTFVQEL

SEQ ID NO: 163610 - protein, 9 aa, Homo Sapiens
YYLTHGLYL

SEQ ID NO: 163611 - protein, 9 aa, Homo Sapiens
YYLVKREDY

SEQ ID NO: 163612 - protein, 9 aa, Homo Sapiens
YYLWMLHSV

SEQ ID NO: 163613 - protein, 9 aa, Homo Sapiens
YYLYNHVAM

SEQ ID NO: 163614 - protein, 9 aa, Homo Sapiens
YYMDYLAAL

SEQ ID NO: 163615 - protein, 9 aa, Homo Sapiens
YYMRDVTAI

SEQ ID NO: 163616 - protein, 9 aa, Homo Sapiens
YYNGKIHAY

SEQ ID NO: 163617 - protein, 9 aa, Homo Sapiens
YYNKVSTVF

SEQ ID NO: 163618 - protein, 9 aa, Homo Sapiens
YYNLQGISH

SEQ ID NO: 163619 - protein, 9 aa, Homo Sapiens
YYNTEKVSI

SEQ ID NO: 163620 - protein, 9 aa, Homo Sapiens
YYPAKIEAI

SEQ ID NO: 163621 - protein, 9 aa, Homo Sapiens
YYPDHIKGL

SEQ ID NO: 163622 - protein, 9 aa, Homo Sapiens
YYPEHTSVL

SEQ ID NO: 163623 - protein, 9 aa, Homo Sapiens
YYPELAFQF

SEQ ID NO: 163624 - protein, 9 aa, Homo Sapiens
YYPEYKLLF

SEQ ID NO: 163625 - protein, 9 aa, Homo Sapiens
YYPFHYAPF

SEQ ID NO: 163626 - protein, 9 aa, Homo Sapiens
YYPIMVTQL

SEQ ID NO: 163627 - protein, 9 aa, Homo Sapiens
YYPLVAQHY

SEQ ID NO: 163628 - protein, 9 aa, Homo Sapiens
YYPQQAIVF

SEQ ID NO: 163629 - protein, 9 aa, Homo Sapiens
YYPSDVSSL

SEQ ID NO: 163630 - protein, 9 aa, Homo Sapiens
YYPYTITEY

SEQ ID NO: 163631 - protein, 9 aa, Homo Sapiens
YYQDQVDDF

SEQ ID NO: 163632 - protein, 9 aa, Homo Sapiens
YYQDTPKQI

SEQ ID NO: 163633 - protein, 9 aa, Homo Sapiens
YYQETLQQL

SEQ ID NO: 163634 - protein, 9 aa, Homo Sapiens
YYQEYPMSI

SEQ ID NO: 163635 - protein, 9 aa, Homo Sapiens
YYQHIVTTL

SEQ ID NO: 163636 - protein, 9 aa, Homo Sapiens
YYQIRSSQL

SEQ ID NO: 163637 - protein, 9 aa, Homo Sapiens
YYQLGDHEL

SEQ ID NO: 163638 - protein, 9 aa, Homo Sapiens
YYQLMKTAL

SEQ ID NO: 163639 - protein, 9 aa, Homo Sapiens
YYQNHIMNL

SEQ ID NO: 163640 - protein, 9 aa, Homo Sapiens
YYQPLVHLL

SEQ ID NO: 163641 - protein, 9 aa, Homo Sapiens
YYQRMLVVL

SEQ ID NO: 163642 - protein, 9 aa, Homo Sapiens
YYQSGRMLL

SEQ ID NO: 163643 - protein, 9 aa, Homo Sapiens
YYQSGTRSL

SEQ ID NO: 163644 - protein, 9 aa, Homo Sapiens
YYQSSVQYL

SEQ ID NO: 163645 - protein, 9 aa, Homo Sapiens
YYQTPRLWL

SEQ ID NO: 163646 - protein, 9 aa, Homo Sapiens
YYQVLNFAM

SEQ ID NO: 163647 - protein, 9 aa, Homo Sapiens
YYQYMETYM

SEQ ID NO: 163648 - protein, 9 aa, Homo Sapiens
YYRDYPTLV

SEQ ID NO: 163649 - protein, 9 aa, Homo Sapiens
YYSPHGHIL

SEQ ID NO: 163650 - protein, 9 aa, Homo Sapiens
YYSPSCREF

SEQ ID NO: 163651 - protein, 9 aa, Homo Sapiens
YYSPTKNEI

SEQ ID NO: 163652 - protein, 9 aa, Homo Sapiens
YYTDFLITL

SEQ ID NO: 163653 - protein, 9 aa, Homo Sapiens
YYTDFVMEL

SEQ ID NO: 163654 - protein, 9 aa, Homo Sapiens
YYTPDRMVL

SEQ ID NO: 163655 - protein, 9 aa, Homo Sapiens
YYTPITPHL

SEQ ID NO: 163656 - protein, 9 aa, Homo Sapiens
YYTRLGNDF

SEQ ID NO: 163657 - protein, 9 aa, Homo Sapiens
YYTVRQLEL

SEQ ID NO: 163658 - protein, 9 aa, Homo Sapiens
YYVDFFKTL

SEQ ID NO: 163659 - protein, 9 aa, Homo Sapiens
YYVRAVLHL

SEQ ID NO: 163660 - protein, 9 aa, Homo Sapiens
YYVWTVKEV

SEQ ID NO: 163661 - protein, 9 aa, Homo Sapiens
YYYDKNIIH

SEQ ID NO: 163662 - protein, 9 aa, Homo Sapiens
YYYDPTTGL

SEQ ID NO: 163663 - protein, 9 aa, Homo Sapiens
YYYGDISSL

SEQ ID NO: 163664 - protein, 9 aa, Homo Sapiens
YYYNGKAVY

SEQ ID NO: 163665 - protein, 9 aa, Homo Sapiens
YYYNKRILH

SEQ ID NO: 163666 - protein, 9 aa, Homo Sapiens
YYYPKQQGL

SEQ ID NO: 163667 - protein, 10 aa, Homo Sapiens
AAPGYAPPPF

SEQ ID NO: 163668 - protein, 10 aa, Homo Sapiens
AFADYRPTEV

SEQ ID NO: 163669 - protein, 10 aa, Homo Sapiens
AFFEEERSAL

SEQ ID NO: 163670 - protein, 10 aa, Homo Sapiens
AFFGSYRNAL

SEQ ID NO: 163671 - protein, 10 aa, Homo Sapiens
AFFNIPLMAY

SEQ ID NO: 163672 - protein, 10 aa, Homo Sapiens
AFFPGFPLAL

SEQ ID NO: 163673 - protein, 10 aa, Homo Sapiens
AFFTSKALNM

SEQ ID NO: 163674 - protein, 10 aa, Homo Sapiens
AFHPFIAGPY

SEQ ID NO: 163675 - protein, 10 aa, Homo Sapiens
AFIDGGGSVL

SEQ ID NO: 163676 - protein, 10 aa, Homo Sapiens
AFIDRKDSYY

SEQ ID NO: 163677 - protein, 10 aa, Homo Sapiens
AFIRVVGSEF

SEQ ID NO: 163678 - protein, 10 aa, Homo Sapiens
AFITIQVAQM

SEQ ID NO: 163679 - protein, 10 aa, Homo Sapiens
AFLDSQTATF

SEQ ID NO: 163680 - protein, 10 aa, Homo Sapiens
AFMDESTQCF

SEQ ID NO: 163681 - protein, 10 aa, Homo Sapiens
AFPGGPLGAL

SEQ ID NO: 163682 - protein, 10 aa, Homo Sapiens
AFVDKPVSPY

SEQ ID NO: 163683 - protein, 10 aa, Homo Sapiens
AFVTFSTRAM

SEQ ID NO: 163684 - protein, 10 aa, Homo Sapiens
AFVTFTTRAM

SEQ ID NO: 163685 - protein, 10 aa, Homo Sapiens
AFYDVDFLCK

SEQ ID NO: 163686 - protein, 10 aa, Homo Sapiens
AFYDWDNTEL

SEQ ID NO: 163687 - protein, 10 aa, Homo Sapiens
AFYEHAQTYY

SEQ ID NO: 163688 - protein, 10 aa, Homo Sapiens
AFYPEEISSM

SEQ ID NO: 163689 - protein, 10 aa, Homo Sapiens
AFYTFPFQQL

SEQ ID NO: 163690 - protein, 10 aa, Homo Sapiens
AFYVPFAKAL

SEQ ID NO: 163691 - protein, 10 aa, Homo Sapiens
ALPEDDFLSL

SEQ ID NO: 163692 - protein, 10 aa, Homo Sapiens
ALPHGASCPY

SEQ ID NO: 163693 - protein, 10 aa, Homo Sapiens
AWIDAEVTEF

SEQ ID NO: 163694 - protein, 10 aa, Homo Sapiens
AYATFIVTNY

SEQ ID NO: 163695 - protein, 10 aa, Homo Sapiens
AYCTFPASVL

SEQ ID NO: 163696 - protein, 10 aa, Homo Sapiens
AYFAWKATAM

SEQ ID NO: 163697 - protein, 10 aa, Homo Sapiens
AYFDLQTHVI

SEQ ID NO: 163698 - protein, 10 aa, Homo Sapiens
AYFPELIANF

SEQ ID NO: 163699 - protein, 10 aa, Homo Sapiens
AYIAVGSISF

SEQ ID NO: 163700 - protein, 10 aa, Homo Sapiens
AYIDPIAMEY

SEQ ID NO: 163701 - protein, 10 aa, Homo Sapiens
AYISQVPTQM

SEQ ID NO: 163702 - protein, 10 aa, Homo Sapiens
AYLGAKPRSL

SEQ ID NO: 163703 - protein, 10 aa, Homo Sapiens
AYLPKNTHPF

SEQ ID NO: 163704 - protein, 10 aa, Homo Sapiens
AYMDAPKAAL

SEQ ID NO: 163705 - protein, 10 aa, Homo Sapiens
AYMELVNNML

SEQ ID NO: 163706 - protein, 10 aa, Homo Sapiens
AYPDFAPQKF

SEQ ID NO: 163707 - protein, 10 aa, Homo Sapiens
AYRDWFSSQL

SEQ ID NO: 163708 - protein, 10 aa, Homo Sapiens
AYYCHPPTSW

SEQ ID NO: 163709 - protein, 10 aa, Homo Sapiens
AYYDPKTRAM

SEQ ID NO: 163710 - protein, 10 aa, Homo Sapiens
AYYEFKKQFF

SEQ ID NO: 163711 - protein, 10 aa, Homo Sapiens
AYYEFREEAY

SEQ ID NO: 163712 - protein, 10 aa, Homo Sapiens
AYYESEINSL

SEQ ID NO: 163713 - protein, 10 aa, Homo Sapiens
AYYGYPYNAL

SEQ ID NO: 163714 - protein, 10 aa, Homo Sapiens
AYYLGKILEM

SEQ ID NO: 163715 - protein, 10 aa, Homo Sapiens
AYYPSDVSSL

SEQ ID NO: 163716 - protein, 10 aa, Homo Sapiens
EYYDKHFTEF

SEQ ID NO: 163717 - protein, 10 aa, Homo Sapiens
FFFDSAMESY

SEQ ID NO: 163718 - protein, 10 aa, Homo Sapiens
FFFPFDTRQM

SEQ ID NO: 163719 - protein, 10 aa, Homo Sapiens
FFFPTQGHDY

SEQ ID NO: 163720 - protein, 10 aa, Homo Sapiens
FFFTARTSFF

SEQ ID NO: 163721 - protein, 10 aa, Homo Sapiens
FFFTGPLSHF

SEQ ID NO: 163722 - protein, 10 aa, Homo Sapiens
FFHQENVRAL

SEQ ID NO: 163723 - protein, 10 aa, Homo Sapiens
FFILPCTDSF

SEQ ID NO: 163724 - protein, 10 aa, Homo Sapiens
FFLQVKEGIL

SEQ ID NO: 163725 - protein, 10 aa, Homo Sapiens
FFPDGHVMML

SEQ ID NO: 163726 - protein, 10 aa, Homo Sapiens
FFPDKPITQY

SEQ ID NO: 163727 - protein, 10 aa, Homo Sapiens
FFPEAAQVAY

SEQ ID NO: 163728 - protein, 10 aa, Homo Sapiens
FFPEIDLEKY

SEQ ID NO: 163729 - protein, 10 aa, Homo Sapiens
FFPEYTHQLF

SEQ ID NO: 163730 - protein, 10 aa, Homo Sapiens
FFPGISVKSV

SEQ ID NO: 163731 - protein, 10 aa, Homo Sapiens
FFPHVPHPSM

SEQ ID NO: 163732 - protein, 10 aa, Homo Sapiens
FFPQYPDKEL

SEQ ID NO: 163733 - protein, 10 aa, Homo Sapiens
FFPSSCVREL

SEQ ID NO: 163734 - protein, 10 aa, Homo Sapiens
FFPYYVYNII

SEQ ID NO: 163735 - protein, 10 aa, Homo Sapiens
FFQDKELRSM

SEQ ID NO: 163736 - protein, 10 aa, Homo Sapiens
FFQETKTGEL

SEQ ID NO: 163737 - protein, 10 aa, Homo Sapiens
FFQGGIPRAL

SEQ ID NO: 163738 - protein, 10 aa, Homo Sapiens
FFYDGIKAIF

SEQ ID NO: 163739 - protein, 10 aa, Homo Sapiens
FFYDGIKAIL

SEQ ID NO: 163740 - protein, 10 aa, Homo Sapiens
FFYDQAFAIY

SEQ ID NO: 163741 - protein, 10 aa, Homo Sapiens
FFYEGSRVLF

SEQ ID NO: 163742 - protein, 10 aa, Homo Sapiens
FFYHPETQQY

SEQ ID NO: 163743 - protein, 10 aa, Homo Sapiens
FFYNEHTNDF

SEQ ID NO: 163744 - protein, 10 aa, Homo Sapiens
FFYNLIHPEY

SEQ ID NO: 163745 - protein, 10 aa, Homo Sapiens
FHPEAHAITL

SEQ ID NO: 163746 - protein, 10 aa, Homo Sapiens
FLPARFYQAL

SEQ ID NO: 163747 - protein, 10 aa, Homo Sapiens
FLPEEAWCDL

SEQ ID NO: 163748 - protein, 10 aa, Homo Sapiens
FLPEFPSCSL

SEQ ID NO: 163749 - protein, 10 aa, Homo Sapiens
FLPPGSILCM

SEQ ID NO: 163750 - protein, 10 aa, Homo Sapiens
FLPTYPPSAY

SEQ ID NO: 163751 - protein, 10 aa, Homo Sapiens
FSSFIYFASL

SEQ ID NO: 163752 - protein, 10 aa, Homo Sapiens
FYADFGPLNL

SEQ ID NO: 163753 - protein, 10 aa, Homo Sapiens
FYFDLNSEQM

SEQ ID NO: 163754 - protein, 10 aa, Homo Sapiens
FYFDNILNSF

SEQ ID NO: 163755 - protein, 10 aa, Homo Sapiens
FYFDRDDVAL

SEQ ID NO: 163756 - protein, 10 aa, Homo Sapiens
FYFVDDRLVM

SEQ ID NO: 163757 - protein, 10 aa, Homo Sapiens
FYFWPRTVPM

SEQ ID NO: 163758 - protein, 10 aa, Homo Sapiens
FYHLGVRESF

SEQ ID NO: 163759 - protein, 10 aa, Homo Sapiens
FYIIVPPLTL

SEQ ID NO: 163760 - protein, 10 aa, Homo Sapiens
FYIPYRPKDF

SEQ ID NO: 163761 - protein, 10 aa, Homo Sapiens
FYLPIAAAMY

SEQ ID NO: 163762 - protein, 10 aa, Homo Sapiens
FYPECEIRTM

SEQ ID NO: 163763 - protein, 10 aa, Homo Sapiens
FYPEDEILHF

SEQ ID NO: 163764 - protein, 10 aa, Homo Sapiens
FYPEDVAEEL

SEQ ID NO: 163765 - protein, 10 aa, Homo Sapiens
FYPEELDQLL

SEQ ID NO: 163766 - protein, 10 aa, Homo Sapiens
FYPGASPTEF

SEQ ID NO: 163767 - protein, 10 aa, Homo Sapiens
FYPGWKVLVF

SEQ ID NO: 163768 - protein, 10 aa, Homo Sapiens
FYPIYFRPLM

SEQ ID NO: 163769 - protein, 10 aa, Homo Sapiens
FYPKANIVAY

SEQ ID NO: 163770 - protein, 10 aa, Homo Sapiens
FYPPAHQLSL

SEQ ID NO: 163771 - protein, 10 aa, Homo Sapiens
FYQDTFGQQW

SEQ ID NO: 163772 - protein, 10 aa, Homo Sapiens
FYQDTYGQQW

SEQ ID NO: 163773 - protein, 10 aa, Homo Sapiens
FYSGSPTSYF

SEQ ID NO: 163774 - protein, 10 aa, Homo Sapiens
FYTPQNPSSL

SEQ ID NO: 163775 - protein, 10 aa, Homo Sapiens
FYVPEIVDEL

SEQ ID NO: 163776 - protein, 10 aa, Homo Sapiens
FYYDGKVMKL

SEQ ID NO: 163777 - protein, 10 aa, Homo Sapiens
FYYFPDSGFF

SEQ ID NO: 163778 - protein, 10 aa, Homo Sapiens
GFFNGLRTEL

SEQ ID NO: 163779 - protein, 10 aa, Homo Sapiens
GFMTGTISSM

SEQ ID NO: 163780 - protein, 10 aa, Homo Sapiens
GGYDGYRPSF

SEQ ID NO: 163781 - protein, 10 aa, Homo Sapiens
GLFQHICTAY

SEQ ID NO: 163782 - protein, 10 aa, Homo Sapiens
GPPPPPGKPQ

SEQ ID NO: 163783 - protein, 10 aa, Homo Sapiens
GYMSPHPSPL

SEQ ID NO: 163784 - protein, 10 aa, Homo Sapiens
HFFEFLTKEL

SEQ ID NO: 163785 - protein, 10 aa, Homo Sapiens
HFGGGGFLAF

SEQ ID NO: 163786 - protein, 10 aa, Homo Sapiens
HFGGGKTTGF

SEQ ID NO: 163787 - protein, 10 aa, Homo Sapiens
HFPATPLLDY

SEQ ID NO: 163788 - protein, 10 aa, Homo Sapiens
HFPSNLVTEM

SEQ ID NO: 163789 - protein, 10 aa, Homo Sapiens
HFYDFERDAY

SEQ ID NO: 163790 - protein, 10 aa, Homo Sapiens
HYPQFSGQSF

SEQ ID NO: 163791 - protein, 10 aa, Homo Sapiens
HYQDVSCLQF

SEQ ID NO: 163792 - protein, 10 aa, Homo Sapiens
HYYRGNYMTF

SEQ ID NO: 163793 - protein, 10 aa, Homo Sapiens
IFIDRDPAAF

SEQ ID NO: 163794 - protein, 10 aa, Homo Sapiens
IFIDRDPTVF

SEQ ID NO: 163795 - protein, 10 aa, Homo Sapiens
IFLDSKGLEY

SEQ ID NO: 163796 - protein, 10 aa, Homo Sapiens
IFMEKSTRDF

SEQ ID NO: 163797 - protein, 10 aa, Homo Sapiens
IFQELVEGVF

SEQ ID NO: 163798 - protein, 10 aa, Homo Sapiens
IFYEHLTRSL

SEQ ID NO: 163799 - protein, 10 aa, Homo Sapiens
IFYHPETTQL

SEQ ID NO: 163800 - protein, 10 aa, Homo Sapiens
IMPEEEYSEF

SEQ ID NO: 163801 - protein, 10 aa, Homo Sapiens
IWPNARISVM

SEQ ID NO: 163802 - protein, 10 aa, Homo Sapiens
IYFDHDLQSY

SEQ ID NO: 163803 - protein, 10 aa, Homo Sapiens
IYHNPTANSF

SEQ ID NO: 163804 - protein, 10 aa, Homo Sapiens
IYLNWSPEAY

SEQ ID NO: 163805 - protein, 10 aa, Homo Sapiens
IYLPGRPTSM

SEQ ID NO: 163806 - protein, 10 aa, Homo Sapiens
IYMDTLNIFM

SEQ ID NO: 163807 - protein, 10 aa, Homo Sapiens
IYMEPEKQVM

SEQ ID NO: 163808 - protein, 10 aa, Homo Sapiens
IYPGYHQSSY

SEQ ID NO: 163809 - protein, 10 aa, Homo Sapiens
IYPTAPPRSY

SEQ ID NO: 163810 - protein, 10 aa, Homo Sapiens
IYQEGWRTVF

SEQ ID NO: 163811 - protein, 10 aa, Homo Sapiens
IYQEIRNTDM

SEQ ID NO: 163812 - protein, 10 aa, Homo Sapiens
IYQELLGLAF

SEQ ID NO: 163813 - protein, 10 aa, Homo Sapiens
IYTDYRPTPL

SEQ ID NO: 163814 - protein, 10 aa, Homo Sapiens
IYVVQGIYGY

SEQ ID NO: 163815 - protein, 10 aa, Homo Sapiens
IYYTGKYQSL

SEQ ID NO: 163816 - protein, 10 aa, Homo Sapiens
KFISGILAAL

SEQ ID NO: 163817 - protein, 10 aa, Homo Sapiens
KFMTHVASQF

SEQ ID NO: 163818 - protein, 10 aa, Homo Sapiens
KLPEYNPRTL

SEQ ID NO: 163819 - protein, 10 aa, Homo Sapiens
KYFDKRRDYL

SEQ ID NO: 163820 - protein, 10 aa, Homo Sapiens
KYIESPVLFL

SEQ ID NO: 163821 - protein, 10 aa, Homo Sapiens
KYYDEIINAL

SEQ ID NO: 163822 - protein, 10 aa, Homo Sapiens
KYYDKLFKEY

SEQ ID NO: 163823 - protein, 10 aa, Homo Sapiens
KYYDKNAIAI

SEQ ID NO: 163824 - protein, 10 aa, Homo Sapiens
LFPEGPARAF

SEQ ID NO: 163825 - protein, 10 aa, Homo Sapiens
LFPELPKSAL

SEQ ID NO: 163826 - protein, 10 aa, Homo Sapiens
LFPEPEHSSF

SEQ ID NO: 163827 - protein, 10 aa, Homo Sapiens
LFPESERPEM

SEQ ID NO: 163828 - protein, 10 aa, Homo Sapiens
LFPEYKNNKL

SEQ ID NO: 163829 - protein, 10 aa, Homo Sapiens
LFPIHVQTSL

SEQ ID NO: 163830 - protein, 10 aa, Homo Sapiens
LFPPDQFECL

SEQ ID NO: 163831 - protein, 10 aa, Homo Sapiens
LFYTGKQSYY

SEQ ID NO: 163832 - protein, 10 aa, Homo Sapiens
LLPEFPRGPL

SEQ ID NO: 163833 - protein, 10 aa, Homo Sapiens
LLPQHQVPAY

SEQ ID NO: 163834 - protein, 10 aa, Homo Sapiens
LWPDSVPSAL

SEQ ID NO: 163835 - protein, 10 aa, Homo Sapiens
LYINHTPPPL

SEQ ID NO: 163836 - protein, 10 aa, Homo Sapiens
LYPDLLPTDY

SEQ ID NO: 163837 - protein, 10 aa, Homo Sapiens
LYPENIVPSF

SEQ ID NO: 163838 - protein, 10 aa, Homo Sapiens
LYPEVPPEEF

SEQ ID NO: 163839 - protein, 10 aa, Homo Sapiens
LYPHEPTAVF

SEQ ID NO: 163840 - protein, 10 aa, Homo Sapiens
LYYEVEILSH

SEQ ID NO: 163841 - protein, 10 aa, Homo Sapiens
LYYPQQAIVF

SEQ ID NO: 163842 - protein, 10 aa, Homo Sapiens
MFPEHAVKAY

SEQ ID NO: 163843 - protein, 10 aa, Homo Sapiens
MFQTAVGHSF

SEQ ID NO: 163844 - protein, 10 aa, Homo Sapiens
MMPPMGGPPM

SEQ ID NO: 163845 - protein, 10 aa, Homo Sapiens
MWFDKTPLSY

SEQ ID NO: 163846 - protein, 10 aa, Homo Sapiens
MYFDWGPGEM

SEQ ID NO: 163847 - protein, 10 aa, Homo Sapiens
MYKYPSDISY

SEQ ID NO: 163848 - protein, 10 aa, Homo Sapiens
MYMDRRCVYY

SEQ ID NO: 163849 - protein, 10 aa, Homo Sapiens
MYYYNGKAVY

SEQ ID NO: 163850 - protein, 10 aa, Homo Sapiens
NFISLGPSIS

SEQ ID NO: 163851 - protein, 10 aa, Homo Sapiens
NFPEHIFPAL

SEQ ID NO: 163852 - protein, 10 aa, Homo Sapiens
NFPEYELPEL

SEQ ID NO: 163853 - protein, 10 aa, Homo Sapiens
NFYDKKTAIH

SEQ ID NO: 163854 - protein, 10 aa, Homo Sapiens
NFYDRYRGDY

SEQ ID NO: 163855 - protein, 10 aa, Homo Sapiens
NFYEGHITSL

SEQ ID NO: 163856 - protein, 10 aa, Homo Sapiens
NFYGDLRKAL

SEQ ID NO: 163857 - protein, 10 aa, Homo Sapiens
NFYTVAVTSL

SEQ ID NO: 163858 - protein, 10 aa, Homo Sapiens
NGMIGLVTSL

SEQ ID NO: 163859 - protein, 10 aa, Homo Sapiens
NYIDLPVLAI

SEQ ID NO: 163860 - protein, 10 aa, Homo Sapiens
NYIDRFLSSM

SEQ ID NO: 163861 - protein, 10 aa, Homo Sapiens
NYYDLVRTEI

SEQ ID NO: 163862 - protein, 10 aa, Homo Sapiens
NYYNKVSTVF

SEQ ID NO: 163863 - protein, 10 aa, Homo Sapiens
NYYNLQGISH

SEQ ID NO: 163864 - protein, 10 aa, Homo Sapiens
NYYPYTITEY

SEQ ID NO: 163865 - protein, 10 aa, Homo Sapiens
QFPGFPAAAY

SEQ ID NO: 163866 - protein, 10 aa, Homo Sapiens
QFYDNKGITY

SEQ ID NO: 163867 - protein, 10 aa, Homo Sapiens
QFYGLTPLVR

SEQ ID NO: 163868 - protein, 10 aa, Homo Sapiens
QYFDSRGMFI

SEQ ID NO: 163869 - protein, 10 aa, Homo Sapiens
QYLTFKPQTF

SEQ ID NO: 163870 - protein, 10 aa, Homo Sapiens
QYYIFIPSKF

SEQ ID NO: 163871 - protein, 10 aa, Homo Sapiens
QYYNGKIHAY

SEQ ID NO: 163872 - protein, 10 aa, Homo Sapiens
QYYSGELVSY

SEQ ID NO: 163873 - protein, 10 aa, Homo Sapiens
RFFDTNTSVL

SEQ ID NO: 163874 - protein, 10 aa, Homo Sapiens
RFIDDVVSAV

SEQ ID NO: 163875 - protein, 10 aa, Homo Sapiens
RFIDISPAEM

SEQ ID NO: 163876 - protein, 10 aa, Homo Sapiens
RFPDQPFIAL

SEQ ID NO: 163877 - protein, 10 aa, Homo Sapiens
RFPEELTQTF

SEQ ID NO: 163878 - protein, 10 aa, Homo Sapiens
RFPEEPHVPL

SEQ ID NO: 163879 - protein, 10 aa, Homo Sapiens
RFPEHRAAEI

SEQ ID NO: 163880 - protein, 10 aa, Homo Sapiens
RFPNFTNQLL

SEQ ID NO: 163881 - protein, 10 aa, Homo Sapiens
RFQEADSPTL

SEQ ID NO: 163882 - protein, 10 aa, Homo Sapiens
RFQSSAVMAL

SEQ ID NO: 163883 - protein, 10 aa, Homo Sapiens
RFVEVGRVAY

SEQ ID NO: 163884 - protein, 10 aa, Homo Sapiens
RLMVHTVATF

SEQ ID NO: 163885 - protein, 10 aa, Homo Sapiens
RSNFGYNIPL

SEQ ID NO: 163886 - protein, 10 aa, Homo Sapiens
RTPDAFISSF

SEQ ID NO: 163887 - protein, 10 aa, Homo Sapiens
RWPDLHKNEL

SEQ ID NO: 163888 - protein, 10 aa, Homo Sapiens
RYIEKLTNEM

SEQ ID NO: 163889 - protein, 10 aa, Homo Sapiens
RYIMGSGESF

SEQ ID NO: 163890 - protein, 10 aa, Homo Sapiens
RYMELYTHVY

SEQ ID NO: 163891 - protein, 10 aa, Homo Sapiens
RYPDIQASYL

SEQ ID NO: 163892 - protein, 10 aa, Homo Sapiens
RYPDTIALTF

SEQ ID NO: 163893 - protein, 10 aa, Homo Sapiens
RYPEEDYESF

SEQ ID NO: 163894 - protein, 10 aa, Homo Sapiens
RYPGYMNNDL

SEQ ID NO: 163895 - protein, 10 aa, Homo Sapiens
RYYDVPIATL

SEQ ID NO: 163896 - protein, 10 aa, Homo Sapiens
SAPGPGYAPL

SEQ ID NO: 163897 - protein, 10 aa, Homo Sapiens
SAQGSESHSL

SEQ ID NO: 163898 - protein, 10 aa, Homo Sapiens
SFFDNISSEL

SEQ ID NO: 163899 - protein, 10 aa, Homo Sapiens
SFFNLTVKEM

SEQ ID NO: 163900 - protein, 10 aa, Homo Sapiens
SFIAAPVTCF

SEQ ID NO: 163901 - protein, 10 aa, Homo Sapiens
SFMQHDVQEL

SEQ ID NO: 163902 - protein, 10 aa, Homo Sapiens
SFPASSGVSH

SEQ ID NO: 163903 - protein, 10 aa, Homo Sapiens
SFPDCHVGSF

SEQ ID NO: 163904 - protein, 10 aa, Homo Sapiens
SFPDDATSPL

SEQ ID NO: 163905 - protein, 10 aa, Homo Sapiens
SFPEHRVLSF

SEQ ID NO: 163906 - protein, 10 aa, Homo Sapiens
SFPGFHGSEM

SEQ ID NO: 163907 - protein, 10 aa, Homo Sapiens
SFPHYGFPTY

SEQ ID NO: 163908 - protein, 10 aa, Homo Sapiens
SFPKYKPSSL

SEQ ID NO: 163909 - protein, 10 aa, Homo Sapiens
SFQDQKIASM

SEQ ID NO: 163910 - protein, 10 aa, Homo Sapiens
SFVDKTVLPF

SEQ ID NO: 163911 - protein, 10 aa, Homo Sapiens
SFYDGYRHEM

SEQ ID NO: 163912 - protein, 10 aa, Homo Sapiens
SFYDSQGIHF

SEQ ID NO: 163913 - protein, 10 aa, Homo Sapiens
SFYEKGPLTF

SEQ ID NO: 163914 - protein, 10 aa, Homo Sapiens
SFYIPPPATH

SEQ ID NO: 163915 - protein, 10 aa, Homo Sapiens
SFYLFHPLAY

SEQ ID NO: 163916 - protein, 10 aa, Homo Sapiens
SFYNKRTLTF

SEQ ID NO: 163917 - protein, 10 aa, Homo Sapiens
SFYNLLTRTF

SEQ ID NO: 163918 - protein, 10 aa, Homo Sapiens
SFYPEEVSSM

SEQ ID NO: 163919 - protein, 10 aa, Homo Sapiens
SFYTAIAQAF

SEQ ID NO: 163920 - protein, 10 aa, Homo Sapiens
SFYVPSGNYY

SEQ ID NO: 163921 - protein, 10 aa, Homo Sapiens
SMIDPPRAAV

SEQ ID NO: 163922 - protein, 10 aa, Homo Sapiens
SMPTIPALAL

SEQ ID NO: 163923 - protein, 10 aa, Homo Sapiens
SWPTYPQLYV

SEQ ID NO: 163924 - protein, 10 aa, Homo Sapiens
SYADGYSPPL

SEQ ID NO: 163925 - protein, 10 aa, Homo Sapiens
SYCPGMGVAL

SEQ ID NO: 163926 - protein, 10 aa, Homo Sapiens
SYFDAIPVTM

SEQ ID NO: 163927 - protein, 10 aa, Homo Sapiens
SYFDKMSNEM

SEQ ID NO: 163928 - protein, 10 aa, Homo Sapiens
SYFDRYRDSF

SEQ ID NO: 163929 - protein, 10 aa, Homo Sapiens
SYFEGKQVSV

SEQ ID NO: 163930 - protein, 10 aa, Homo Sapiens
SYFEIPTKEF

SEQ ID NO: 163931 - protein, 10 aa, Homo Sapiens
SYFEKETLTF

SEQ ID NO: 163932 - protein, 10 aa, Homo Sapiens
SYFEKGPLTF

SEQ ID NO: 163933 - protein, 10 aa, Homo Sapiens
SYIDRLISVF

SEQ ID NO: 163934 - protein, 10 aa, Homo Sapiens
SYIFPSSISA

SEQ ID NO: 163935 - protein, 10 aa, Homo Sapiens
SYIPYNPQQF

SEQ ID NO: 163936 - protein, 10 aa, Homo Sapiens
SYLFHQHQLY

SEQ ID NO: 163937 - protein, 10 aa, Homo Sapiens
SYMPARVVVF

SEQ ID NO: 163938 - protein, 10 aa, Homo Sapiens
SYMVGMIASF

SEQ ID NO: 163939 - protein, 10 aa, Homo Sapiens
SYPAAVPQAL

SEQ ID NO: 163940 - protein, 10 aa, Homo Sapiens
SYPDWGSNYY

SEQ ID NO: 163941 - protein, 10 aa, Homo Sapiens
SYQIPTENSM

SEQ ID NO: 163942 - protein, 10 aa, Homo Sapiens
SYSFDYPSDM

SEQ ID NO: 163943 - protein, 10 aa, Homo Sapiens
SYVNLPTIAL

SEQ ID NO: 163944 - protein, 10 aa, Homo Sapiens
SYYGNRAATL

SEQ ID NO: 163945 - protein, 10 aa, Homo Sapiens
SYYGRDRSPL

SEQ ID NO: 163946 - protein, 10 aa, Homo Sapiens
SYYTVRQLEL

SEQ ID NO: 163947 - protein, 10 aa, Homo Sapiens
TFPLEAITAF

SEQ ID NO: 163948 - protein, 10 aa, Homo Sapiens
TMPDTPRLFA

SEQ ID NO: 163949 - protein, 10 aa, Homo Sapiens
TMPGLPTRPC

SEQ ID NO: 163950 - protein, 10 aa, Homo Sapiens
TYFFKRTQYF

SEQ ID NO: 163951 - protein, 10 aa, Homo Sapiens
TYFQDERHPY

SEQ ID NO: 163952 - protein, 10 aa, Homo Sapiens
TYIGYLPLAH

SEQ ID NO: 163953 - protein, 10 aa, Homo Sapiens
TYITYFVRAM

SEQ ID NO: 163954 - protein, 10 aa, Homo Sapiens
TYLETKGAAL

SEQ ID NO: 163955 - protein, 10 aa, Homo Sapiens
TYMEYETLTL

SEQ ID NO: 163956 - protein, 10 aa, Homo Sapiens
TYPDWIGQSY

SEQ ID NO: 163957 - protein, 10 aa, Homo Sapiens
TYPEFLANAL

SEQ ID NO: 163958 - protein, 10 aa, Homo Sapiens
TYPYNPPICF

SEQ ID NO: 163959 - protein, 10 aa, Homo Sapiens
TYVGGHVEAL

SEQ ID NO: 163960 - protein, 10 aa, Homo Sapiens
TYYDLVKAFM

SEQ ID NO: 163961 - protein, 10 aa, Homo Sapiens
VFAEGKPLAL

SEQ ID NO: 163962 - protein, 10 aa, Homo Sapiens
VFFEVSPVSF

SEQ ID NO: 163963 - protein, 10 aa, Homo Sapiens
VFFGCTFVAF

SEQ ID NO: 163964 - protein, 10 aa, Homo Sapiens
VFIDTEGSFM

SEQ ID NO: 163965 - protein, 10 aa, Homo Sapiens
VFIGANPLAV

SEQ ID NO: 163966 - protein, 10 aa, Homo Sapiens
VFINVPTVSF

SEQ ID NO: 163967 - protein, 10 aa, Homo Sapiens
VFITDKISSF

SEQ ID NO: 163968 - protein, 10 aa, Homo Sapiens
VFLDYEAGVL

SEQ ID NO: 163969 - protein, 10 aa, Homo Sapiens
VFMFPVGLYY

SEQ ID NO: 163970 - protein, 10 aa, Homo Sapiens
VFMPHVTEAY

SEQ ID NO: 163971 - protein, 10 aa, Homo Sapiens
VFMPQHIMAI

SEQ ID NO: 163972 - protein, 10 aa, Homo Sapiens
VFPEVGASVW

SEQ ID NO: 163973 - protein, 10 aa, Homo Sapiens
VFPMEKLSSF

SEQ ID NO: 163974 - protein, 10 aa, Homo Sapiens
VFPPLTQRTY

SEQ ID NO: 163975 - protein, 10 aa, Homo Sapiens
VFQKPSGVSA

SEQ ID NO: 163976 - protein, 10 aa, Homo Sapiens
VFRTDLITAM

SEQ ID NO: 163977 - protein, 10 aa, Homo Sapiens
VFYPGETVVH

SEQ ID NO: 163978 - protein, 10 aa, Homo Sapiens
VLPHQPLATY

SEQ ID NO: 163979 - protein, 10 aa, Homo Sapiens
VLPSERYKEL

SEQ ID NO: 163980 - protein, 10 aa, Homo Sapiens
VYFAERVTSL

SEQ ID NO: 163981 - protein, 10 aa, Homo Sapiens
VYFHTLTSEY

SEQ ID NO: 163982 - protein, 10 aa, Homo Sapiens
VYHNVKPAAL

SEQ ID NO: 163983 - protein, 10 aa, Homo Sapiens
VYIGYLPLAH

SEQ ID NO: 163984 - protein, 10 aa, Homo Sapiens
VYIVLDKAEY

SEQ ID NO: 163985 - protein, 10 aa, Homo Sapiens
VYKNPSEYHY

SEQ ID NO: 163986 - protein, 10 aa, Homo Sapiens
VYLHYLPSYY

SEQ ID NO: 163987 - protein, 10 aa, Homo Sapiens
VYMEEVPLAL

SEQ ID NO: 163988 - protein, 10 aa, Homo Sapiens
VYMTEPIDEY

SEQ ID NO: 163989 - protein, 10 aa, Homo Sapiens
VYPNFRPTPK

SEQ ID NO: 163990 - protein, 10 aa, Homo Sapiens
VYQFCFSNEF

SEQ ID NO: 163991 - protein, 10 aa, Homo Sapiens
VYYGHTNYIY

SEQ ID NO: 163992 - protein, 10 aa, Homo Sapiens
VYYIFERLCA

SEQ ID NO: 163993 - protein, 10 aa, Homo Sapiens
VYYKDDTHYF

SEQ ID NO: 163994 - protein, 10 aa, Homo Sapiens
VYYTNRALCY

SEQ ID NO: 163995 - protein, 10 aa, Homo Sapiens
VYYVGVASCL

SEQ ID NO: 163996 - protein, 10 aa, Homo Sapiens
WYPLLKNISM

SEQ ID NO: 163997 - protein, 10 aa, Homo Sapiens
YFADRLYDSM

SEQ ID NO: 163998 - protein, 10 aa, Homo Sapiens
YFFDNDSKSF

SEQ ID NO: 163999 - protein, 10 aa, Homo Sapiens
YFFDRSSQAF

SEQ ID NO: 164000 - protein, 10 aa, Homo Sapiens
YFFPDDPPTF

SEQ ID NO: 164001 - protein, 10 aa, Homo Sapiens
YFHDGVRVAA

SEQ ID NO: 164002 - protein, 10 aa, Homo Sapiens
YFHDNVRVAA

SEQ ID NO: 164003 - protein, 10 aa, Homo Sapiens
YFHDRVASFY

SEQ ID NO: 164004 - protein, 10 aa, Homo Sapiens
YFIAPSGHGL

SEQ ID NO: 164005 - protein, 10 aa, Homo Sapiens
YFIAPTGHSL

SEQ ID NO: 164006 - protein, 10 aa, Homo Sapiens
YFIDTDLNQL

SEQ ID NO: 164007 - protein, 10 aa, Homo Sapiens
YFINGDISSL

SEQ ID NO: 164008 - protein, 10 aa, Homo Sapiens
YFIPATGHSL

SEQ ID NO: 164009 - protein, 10 aa, Homo Sapiens
YFIPFLPLEY

SEQ ID NO: 164010 - protein, 10 aa, Homo Sapiens
YFIPTPPSSY

SEQ ID NO: 164011 - protein, 10 aa, Homo Sapiens
YFISHVLAFF

SEQ ID NO: 164012 - protein, 10 aa, Homo Sapiens
YFISPTGHSL

SEQ ID NO: 164013 - protein, 10 aa, Homo Sapiens
YFITPTGHSL

SEQ ID NO: 164014 - protein, 10 aa, Homo Sapiens
YFLPEAPAEL

SEQ ID NO: 164015 - protein, 10 aa, Homo Sapiens
YFLSHIPITL

SEQ ID NO: 164016 - protein, 10 aa, Homo Sapiens
YFNDIAVGAV

SEQ ID NO: 164017 - protein, 10 aa, Homo Sapiens
YFPDCIVRPF

SEQ ID NO: 164018 - protein, 10 aa, Homo Sapiens
YFPDRENQQF

SEQ ID NO: 164019 - protein, 10 aa, Homo Sapiens
YFPDYSIGNL

SEQ ID NO: 164020 - protein, 10 aa, Homo Sapiens
YFPEEKFESL

SEQ ID NO: 164021 - protein, 10 aa, Homo Sapiens
YFPGYFPNEL

SEQ ID NO: 164022 - protein, 10 aa, Homo Sapiens
YFYDDVTTLY

SEQ ID NO: 164023 - protein, 10 aa, Homo Sapiens
YFYDGVSRDA

SEQ ID NO: 164024 - protein, 10 aa, Homo Sapiens
YFYDPDVGNF

SEQ ID NO: 164025 - protein, 10 aa, Homo Sapiens
YFYDRRRIYL

SEQ ID NO: 164026 - protein, 10 aa, Homo Sapiens
YFYDSTRNVY

SEQ ID NO: 164027 - protein, 10 aa, Homo Sapiens
YFYPFPVPPL

SEQ ID NO: 164028 - protein, 10 aa, Homo Sapiens
YFYPYGLQTF

SEQ ID NO: 164029 - protein, 10 aa, Homo Sapiens
YLPENQVLPH

SEQ ID NO: 164030 - protein, 10 aa, Homo Sapiens
YLPNQLFRTF

SEQ ID NO: 164031 - protein, 10 aa, Homo Sapiens
YMIDPSGVSY

SEQ ID NO: 164032 - protein, 10 aa, Homo Sapiens
YWPEAKRAAL

SEQ ID NO: 164033 - protein, 10 aa, Homo Sapiens
YWPEGKRVAM

SEQ ID NO: 164034 - protein, 10 aa, Homo Sapiens
YWPHQPIENL

SEQ ID NO: 164035 - protein, 10 aa, Homo Sapiens
YWPTYTPMEV

SEQ ID NO: 164036 - protein, 10 aa, Homo Sapiens
YWPTYVPMEV

SEQ ID NO: 164037 - protein, 10 aa, Homo Sapiens
YYFDGKGKAF

SEQ ID NO: 164038 - protein, 10 aa, Homo Sapiens
YYFDRDDVAL

SEQ ID NO: 164039 - protein, 10 aa, Homo Sapiens
YYFDVSHEHL

SEQ ID NO: 164040 - protein, 10 aa, Homo Sapiens
YYFEGIKQTF

SEQ ID NO: 164041 - protein, 10 aa, Homo Sapiens
YYFNRKTFSF

SEQ ID NO: 164042 - protein, 10 aa, Homo Sapiens
YYFSTISSSF

SEQ ID NO: 164043 - protein, 10 aa, Homo Sapiens
YYIDDVFHAL

SEQ ID NO: 164044 - protein, 10 aa, Homo Sapiens
YYIDGKIQTN

SEQ ID NO: 164045 - protein, 10 aa, Homo Sapiens
YYIDTLGRIM

SEQ ID NO: 164046 - protein, 10 aa, Homo Sapiens
YYINKISSTL

SEQ ID NO: 164047 - protein, 10 aa, Homo Sapiens
YYINYTTIEL

SEQ ID NO: 164048 - protein, 10 aa, Homo Sapiens
YYIPEITSVL

SEQ ID NO: 164049 - protein, 10 aa, Homo Sapiens
YYIQNGIQSF

SEQ ID NO: 164050 - protein, 10 aa, Homo Sapiens
YYLAQIPIAM

SEQ ID NO: 164051 - protein, 10 aa, Homo Sapiens
YYLDMHSLPH

SEQ ID NO: 164052 - protein, 10 aa, Homo Sapiens
YYLQHPPISF

SEQ ID NO: 164053 - protein, 10 aa, Homo Sapiens
YYLQIHPQEL

SEQ ID NO: 164054 - protein, 10 aa, Homo Sapiens
YYPAQGVQQF

SEQ ID NO: 164055 - protein, 10 aa, Homo Sapiens
YYPDPTFPAM

SEQ ID NO: 164056 - protein, 10 aa, Homo Sapiens
YYPPSQIAQL

SEQ ID NO: 164057 - protein, 10 aa, Homo Sapiens
YYQPYEIPAV

SEQ ID NO: 164058 - protein, 10 aa, Homo Sapiens
YYQTAPKAGY

SEQ ID NO: 164059 - protein, 10 aa, Homo Sapiens
YYRYPTGESY

SEQ ID NO: 164060 - protein, 10 aa, Homo Sapiens
YYVDTAVRHV

SEQ ID NO: 164061 - protein, 10 aa, Homo Sapiens
YYVDTFVSVY

SEQ ID NO: 164062 - protein, 10 aa, Homo Sapiens
YYYDGDIGNY

SEQ ID NO: 164063 - protein, 10 aa, Homo Sapiens
YYYDGDVGNY

SEQ ID NO: 164064 - protein, 10 aa, Homo Sapiens
YYYDPLAGTY

SEQ ID NO: 164065 - protein, 10 aa, Homo Sapiens
YYYDPQTGLY

SEQ ID NO: 164066 - protein, 10 aa, Homo Sapiens
YYYDPTTGLY

SEQ ID NO: 164067 - protein, 10 aa, Homo Sapiens
YYYDTHTNTY

SEQ ID NO: 164068 - protein, 10 aa, Homo Sapiens
YYYHARVYEF

SEQ ID NO: 164069 - protein, 10 aa, Homo Sapiens
YYYNGKAVYA

SEQ ID NO: 164070 - protein, 11 aa, Homo Sapiens
ADREDDPNFFK

SEQ ID NO: 164071 - protein, 11 aa, Homo Sapiens
AFIEYEHERDM

SEQ ID NO: 164072 - protein, 11 aa, Homo Sapiens
AFPGEARISNV

SEQ ID NO: 164073 - protein, 11 aa, Homo Sapiens
AYFQSIKAIAL

SEQ ID NO: 164074 - protein, 11 aa, Homo Sapiens
AYIDPIAMEYY

SEQ ID NO: 164075 - protein, 11 aa, Homo Sapiens
AYMELQQKAEF

SEQ ID NO: 164076 - protein, 11 aa, Homo Sapiens
AYYPAQGVQQF

SEQ ID NO: 164077 - protein, 11 aa, Homo Sapiens
CTFIRVSGSEL

SEQ ID NO: 164078 - protein, 11 aa, Homo Sapiens
EHDYFEFFSND

SEQ ID NO: 164079 - protein, 11 aa, Homo Sapiens
FFHELSPGSCF

SEQ ID NO: 164080 - protein, 11 aa, Homo Sapiens
FFLPGGARSEM

SEQ ID NO: 164081 - protein, 11 aa, Homo Sapiens
FFNEDGVIRPY

SEQ ID NO: 164082 - protein, 11 aa, Homo Sapiens
FYHHEAGVTAL

SEQ ID NO: 164083 - protein, 11 aa, Homo Sapiens
FYIDPYKLLPL

SEQ ID NO: 164084 - protein, 11 aa, Homo Sapiens
FYLNPDQSGEF

SEQ ID NO: 164085 - protein, 11 aa, Homo Sapiens
FYMDTSHLFNT

SEQ ID NO: 164086 - protein, 11 aa, Homo Sapiens
FYNTAQSPSAL

SEQ ID NO: 164087 - protein, 11 aa, Homo Sapiens
FYPDEIQRPPV

SEQ ID NO: 164088 - protein, 11 aa, Homo Sapiens
FYPGSIEVRWF

SEQ ID NO: 164089 - protein, 11 aa, Homo Sapiens
FYPVVKEGRTL

SEQ ID NO: 164090 - protein, 11 aa, Homo Sapiens
FYQDTFGQQWK

SEQ ID NO: 164091 - protein, 11 aa, Homo Sapiens
FYQDTYGQQWK

SEQ ID NO: 164092 - protein, 11 aa, Homo Sapiens
FYVDSDMVNEF

SEQ ID NO: 164093 - protein, 11 aa, Homo Sapiens
FYVPAEPKLAF

SEQ ID NO: 164094 - protein, 11 aa, Homo Sapiens
FYVPGVAPINF

SEQ ID NO: 164095 - protein, 11 aa, Homo Sapiens
FYYDEFGFRVY

SEQ ID NO: 164096 - protein, 11 aa, Homo Sapiens
FYYENENVKGL

SEQ ID NO: 164097 - protein, 11 aa, Homo Sapiens
FYYNTSEQNVM

SEQ ID NO: 164098 - protein, 11 aa, Homo Sapiens
FYYPLEGSKSM

SEQ ID NO: 164099 - protein, 11 aa, Homo Sapiens
GLFQHICTAYE

SEQ ID NO: 164100 - protein, 11 aa, Homo Sapiens
HFIQAGLLSAL

SEQ ID NO: 164101 - protein, 11 aa, Homo Sapiens
HFPDPNKLHCF

SEQ ID NO: 164102 - protein, 11 aa, Homo Sapiens
HFPEFPATRAY

SEQ ID NO: 164103 - protein, 11 aa, Homo Sapiens
HYMNPYQLNAY

SEQ ID NO: 164104 - protein, 11 aa, Homo Sapiens
HYMSPYQLNAY

SEQ ID NO: 164105 - protein, 11 aa, Homo Sapiens
HYPSQPVFAPM

SEQ ID NO: 164106 - protein, 11 aa, Homo Sapiens
IECLPTSGHLS

SEQ ID NO: 164107 - protein, 11 aa, Homo Sapiens
IFFFGTHETAF

SEQ ID NO: 164108 - protein, 11 aa, Homo Sapiens
IFQELVEGVFY

SEQ ID NO: 164109 - protein, 11 aa, Homo Sapiens
IYADPTKRLEL

SEQ ID NO: 164110 - protein, 11 aa, Homo Sapiens
IYALNENVSSF

SEQ ID NO: 164111 - protein, 11 aa, Homo Sapiens
IYIDRHVMQPY

SEQ ID NO: 164112 - protein, 11 aa, Homo Sapiens
IYMDPHYCQSF

SEQ ID NO: 164113 - protein, 11 aa, Homo Sapiens
IYMERAEDLPL

SEQ ID NO: 164114 - protein, 11 aa, Homo Sapiens
IYVALLRVTPF

SEQ ID NO: 164115 - protein, 11 aa, Homo Sapiens
KFMDQHPEMDF

SEQ ID NO: 164116 - protein, 11 aa, Homo Sapiens
KYFEGVSPKSL

SEQ ID NO: 164117 - protein, 11 aa, Homo Sapiens
KYMNSLLIGEL

SEQ ID NO: 164118 - protein, 11 aa, Homo Sapiens
KYMPSVKVSVF

SEQ ID NO: 164119 - protein, 11 aa, Homo Sapiens
KYPKGAGRVAF

SEQ ID NO: 164120 - protein, 11 aa, Homo Sapiens
LFPEADKVRTM

SEQ ID NO: 164121 - protein, 11 aa, Homo Sapiens
LFQENSVLSSL

SEQ ID NO: 164122 - protein, 11 aa, Homo Sapiens
LYFGSAFATPF

SEQ ID NO: 164123 - protein, 11 aa, Homo Sapiens
LYILTGHQSTY

SEQ ID NO: 164124 - protein, 11 aa, Homo Sapiens
LYYDTDPFLFY

SEQ ID NO: 164125 - protein, 11 aa, Homo Sapiens
MAPSETQFSHL

SEQ ID NO: 164126 - protein, 11 aa, Homo Sapiens
NYPDYMPSNIF

SEQ ID NO: 164127 - protein, 11 aa, Homo Sapiens
PRIASNAGSIA

SEQ ID NO: 164128 - protein, 11 aa, Homo Sapiens
QYWDPLLGTCM

SEQ ID NO: 164129 - protein, 11 aa, Homo Sapiens
RFYDPTAGVVM

SEQ ID NO: 164130 - protein, 11 aa, Homo Sapiens
RYHGLSSLCNL

SEQ ID NO: 164131 - protein, 11 aa, Homo Sapiens
RYINPAKLTPY

SEQ ID NO: 164132 - protein, 11 aa, Homo Sapiens
RYMLTAGLTAF

SEQ ID NO: 164133 - protein, 11 aa, Homo Sapiens
RYPEYDGRGVL

SEQ ID NO: 164134 - protein, 11 aa, Homo Sapiens
SFFDATDRVSF

SEQ ID NO: 164135 - protein, 11 aa, Homo Sapiens
SFPTTKTYFPH

SEQ ID NO: 164136 - protein, 11 aa, Homo Sapiens
SFYSGLTPTEF

SEQ ID NO: 164137 - protein, 11 aa, Homo Sapiens
SFYSLTSSNIS

SEQ ID NO: 164138 - protein, 11 aa, Homo Sapiens
SYIFPSSISAM

SEQ ID NO: 164139 - protein, 11 aa, Homo Sapiens
SYQDPAQLSCL

SEQ ID NO: 164140 - protein, 11 aa, Homo Sapiens
SYYGPLNLLTF

SEQ ID NO: 164141 - protein, 11 aa, Homo Sapiens
SYYPAENLIEY

SEQ ID NO: 164142 - protein, 11 aa, Homo Sapiens
SYYPTSSSTSF

SEQ ID NO: 164143 - protein, 11 aa, Homo Sapiens
SYYSPSIGFSY

SEQ ID NO: 164144 - protein, 11 aa, Homo Sapiens
TFPAYPGSSSM

SEQ ID NO: 164145 - protein, 11 aa, Homo Sapiens
TYMPSVSLQSL

SEQ ID NO: 164146 - protein, 11 aa, Homo Sapiens
TYYGSFVTRAL

SEQ ID NO: 164147 - protein, 11 aa, Homo Sapiens
VFMDSNGIRQF

SEQ ID NO: 164148 - protein, 11 aa, Homo Sapiens
VFMPPSSSSEL

SEQ ID NO: 164149 - protein, 11 aa, Homo Sapiens
VFQEPSLLSSL

SEQ ID NO: 164150 - protein, 11 aa, Homo Sapiens
VWPRRPTGEVY

SEQ ID NO: 164151 - protein, 11 aa, Homo Sapiens
VYFENSSSNPY

SEQ ID NO: 164152 - protein, 11 aa, Homo Sapiens
VYFGTSHPRYY

SEQ ID NO: 164153 - protein, 11 aa, Homo Sapiens
VYFKGKWKTPF

SEQ ID NO: 164154 - protein, 11 aa, Homo Sapiens
VYHEPSSIGSM

SEQ ID NO: 164155 - protein, 11 aa, Homo Sapiens
VYNTVSEGTHF

SEQ ID NO: 164156 - protein, 11 aa, Homo Sapiens
VYQETRERLAM

SEQ ID NO: 164157 - protein, 11 aa, Homo Sapiens
VYQSLCPTSWV

SEQ ID NO: 164158 - protein, 11 aa, Homo Sapiens
VYVDLGGSHVF

SEQ ID NO: 164159 - protein, 11 aa, Homo Sapiens
WYFEGLYPTYY

SEQ ID NO: 164160 - protein, 11 aa, Homo Sapiens
YFLERGLESAT

SEQ ID NO: 164161 - protein, 11 aa, Homo Sapiens
YFYDPDVGNFH

SEQ ID NO: 164162 - protein, 11 aa, Homo Sapiens
YFYDVEALRDY

SEQ ID NO: 164163 - protein, 11 aa, Homo Sapiens
YFYPFPVPPLL

SEQ ID NO: 164164 - protein, 11 aa, Homo Sapiens
YLPEAGQYSSF

SEQ ID NO: 164165 - protein, 11 aa, Homo Sapiens
YYALCGFGGVL

SEQ ID NO: 164166 - protein, 11 aa, Homo Sapiens
YYDGDIGNYYY

SEQ ID NO: 164167 - protein, 11 aa, Homo Sapiens
YYDGDVGNYYY

SEQ ID NO: 164168 - protein, 11 aa, Homo Sapiens
YYFAQQNSGHF

SEQ ID NO: 164169 - protein, 11 aa, Homo Sapiens
YYFDAAEAEAW

SEQ ID NO: 164170 - protein, 11 aa, Homo Sapiens
YYFDNVSSTEL

SEQ ID NO: 164171 - protein, 11 aa, Homo Sapiens
YYHGPTPIQSL

SEQ ID NO: 164172 - protein, 11 aa, Homo Sapiens
YYIDADLLREI

SEQ ID NO: 164173 - protein, 11 aa, Homo Sapiens
YYIGDIHPSDL

SEQ ID NO: 164174 - protein, 11 aa, Homo Sapiens
YYIPGQGRSTY

SEQ ID NO: 164175 - protein, 11 aa, Homo Sapiens
YYITNDTVQTY

SEQ ID NO: 164176 - protein, 11 aa, Homo Sapiens
YYLNEQGDRVY

SEQ ID NO: 164177 - protein, 11 aa, Homo Sapiens
YYMEGRDSMQL

SEQ ID NO: 164178 - protein, 11 aa, Homo Sapiens
YYPGFNPFRAY

SEQ ID NO: 164179 - protein, 11 aa, Homo Sapiens
YYQALSSSSIM

SEQ ID NO: 164180 - protein, 11 aa, Homo Sapiens
YYQTIGNHASY

SEQ ID NO: 164181 - protein, 11 aa, Homo Sapiens
YYSPTKNEIVF

SEQ ID NO: 164182 - protein, 11 aa, Homo Sapiens
YYYDPLAGTYY

SEQ ID NO: 164183 - protein, 11 aa, Homo Sapiens
YYYDPQEEVYL

SEQ ID NO: 164184 - protein, 11 aa, Homo Sapiens
YYYDPQTGLYY

SEQ ID NO: 164185 - protein, 11 aa, Homo Sapiens
YYYDPTTGLYY

SEQ ID NO: 164186 - protein, 11 aa, Homo Sapiens
YYYDTHTNTYY

SEQ ID NO: 164187 - protein, 8 aa, Homo Sapiens
AAAPPLTL

SEQ ID NO: 164188 - protein, 8 aa, Homo Sapiens
AAGRPLEL

SEQ ID NO: 164189 - protein, 8 aa, Homo Sapiens
AASHPLLL

SEQ ID NO: 164190 - protein, 8 aa, Homo Sapiens
AGSIVLKV

SEQ ID NO: 164191 - protein, 8 aa, Homo Sapiens
AIGKVLKL

SEQ ID NO: 164192 - protein, 8 aa, Homo Sapiens
ALAPMLEV

SEQ ID NO: 164193 - protein, 8 aa, Homo Sapiens
ALGPILRL

SEQ ID NO: 164194 - protein, 8 aa, Homo Sapiens
AQGVVLKV

SEQ ID NO: 164195 - protein, 8 aa, Homo Sapiens
AQSKILFV

SEQ ID NO: 164196 - protein, 8 aa, Homo Sapiens
ASAPRLMV

SEQ ID NO: 164197 - protein, 8 aa, Homo Sapiens
ASGKLLLL

SEQ ID NO: 164198 - protein, 8 aa, Homo Sapiens
ASGLPLMV

SEQ ID NO: 164199 - protein, 8 aa, Homo Sapiens
ASGMILVM

SEQ ID NO: 164200 - protein, 8 aa, Homo Sapiens
ASGYPVKV

SEQ ID NO: 164201 - protein, 8 aa, Homo Sapiens
ASSTPLHV

SEQ ID NO: 164202 - protein, 8 aa, Homo Sapiens
ASTHRLMT

SEQ ID NO: 164203 - protein, 8 aa, Homo Sapiens
ASYKPVFV

SEQ ID NO: 164204 - protein, 8 aa, Homo Sapiens
ATAPVVAL

SEQ ID NO: 164205 - protein, 8 aa, Homo Sapiens
ATGHPMVI

SEQ ID NO: 164206 - protein, 8 aa, Homo Sapiens
ATGPLLKF

SEQ ID NO: 164207 - protein, 8 aa, Homo Sapiens
ATGPSIKI

SEQ ID NO: 164208 - protein, 8 aa, Homo Sapiens
ATNIDLKL

SEQ ID NO: 164209 - protein, 8 aa, Homo Sapiens
AVAHPLIL

SEQ ID NO: 164210 - protein, 8 aa, Homo Sapiens
AVAPVLSI

SEQ ID NO: 164211 - protein, 8 aa, Homo Sapiens
DTNADKQL

SEQ ID NO: 164212 - protein, 8 aa, Homo Sapiens
FAGKVLRL

SEQ ID NO: 164213 - protein, 8 aa, Homo Sapiens
FAGQPLTI

SEQ ID NO: 164214 - protein, 8 aa, Homo Sapiens
FAGVDIRV

SEQ ID NO: 164215 - protein, 8 aa, Homo Sapiens
FARMLAQE

SEQ ID NO: 164216 - protein, 8 aa, Homo Sapiens
FGITPLFV

SEQ ID NO: 164217 - protein, 8 aa, Homo Sapiens
FNEKSKEL

SEQ ID NO: 164218 - protein, 8 aa, Homo Sapiens
FNTGPLSV

SEQ ID NO: 164219 - protein, 8 aa, Homo Sapiens
FSGNPIKV

SEQ ID NO: 164220 - protein, 8 aa, Homo Sapiens
FSGPAITL

SEQ ID NO: 164221 - protein, 8 aa, Homo Sapiens
FSGRILGL

SEQ ID NO: 164222 - protein, 8 aa, Homo Sapiens
FSSLPLKM

SEQ ID NO: 164223 - protein, 8 aa, Homo Sapiens
FSSPPLSL

SEQ ID NO: 164224 - protein, 8 aa, Homo Sapiens
FTADPLSL

SEQ ID NO: 164225 - protein, 8 aa, Homo Sapiens
FTANALAL

SEQ ID NO: 164226 - protein, 8 aa, Homo Sapiens
FTGAPLKV

SEQ ID NO: 164227 - protein, 8 aa, Homo Sapiens
FTSEPRLI

SEQ ID NO: 164228 - protein, 8 aa, Homo Sapiens
FTSKELVV

SEQ ID NO: 164229 - protein, 8 aa, Homo Sapiens
FVQMMTAK

SEQ ID NO: 164230 - protein, 8 aa, Homo Sapiens
FVRVLVSK

SEQ ID NO: 164231 - protein, 8 aa, Homo Sapiens
GVGPELEV

SEQ ID NO: 164232 - protein, 8 aa, Homo Sapiens
HIAKALAL

SEQ ID NO: 164233 - protein, 8 aa, Homo Sapiens
HNGEPLYI

SEQ ID NO: 164234 - protein, 8 aa, Homo Sapiens
HSGPIHVL

SEQ ID NO: 164235 - protein, 8 aa, Homo Sapiens
HSGPPIVI

SEQ ID NO: 164236 - protein, 8 aa, Homo Sapiens
HTAPVLDI

SEQ ID NO: 164237 - protein, 8 aa, Homo Sapiens
HTGPITCL

SEQ ID NO: 164238 - protein, 8 aa, Homo Sapiens
HTGPVFTV

SEQ ID NO: 164239 - protein, 8 aa, Homo Sapiens
HTGYVIEL

SEQ ID NO: 164240 - protein, 8 aa, Homo Sapiens
HTIKPALV

SEQ ID NO: 164241 - protein, 8 aa, Homo Sapiens
HTSVPLLL

SEQ ID NO: 164242 - protein, 8 aa, Homo Sapiens
IAGKIIEV

SEQ ID NO: 164243 - protein, 8 aa, Homo Sapiens
IAGPVVEI

SEQ ID NO: 164244 - protein, 8 aa, Homo Sapiens
IASKPIIV

SEQ ID NO: 164245 - protein, 8 aa, Homo Sapiens
IGGKSLEV

SEQ ID NO: 164246 - protein, 8 aa, Homo Sapiens
IGSKPLQI

SEQ ID NO: 164247 - protein, 8 aa, Homo Sapiens
IIGRPVVV

SEQ ID NO: 164248 - protein, 8 aa, Homo Sapiens
IINTFHQY

SEQ ID NO: 164249 - protein, 8 aa, Homo Sapiens
ILSKPIEV

SEQ ID NO: 164250 - protein, 8 aa, Homo Sapiens
ISAEPIVV

SEQ ID NO: 164251 - protein, 8 aa, Homo Sapiens
ISAKPLEM

SEQ ID NO: 164252 - protein, 8 aa, Homo Sapiens
ISGKIIFV

SEQ ID NO: 164253 - protein, 8 aa, Homo Sapiens
ISGKPILV

SEQ ID NO: 164254 - protein, 8 aa, Homo Sapiens
ISGPPLKA

SEQ ID NO: 164255 - protein, 8 aa, Homo Sapiens
ISSHVLEL

SEQ ID NO: 164256 - protein, 8 aa, Homo Sapiens
ISVHPLTL

SEQ ID NO: 164257 - protein, 8 aa, Homo Sapiens
ITAPPMHV

SEQ ID NO: 164258 - protein, 8 aa, Homo Sapiens
ITGHVLVV

SEQ ID NO: 164259 - protein, 8 aa, Homo Sapiens
ITSKILFV

SEQ ID NO: 164260 - protein, 8 aa, Homo Sapiens
ITTKVLRV

SEQ ID NO: 164261 - protein, 8 aa, Homo Sapiens
IVGPQLTV

SEQ ID NO: 164262 - protein, 8 aa, Homo Sapiens
IYNEALKG

SEQ ID NO: 164263 - protein, 8 aa, Homo Sapiens
KAGKALVI

SEQ ID NO: 164264 - protein, 8 aa, Homo Sapiens
KAVRPLEL

SEQ ID NO: 164265 - protein, 8 aa, Homo Sapiens
KEKIPIIV

SEQ ID NO: 164266 - protein, 8 aa, Homo Sapiens
KIGTPVKV

SEQ ID NO: 164267 - protein, 8 aa, Homo Sapiens
KIVKPVKV

SEQ ID NO: 164268 - protein, 8 aa, Homo Sapiens
KSITPLML

SEQ ID NO: 164269 - protein, 8 aa, Homo Sapiens
KTNVPVKL

SEQ ID NO: 164270 - protein, 8 aa, Homo Sapiens
KTVKPLSL

SEQ ID NO: 164271 - protein, 8 aa, Homo Sapiens
KWYILLLI

SEQ ID NO: 164272 - protein, 8 aa, Homo Sapiens
LAGPPITV

SEQ ID NO: 164273 - protein, 8 aa, Homo Sapiens
LAGPPLEI

SEQ ID NO: 164274 - protein, 8 aa, Homo Sapiens
LIAPPRYV

SEQ ID NO: 164275 - protein, 8 aa, Homo Sapiens
LPSHPLEL

SEQ ID NO: 164276 - protein, 8 aa, Homo Sapiens
LQGPILRL

SEQ ID NO: 164277 - protein, 8 aa, Homo Sapiens
LSAYPLSV

SEQ ID NO: 164278 - protein, 8 aa, Homo Sapiens
LSGISLHV

SEQ ID NO: 164279 - protein, 8 aa, Homo Sapiens
LSGKILHI

SEQ ID NO: 164280 - protein, 8 aa, Homo Sapiens
LSGPVHGL

SEQ ID NO: 164281 - protein, 8 aa, Homo Sapiens
LSGSPLKV

SEQ ID NO: 164282 - protein, 8 aa, Homo Sapiens
LSGVPLMI

SEQ ID NO: 164283 - protein, 8 aa, Homo Sapiens
LSSKVLAI

SEQ ID NO: 164284 - protein, 8 aa, Homo Sapiens
LTAEVLEL

SEQ ID NO: 164285 - protein, 8 aa, Homo Sapiens
LTGKPVMV

SEQ ID NO: 164286 - protein, 8 aa, Homo Sapiens
LTGPIQVI

SEQ ID NO: 164287 - protein, 8 aa, Homo Sapiens
LTGPVLEL

SEQ ID NO: 164288 - protein, 8 aa, Homo Sapiens
LVNVLPKV

SEQ ID NO: 164289 - protein, 8 aa, Homo Sapiens
MAGPRLEI

SEQ ID NO: 164290 - protein, 8 aa, Homo Sapiens
MSGKPLRM

SEQ ID NO: 164291 - protein, 8 aa, Homo Sapiens
MSGPPLVL

SEQ ID NO: 164292 - protein, 8 aa, Homo Sapiens
MVGPILEM

SEQ ID NO: 164293 - protein, 8 aa, Homo Sapiens
NAASPLIV

SEQ ID NO: 164294 - protein, 8 aa, Homo Sapiens
PLSSPLKV

SEQ ID NO: 164295 - protein, 8 aa, Homo Sapiens
QAGPVIKV

SEQ ID NO: 164296 - protein, 8 aa, Homo Sapiens
QIGPMLRL

SEQ ID NO: 164297 - protein, 8 aa, Homo Sapiens
QQSKILKV

SEQ ID NO: 164298 - protein, 8 aa, Homo Sapiens
QSGFPLRV

SEQ ID NO: 164299 - protein, 8 aa, Homo Sapiens
RAAVPRFV

SEQ ID NO: 164300 - protein, 8 aa, Homo Sapiens
RAGVPMEV

SEQ ID NO: 164301 - protein, 8 aa, Homo Sapiens
RANMPLHV

SEQ ID NO: 164302 - protein, 8 aa, Homo Sapiens
RAVFPIYL

SEQ ID NO: 164303 - protein, 8 aa, Homo Sapiens
RGAPPLQL

SEQ ID NO: 164304 - protein, 8 aa, Homo Sapiens
RGNTPLHL

SEQ ID NO: 164305 - protein, 8 aa, Homo Sapiens
RIAKAIEV

SEQ ID NO: 164306 - protein, 8 aa, Homo Sapiens
RIPKALEV

SEQ ID NO: 164307 - protein, 8 aa, Homo Sapiens
RSQKPVMV

SEQ ID NO: 164308 - protein, 8 aa, Homo Sapiens
RSVFPLSV

SEQ ID NO: 164309 - protein, 8 aa, Homo Sapiens
RTGLRVVV

SEQ ID NO: 164310 - protein, 8 aa, Homo Sapiens
RTIFPLFM

SEQ ID NO: 164311 - protein, 8 aa, Homo Sapiens
RTMQPLAV

SEQ ID NO: 164312 - protein, 8 aa, Homo Sapiens
RTWKPTLV

SEQ ID NO: 164313 - protein, 8 aa, Homo Sapiens
RVVFPLEL

SEQ ID NO: 164314 - protein, 8 aa, Homo Sapiens
SASIPLTV

SEQ ID NO: 164315 - protein, 8 aa, Homo Sapiens
SATFPLSV

SEQ ID NO: 164316 - protein, 8 aa, Homo Sapiens
SFKKPFKL

SEQ ID NO: 164317 - protein, 8 aa, Homo Sapiens
SGGKPLEV

SEQ ID NO: 164318 - protein, 8 aa, Homo Sapiens
SIFVFTHV

SEQ ID NO: 164319 - protein, 8 aa, Homo Sapiens
SIRSVRLV

SEQ ID NO: 164320 - protein, 8 aa, Homo Sapiens
SPVDIDTK

SEQ ID NO: 164321 - protein, 8 aa, Homo Sapiens
SSAPVVLV

SEQ ID NO: 164322 - protein, 8 aa, Homo Sapiens
SSFVFSTV

SEQ ID NO: 164323 - protein, 8 aa, Homo Sapiens
SSGSILKV

SEQ ID NO: 164324 - protein, 8 aa, Homo Sapiens
SSGYPLTI

SEQ ID NO: 164325 - protein, 8 aa, Homo Sapiens
SSSKVLEL

SEQ ID NO: 164326 - protein, 8 aa, Homo Sapiens
SSSRILLV

SEQ ID NO: 164327 - protein, 8 aa, Homo Sapiens
STSPPLKL

SEQ ID NO: 164328 - protein, 8 aa, Homo Sapiens
SVGPWLLA

SEQ ID NO: 164329 - protein, 8 aa, Homo Sapiens
SVGYILWV

SEQ ID NO: 164330 - protein, 8 aa, Homo Sapiens
SVSNPLEV

SEQ ID NO: 164331 - protein, 8 aa, Homo Sapiens
TAGQPLQL

SEQ ID NO: 164332 - protein, 8 aa, Homo Sapiens
TAGRVLEL

SEQ ID NO: 164333 - protein, 8 aa, Homo Sapiens
TNIHELRV

SEQ ID NO: 164334 - protein, 8 aa, Homo Sapiens
TSGPPLTM

SEQ ID NO: 164335 - protein, 8 aa, Homo Sapiens
TTGIPIHV

SEQ ID NO: 164336 - protein, 8 aa, Homo Sapiens
TTGPPHLV

SEQ ID NO: 164337 - protein, 8 aa, Homo Sapiens
TTSIPLRL

SEQ ID NO: 164338 - protein, 8 aa, Homo Sapiens
TTSRVLKV

SEQ ID NO: 164339 - protein, 8 aa, Homo Sapiens
VAGTPMFV

SEQ ID NO: 164340 - protein, 8 aa, Homo Sapiens
VATKPLYV

SEQ ID NO: 164341 - protein, 8 aa, Homo Sapiens
VGSKPLYV

SEQ ID NO: 164342 - protein, 8 aa, Homo Sapiens
VIGIPVYV

SEQ ID NO: 164343 - protein, 8 aa, Homo Sapiens
VIGPPVVL

SEQ ID NO: 164344 - protein, 8 aa, Homo Sapiens
VIGRVLEL

SEQ ID NO: 164345 - protein, 8 aa, Homo Sapiens
VLGRVLQL

SEQ ID NO: 164346 - protein, 8 aa, Homo Sapiens
VLNGPLIL

SEQ ID NO: 164347 - protein, 8 aa, Homo Sapiens
VQGQPLMV

SEQ ID NO: 164348 - protein, 8 aa, Homo Sapiens
VREIAQDF

SEQ ID NO: 164349 - protein, 8 aa, Homo Sapiens
VSGKILYI

SEQ ID NO: 164350 - protein, 8 aa, Homo Sapiens
VSGPAMTL

SEQ ID NO: 164351 - protein, 8 aa, Homo Sapiens
VSGPDIDI

SEQ ID NO: 164352 - protein, 8 aa, Homo Sapiens
VSGPGLSL

SEQ ID NO: 164353 - protein, 8 aa, Homo Sapiens
VSGPPAFL

SEQ ID NO: 164354 - protein, 8 aa, Homo Sapiens
VSGPVHLF

SEQ ID NO: 164355 - protein, 8 aa, Homo Sapiens
VSGQILHV

SEQ ID NO: 164356 - protein, 8 aa, Homo Sapiens
VSGQVLEL

SEQ ID NO: 164357 - protein, 8 aa, Homo Sapiens
VSGVIVKI

SEQ ID NO: 164358 - protein, 8 aa, Homo Sapiens
VSIRPMEL

SEQ ID NO: 164359 - protein, 8 aa, Homo Sapiens
VSSKILEL

SEQ ID NO: 164360 - protein, 8 aa, Homo Sapiens
VSTMILEV

SEQ ID NO: 164361 - protein, 8 aa, Homo Sapiens
VTGHPLLI

SEQ ID NO: 164362 - protein, 8 aa, Homo Sapiens
VTGRWLLL

SEQ ID NO: 164363 - protein, 8 aa, Homo Sapiens
VTHLHRVV

SEQ ID NO: 164364 - protein, 8 aa, Homo Sapiens
VTTVILEV

SEQ ID NO: 164365 - protein, 8 aa, Homo Sapiens
VVGKDLTV

SEQ ID NO: 164366 - protein, 8 aa, Homo Sapiens
VVGPVLDV

SEQ ID NO: 164367 - protein, 8 aa, Homo Sapiens
VVGRWLLV

SEQ ID NO: 164368 - protein, 8 aa, Homo Sapiens
VVGTPLLV

SEQ ID NO: 164369 - protein, 8 aa, Homo Sapiens
VVGYVLTV

SEQ ID NO: 164370 - protein, 8 aa, Homo Sapiens
VVVHPLVL

SEQ ID NO: 164371 - protein, 8 aa, Homo Sapiens
WSGEPLFL

SEQ ID NO: 164372 - protein, 8 aa, Homo Sapiens
WSVDPLDR

SEQ ID NO: 164373 - protein, 8 aa, Homo Sapiens
YAGAILEV

SEQ ID NO: 164374 - protein, 8 aa, Homo Sapiens
YGSKPLNI

SEQ ID NO: 164375 - protein, 8 aa, Homo Sapiens
YGSVPVLL

SEQ ID NO: 164376 - protein, 8 aa, Homo Sapiens
YLGKVLEL

SEQ ID NO: 164377 - protein, 8 aa, Homo Sapiens
YLGRTLLV

SEQ ID NO: 164378 - protein, 8 aa, Homo Sapiens
YLSKVLEL

SEQ ID NO: 164379 - protein, 8 aa, Homo Sapiens
YNSHPLLV

SEQ ID NO: 164380 - protein, 8 aa, Homo Sapiens
YQGPVLLI

SEQ ID NO: 164381 - protein, 8 aa, Homo Sapiens
YQGVNLYI

SEQ ID NO: 164382 - protein, 8 aa, Homo Sapiens
YQGVNLYV

SEQ ID NO: 164383 - protein, 8 aa, Homo Sapiens
YRDDLKKL

SEQ ID NO: 164384 - protein, 8 aa, Homo Sapiens
YSAPVIHV

SEQ ID NO: 164385 - protein, 8 aa, Homo Sapiens
YSGRPVNL

SEQ ID NO: 164386 - protein, 8 aa, Homo Sapiens
YSGVEVRV

SEQ ID NO: 164387 - protein, 8 aa, Homo Sapiens
YSGVPMTI

SEQ ID NO: 164388 - protein, 8 aa, Homo Sapiens
YSIRPLIV

SEQ ID NO: 164389 - protein, 8 aa, Homo Sapiens
YSNFPLQV

SEQ ID NO: 164390 - protein, 8 aa, Homo Sapiens
YSNKEIFL

SEQ ID NO: 164391 - protein, 8 aa, Homo Sapiens
YSNRVVDL

SEQ ID NO: 164392 - protein, 8 aa, Homo Sapiens
YSSKVLLL

SEQ ID NO: 164393 - protein, 8 aa, Homo Sapiens
YSSLPVEV

SEQ ID NO: 164394 - protein, 8 aa, Homo Sapiens
YSSYPIKL

SEQ ID NO: 164395 - protein, 8 aa, Homo Sapiens
YTAEPVTL

SEQ ID NO: 164396 - protein, 8 aa, Homo Sapiens
YTAKELNV

SEQ ID NO: 164397 - protein, 8 aa, Homo Sapiens
YTGFSILV

SEQ ID NO: 164398 - protein, 8 aa, Homo Sapiens
YTGPGLAI

SEQ ID NO: 164399 - protein, 8 aa, Homo Sapiens
YTGYVLAL

SEQ ID NO: 164400 - protein, 8 aa, Homo Sapiens
YTSIPIFL

SEQ ID NO: 164401 - protein, 8 aa, Homo Sapiens
YTVVPRLV

SEQ ID NO: 164402 - protein, 8 aa, Homo Sapiens
YVGYILSV

SEQ ID NO: 164403 - protein, 8 aa, Homo Sapiens
YVSFPLEL

SEQ ID NO: 164404 - protein, 9 aa, Homo Sapiens
AAAAPHLLL

SEQ ID NO: 164405 - protein, 9 aa, Homo Sapiens
AAAIKALEL

SEQ ID NO: 164406 - protein, 9 aa, Homo Sapiens
AAAPHLLLL

SEQ ID NO: 164407 - protein, 9 aa, Homo Sapiens
AAAPQLLIV

SEQ ID NO: 164408 - protein, 9 aa, Homo Sapiens
AAASHPLLL

SEQ ID NO: 164409 - protein, 9 aa, Homo Sapiens
AAEFHARFV

SEQ ID NO: 164410 - protein, 9 aa, Homo Sapiens
AAFEKALEV

SEQ ID NO: 164411 - protein, 9 aa, Homo Sapiens
AAIASLLYL

SEQ ID NO: 164412 - protein, 9 aa, Homo Sapiens
AAIDHQIEV

SEQ ID NO: 164413 - protein, 9 aa, Homo Sapiens
AAIMQALWL

SEQ ID NO: 164414 - protein, 9 aa, Homo Sapiens
AAIPYWLLL

SEQ ID NO: 164415 - protein, 9 aa, Homo Sapiens
AAISEVLYV

SEQ ID NO: 164416 - protein, 9 aa, Homo Sapiens
AAIWFRTYL

SEQ ID NO: 164417 - protein, 9 aa, Homo Sapiens
AALMRPLVV

SEQ ID NO: 164418 - protein, 9 aa, Homo Sapiens
AALPVYQEL

SEQ ID NO: 164419 - protein, 9 aa, Homo Sapiens
AAMSHLLEM

SEQ ID NO: 164420 - protein, 9 aa, Homo Sapiens
AAMSLLRRV

SEQ ID NO: 164421 - protein, 9 aa, Homo Sapiens
AANKTIIYL

SEQ ID NO: 164422 - protein, 9 aa, Homo Sapiens
AANKVVLQL

SEQ ID NO: 164423 - protein, 9 aa, Homo Sapiens
AANRLTLEL

SEQ ID NO: 164424 - protein, 9 aa, Homo Sapiens
AAQVHVLML

SEQ ID NO: 164425 - protein, 9 aa, Homo Sapiens
AASAFFTYV

SEQ ID NO: 164426 - protein, 9 aa, Homo Sapiens
AASAQLLRL

SEQ ID NO: 164427 - protein, 9 aa, Homo Sapiens
AASGLPLMV

SEQ ID NO: 164428 - protein, 9 aa, Homo Sapiens
AASPIITLV

SEQ ID NO: 164429 - protein, 9 aa, Homo Sapiens
AASTAQLLV

SEQ ID NO: 164430 - protein, 9 aa, Homo Sapiens
AATARVLVI

SEQ ID NO: 164431 - protein, 9 aa, Homo Sapiens
AATLYSLKV

SEQ ID NO: 164432 - protein, 9 aa, Homo Sapiens
AATSRIAEL

SEQ ID NO: 164433 - protein, 9 aa, Homo Sapiens
AAVGHVLVV

SEQ ID NO: 164434 - protein, 9 aa, Homo Sapiens
AAVHIILVI

SEQ ID NO: 164435 - protein, 9 aa, Homo Sapiens
AAYQSVRIL

SEQ ID NO: 164436 - protein, 9 aa, Homo Sapiens
AAYRRALEL

SEQ ID NO: 164437 - protein, 9 aa, Homo Sapiens
AAYYHPSYL

SEQ ID NO: 164438 - protein, 9 aa, Homo Sapiens
AGDPVILYV

SEQ ID NO: 164439 - protein, 9 aa, Homo Sapiens
AGMPITLTV

SEQ ID NO: 164440 - protein, 9 aa, Homo Sapiens
AGNGIRVFV

SEQ ID NO: 164441 - protein, 9 aa, Homo Sapiens
AGSIVRLYV

SEQ ID NO: 164442 - protein, 9 aa, Homo Sapiens
AGYNRVKIV

SEQ ID NO: 164443 - protein, 9 aa, Homo Sapiens
AGYPHIRYI

SEQ ID NO: 164444 - protein, 9 aa, Homo Sapiens
AIIALFHLL

SEQ ID NO: 164445 - protein, 9 aa, Homo Sapiens
AIILHLLYL

SEQ ID NO: 164446 - protein, 9 aa, Homo Sapiens
AIMAIFRYV

SEQ ID NO: 164447 - protein, 9 aa, Homo Sapiens
AIMDIVIKV

SEQ ID NO: 164448 - protein, 9 aa, Homo Sapiens
AIMDLLLRL

SEQ ID NO: 164449 - protein, 9 aa, Homo Sapiens
AINIMVLKV

SEQ ID NO: 164450 - protein, 9 aa, Homo Sapiens
AINNAITYL

SEQ ID NO: 164451 - protein, 9 aa, Homo Sapiens
AINPELLQL

SEQ ID NO: 164452 - protein, 9 aa, Homo Sapiens
AINPKLLQL

SEQ ID NO: 164453 - protein, 9 aa, Homo Sapiens
AINPKLMQL

SEQ ID NO: 164454 - protein, 9 aa, Homo Sapiens
AIQDHLLEV

SEQ ID NO: 164455 - protein, 9 aa, Homo Sapiens
AISSVRLYI

SEQ ID NO: 164456 - protein, 9 aa, Homo Sapiens
AITDHYIQV

SEQ ID NO: 164457 - protein, 9 aa, Homo Sapiens
AITSYLLQL

SEQ ID NO: 164458 - protein, 9 aa, Homo Sapiens
AIVKVFLAL

SEQ ID NO: 164459 - protein, 9 aa, Homo Sapiens
AIYYFKIAV

SEQ ID NO: 164460 - protein, 9 aa, Homo Sapiens
ALFQQKLQL

SEQ ID NO: 164461 - protein, 9 aa, Homo Sapiens
ALLPYFVYV

SEQ ID NO: 164462 - protein, 9 aa, Homo Sapiens
ALNAVRLLV

SEQ ID NO: 164463 - protein, 9 aa, Homo Sapiens
ALNEVHLVV

SEQ ID NO: 164464 - protein, 9 aa, Homo Sapiens
ALNILKLVV

SEQ ID NO: 164465 - protein, 9 aa, Homo Sapiens
ALNSKILSV

SEQ ID NO: 164466 - protein, 9 aa, Homo Sapiens
ALNYLQLLV

SEQ ID NO: 164467 - protein, 9 aa, Homo Sapiens
AMNSQILEV

SEQ ID NO: 164468 - protein, 9 aa, Homo Sapiens
AMYVQLIEV

SEQ ID NO: 164469 - protein, 9 aa, Homo Sapiens
ANAASPLIV

SEQ ID NO: 164470 - protein, 9 aa, Homo Sapiens
ANDIARLMV

SEQ ID NO: 164471 - protein, 9 aa, Homo Sapiens
ANGIKVLLI

SEQ ID NO: 164472 - protein, 9 aa, Homo Sapiens
ANLEHAFYV

SEQ ID NO: 164473 - protein, 9 aa, Homo Sapiens
ANLGKFLEL

SEQ ID NO: 164474 - protein, 9 aa, Homo Sapiens
ANLPFPLAL

SEQ ID NO: 164475 - protein, 9 aa, Homo Sapiens
ANLYVGLVV

SEQ ID NO: 164476 - protein, 9 aa, Homo Sapiens
ANQAFFLLV

SEQ ID NO: 164477 - protein, 9 aa, Homo Sapiens
ANQQNILKF

SEQ ID NO: 164478 - protein, 9 aa, Homo Sapiens
ANSDHLMQI

SEQ ID NO: 164479 - protein, 9 aa, Homo Sapiens
ANSGAIVKL

SEQ ID NO: 164480 - protein, 9 aa, Homo Sapiens
ANSPWVVQL

SEQ ID NO: 164481 - protein, 9 aa, Homo Sapiens
ANSPYIPYL

SEQ ID NO: 164482 - protein, 9 aa, Homo Sapiens
ANTALPLAL

SEQ ID NO: 164483 - protein, 9 aa, Homo Sapiens
ANTGIILFI

SEQ ID NO: 164484 - protein, 9 aa, Homo Sapiens
ANTLVYHVV

SEQ ID NO: 164485 - protein, 9 aa, Homo Sapiens
ANTQVVREV

SEQ ID NO: 164486 - protein, 9 aa, Homo Sapiens
ANVEHILKI

SEQ ID NO: 164487 - protein, 9 aa, Homo Sapiens
ANWYFGNFL

SEQ ID NO: 164488 - protein, 9 aa, Homo Sapiens
AQMDYQLRL

SEQ ID NO: 164489 - protein, 9 aa, Homo Sapiens
AQNGIPLRI

SEQ ID NO: 164490 - protein, 9 aa, Homo Sapiens
AQNPSELYL

SEQ ID NO: 164491 - protein, 9 aa, Homo Sapiens
AQNRFLLEL

SEQ ID NO: 164492 - protein, 9 aa, Homo Sapiens
AQYEHDLEV

SEQ ID NO: 164493 - protein, 9 aa, Homo Sapiens
AQYNFILVV

SEQ ID NO: 164494 - protein, 9 aa, Homo Sapiens
ASAAAALVL

SEQ ID NO: 164495 - protein, 9 aa, Homo Sapiens
ASAASALHL

SEQ ID NO: 164496 - protein, 9 aa, Homo Sapiens
ASAPRLMVL

SEQ ID NO: 164497 - protein, 9 aa, Homo Sapiens
ASDPRIIRL

SEQ ID NO: 164498 - protein, 9 aa, Homo Sapiens
ASDPYQVHV

SEQ ID NO: 164499 - protein, 9 aa, Homo Sapiens
ASEFGNHYL

SEQ ID NO: 164500 - protein, 9 aa, Homo Sapiens
ASFDGTIKV

SEQ ID NO: 164501 - protein, 9 aa, Homo Sapiens
ASFDKSIKL

SEQ ID NO: 164502 - protein, 9 aa, Homo Sapiens
ASFDRAIEM

SEQ ID NO: 164503 - protein, 9 aa, Homo Sapiens
ASFGSFHLI

SEQ ID NO: 164504 - protein, 9 aa, Homo Sapiens
ASFHRVQAL

SEQ ID NO: 164505 - protein, 9 aa, Homo Sapiens
ASFKAFRSL

SEQ ID NO: 164506 - protein, 9 aa, Homo Sapiens
ASFPEYLVV

SEQ ID NO: 164507 - protein, 9 aa, Homo Sapiens
ASFPGANII

SEQ ID NO: 164508 - protein, 9 aa, Homo Sapiens
ASFPHLRIL

SEQ ID NO: 164509 - protein, 9 aa, Homo Sapiens
ASFQEIMEV

SEQ ID NO: 164510 - protein, 9 aa, Homo Sapiens
ASFSDVRIL

SEQ ID NO: 164511 - protein, 9 aa, Homo Sapiens
ASFTRAYLL

SEQ ID NO: 164512 - protein, 9 aa, Homo Sapiens
ASFWGGMLV

SEQ ID NO: 164513 - protein, 9 aa, Homo Sapiens
ASFYQRALL

SEQ ID NO: 164514 - protein, 9 aa, Homo Sapiens
ASGPGLSFL

SEQ ID NO: 164515 - protein, 9 aa, Homo Sapiens
ASGPPVSEL

SEQ ID NO: 164516 - protein, 9 aa, Homo Sapiens
ASHFFNLMF

SEQ ID NO: 164517 - protein, 9 aa, Homo Sapiens
ASHGFYEFL

SEQ ID NO: 164518 - protein, 9 aa, Homo Sapiens
ASHLHLNSV

SEQ ID NO: 164519 - protein, 9 aa, Homo Sapiens
ASIFHQQEL

SEQ ID NO: 164520 - protein, 9 aa, Homo Sapiens
ASIGNAQKL

SEQ ID NO: 164521 - protein, 9 aa, Homo Sapiens
ASILKQLAV

SEQ ID NO: 164522 - protein, 9 aa, Homo Sapiens
ASIQQTLKL

SEQ ID NO: 164523 - protein, 9 aa, Homo Sapiens
ASIRIPRTV

SEQ ID NO: 164524 - protein, 9 aa, Homo Sapiens
ASISHFMQF

SEQ ID NO: 164525 - protein, 9 aa, Homo Sapiens
ASISHVAHV

SEQ ID NO: 164526 - protein, 9 aa, Homo Sapiens
ASISLAQYL

SEQ ID NO: 164527 - protein, 9 aa, Homo Sapiens
ASISRSLEL

SEQ ID NO: 164528 - protein, 9 aa, Homo Sapiens
ASITLQQQL

SEQ ID NO: 164529 - protein, 9 aa, Homo Sapiens
ASITSFLTV

SEQ ID NO: 164530 - protein, 9 aa, Homo Sapiens
ASIVRVKKL

SEQ ID NO: 164531 - protein, 9 aa, Homo Sapiens
ASIYKILHL

SEQ ID NO: 164532 - protein, 9 aa, Homo Sapiens
ASKAWTLEV

SEQ ID NO: 164533 - protein, 9 aa, Homo Sapiens
ASLDLVLHL

SEQ ID NO: 164534 - protein, 9 aa, Homo Sapiens
ASLDRTIKV

SEQ ID NO: 164535 - protein, 9 aa, Homo Sapiens
ASLDWPRMV

SEQ ID NO: 164536 - protein, 9 aa, Homo Sapiens
ASLEKVQKL

SEQ ID NO: 164537 - protein, 9 aa, Homo Sapiens
ASLERAQNL

SEQ ID NO: 164538 - protein, 9 aa, Homo Sapiens
ASLFSGRLV

SEQ ID NO: 164539 - protein, 9 aa, Homo Sapiens
ASLGLQLEV

SEQ ID NO: 164540 - protein, 9 aa, Homo Sapiens
ASLGYVVVV

SEQ ID NO: 164541 - protein, 9 aa, Homo Sapiens
ASLHVMMTL

SEQ ID NO: 164542 - protein, 9 aa, Homo Sapiens
ASLISVRNL

SEQ ID NO: 164543 - protein, 9 aa, Homo Sapiens
ASLLFKTLL

SEQ ID NO: 164544 - protein, 9 aa, Homo Sapiens
ASLMHSFIL

SEQ ID NO: 164545 - protein, 9 aa, Homo Sapiens
ASLPKPFFL

SEQ ID NO: 164546 - protein, 9 aa, Homo Sapiens
ASLPLVLYI

SEQ ID NO: 164547 - protein, 9 aa, Homo Sapiens
ASLPRVLRV

SEQ ID NO: 164548 - protein, 9 aa, Homo Sapiens
ASLPTSVQV

SEQ ID NO: 164549 - protein, 9 aa, Homo Sapiens
ASLPYAQQL

SEQ ID NO: 164550 - protein, 9 aa, Homo Sapiens
ASLSEVLEL

SEQ ID NO: 164551 - protein, 9 aa, Homo Sapiens
ASLSHQSLV

SEQ ID NO: 164552 - protein, 9 aa, Homo Sapiens
ASLSLPLVL

SEQ ID NO: 164553 - protein, 9 aa, Homo Sapiens
ASLTKILVI

SEQ ID NO: 164554 - protein, 9 aa, Homo Sapiens
ASLVFPLLV

SEQ ID NO: 164555 - protein, 9 aa, Homo Sapiens
ASLVIAQLL

SEQ ID NO: 164556 - protein, 9 aa, Homo Sapiens
ASLWQELEV

SEQ ID NO: 164557 - protein, 9 aa, Homo Sapiens
ASLYLLRVL

SEQ ID NO: 164558 - protein, 9 aa, Homo Sapiens
ASMIHPKEV

SEQ ID NO: 164559 - protein, 9 aa, Homo Sapiens
ASMSVVLKL

SEQ ID NO: 164560 - protein, 9 aa, Homo Sapiens
ASMVLPRAV

SEQ ID NO: 164561 - protein, 9 aa, Homo Sapiens
ASNGSLLKV

SEQ ID NO: 164562 - protein, 9 aa, Homo Sapiens
ASNGVLLLM

SEQ ID NO: 164563 - protein, 9 aa, Homo Sapiens
ASNIMEVKI

SEQ ID NO: 164564 - protein, 9 aa, Homo Sapiens
ASNIMIVTL

SEQ ID NO: 164565 - protein, 9 aa, Homo Sapiens
ASNIVSLKV

SEQ ID NO: 164566 - protein, 9 aa, Homo Sapiens
ASNKSPLVL

SEQ ID NO: 164567 - protein, 9 aa, Homo Sapiens
ASNLIEVFV

SEQ ID NO: 164568 - protein, 9 aa, Homo Sapiens
ASNPAMLLY

SEQ ID NO: 164569 - protein, 9 aa, Homo Sapiens
ASNPELLNL

SEQ ID NO: 164570 - protein, 9 aa, Homo Sapiens
ASNPKILSL

SEQ ID NO: 164571 - protein, 9 aa, Homo Sapiens
ASNPRGLFV

SEQ ID NO: 164572 - protein, 9 aa, Homo Sapiens
ASNPRVTRF

SEQ ID NO: 164573 - protein, 9 aa, Homo Sapiens
ASNVMQLLL

SEQ ID NO: 164574 - protein, 9 aa, Homo Sapiens
ASNYFRAMF

SEQ ID NO: 164575 - protein, 9 aa, Homo Sapiens
ASQLYLLFL

SEQ ID NO: 164576 - protein, 9 aa, Homo Sapiens
ASQQKILSL

SEQ ID NO: 164577 - protein, 9 aa, Homo Sapiens
ASQSVQLEL

SEQ ID NO: 164578 - protein, 9 aa, Homo Sapiens
ASQYFMLLL

SEQ ID NO: 164579 - protein, 9 aa, Homo Sapiens
ASRTRITFV

SEQ ID NO: 164580 - protein, 9 aa, Homo Sapiens
ASSAAPLFF

SEQ ID NO: 164581 - protein, 9 aa, Homo Sapiens
ASSDKRLYM

SEQ ID NO: 164582 - protein, 9 aa, Homo Sapiens
ASSELERLI

SEQ ID NO: 164583 - protein, 9 aa, Homo Sapiens
ASSFVFLNL

SEQ ID NO: 164584 - protein, 9 aa, Homo Sapiens
ASSGDFLDL

SEQ ID NO: 164585 - protein, 9 aa, Homo Sapiens
ASSGDILQL

SEQ ID NO: 164586 - protein, 9 aa, Homo Sapiens
ASSGLLLMI

SEQ ID NO: 164587 - protein, 9 aa, Homo Sapiens
ASSPEHPEL

SEQ ID NO: 164588 - protein, 9 aa, Homo Sapiens
ASSPGILVL

SEQ ID NO: 164589 - protein, 9 aa, Homo Sapiens
ASSPHGLVM

SEQ ID NO: 164590 - protein, 9 aa, Homo Sapiens
ASSPIPVVI

SEQ ID NO: 164591 - protein, 9 aa, Homo Sapiens
ASSPISHFL

SEQ ID NO: 164592 - protein, 9 aa, Homo Sapiens
ASSPKFSEL

SEQ ID NO: 164593 - protein, 9 aa, Homo Sapiens
ASSPLRLWL

SEQ ID NO: 164594 - protein, 9 aa, Homo Sapiens
ASSPPHLQF

SEQ ID NO: 164595 - protein, 9 aa, Homo Sapiens
ASSRMFLLV

SEQ ID NO: 164596 - protein, 9 aa, Homo Sapiens
ASSSLPKKL

SEQ ID NO: 164597 - protein, 9 aa, Homo Sapiens
ASSSQIIHI

SEQ ID NO: 164598 - protein, 9 aa, Homo Sapiens
ASSSYDLTV

SEQ ID NO: 164599 - protein, 9 aa, Homo Sapiens
ASSSYNMVI

SEQ ID NO: 164600 - protein, 9 aa, Homo Sapiens
ASTAFNLQV

SEQ ID NO: 164601 - protein, 9 aa, Homo Sapiens
ASTALVWVV

SEQ ID NO: 164602 - protein, 9 aa, Homo Sapiens
ASTARHLYL

SEQ ID NO: 164603 - protein, 9 aa, Homo Sapiens
ASTDGHLRV

SEQ ID NO: 164604 - protein, 9 aa, Homo Sapiens
ASTEVKLRL

SEQ ID NO: 164605 - protein, 9 aa, Homo Sapiens
ASTFRLLTV

SEQ ID NO: 164606 - protein, 9 aa, Homo Sapiens
ASTILHLVV

SEQ ID NO: 164607 - protein, 9 aa, Homo Sapiens
ASTPAILFL

SEQ ID NO: 164608 - protein, 9 aa, Homo Sapiens
ASTSRLLSV

SEQ ID NO: 164609 - protein, 9 aa, Homo Sapiens
ASTSRSLAL

SEQ ID NO: 164610 - protein, 9 aa, Homo Sapiens
ASTTQHLRL

SEQ ID NO: 164611 - protein, 9 aa, Homo Sapiens
ASTVRILEV

SEQ ID NO: 164612 - protein, 9 aa, Homo Sapiens
ASTWVFPTL

SEQ ID NO: 164613 - protein, 9 aa, Homo Sapiens
ASVDKVLEL

SEQ ID NO: 164614 - protein, 9 aa, Homo Sapiens
ASVDKVTRL

SEQ ID NO: 164615 - protein, 9 aa, Homo Sapiens
ASVGRLLEL

SEQ ID NO: 164616 - protein, 9 aa, Homo Sapiens
ASVPKELYL

SEQ ID NO: 164617 - protein, 9 aa, Homo Sapiens
ASVVTVLRV

SEQ ID NO: 164618 - protein, 9 aa, Homo Sapiens
ASWDHTIRV

SEQ ID NO: 164619 - protein, 9 aa, Homo Sapiens
ASWPHIQLV

SEQ ID NO: 164620 - protein, 9 aa, Homo Sapiens
ASYEFVQRL

SEQ ID NO: 164621 - protein, 9 aa, Homo Sapiens
ASYEKKVRL

SEQ ID NO: 164622 - protein, 9 aa, Homo Sapiens
ASYFEPLIL

SEQ ID NO: 164623 - protein, 9 aa, Homo Sapiens
ASYKKAIIL

SEQ ID NO: 164624 - protein, 9 aa, Homo Sapiens
ASYPAPQEV

SEQ ID NO: 164625 - protein, 9 aa, Homo Sapiens
ASYPIPIIL

SEQ ID NO: 164626 - protein, 9 aa, Homo Sapiens
ASYSGLMRI

SEQ ID NO: 164627 - protein, 9 aa, Homo Sapiens
ASYTKALKL

SEQ ID NO: 164628 - protein, 9 aa, Homo Sapiens
ASYVNLPTI

SEQ ID NO: 164629 - protein, 9 aa, Homo Sapiens
ATAKNVLKL

SEQ ID NO: 164630 - protein, 9 aa, Homo Sapiens
ATAPPHVTV

SEQ ID NO: 164631 - protein, 9 aa, Homo Sapiens
ATASNLVKV

SEQ ID NO: 164632 - protein, 9 aa, Homo Sapiens
ATASVNLKV

SEQ ID NO: 164633 - protein, 9 aa, Homo Sapiens
ATAVVQLYL

SEQ ID NO: 164634 - protein, 9 aa, Homo Sapiens
ATDNIILTV

SEQ ID NO: 164635 - protein, 9 aa, Homo Sapiens
ATEPHVRMV

SEQ ID NO: 164636 - protein, 9 aa, Homo Sapiens
ATFDEVLEL

SEQ ID NO: 164637 - protein, 9 aa, Homo Sapiens
ATFLQISTV

SEQ ID NO: 164638 - protein, 9 aa, Homo Sapiens
ATFPKEIQM

SEQ ID NO: 164639 - protein, 9 aa, Homo Sapiens
ATHGAALTV

SEQ ID NO: 164640 - protein, 9 aa, Homo Sapiens
ATHGRFLEI

SEQ ID NO: 164641 - protein, 9 aa, Homo Sapiens
ATIARELLM

SEQ ID NO: 164642 - protein, 9 aa, Homo Sapiens
ATIDGVRFL

SEQ ID NO: 164643 - protein, 9 aa, Homo Sapiens
ATIDKVVKI

SEQ ID NO: 164644 - protein, 9 aa, Homo Sapiens
ATIKLQSTV

SEQ ID NO: 164645 - protein, 9 aa, Homo Sapiens
ATILKLLEV

SEQ ID NO: 164646 - protein, 9 aa, Homo Sapiens
ATILRELEV

SEQ ID NO: 164647 - protein, 9 aa, Homo Sapiens
ATIRKALRL

SEQ ID NO: 164648 - protein, 9 aa, Homo Sapiens
ATISSPLEL

SEQ ID NO: 164649 - protein, 9 aa, Homo Sapiens
ATISYILTL

SEQ ID NO: 164650 - protein, 9 aa, Homo Sapiens
ATKIVFLTV

SEQ ID NO: 164651 - protein, 9 aa, Homo Sapiens
ATLEKVIEI

SEQ ID NO: 164652 - protein, 9 aa, Homo Sapiens
ATLGATLKL

SEQ ID NO: 164653 - protein, 9 aa, Homo Sapiens
ATLHLLLTL

SEQ ID NO: 164654 - protein, 9 aa, Homo Sapiens
ATLKLQSEL

SEQ ID NO: 164655 - protein, 9 aa, Homo Sapiens
ATLNSFIHV

SEQ ID NO: 164656 - protein, 9 aa, Homo Sapiens
ATLQLSLKL

SEQ ID NO: 164657 - protein, 9 aa, Homo Sapiens
ATLTRPLAL

SEQ ID NO: 164658 - protein, 9 aa, Homo Sapiens
ATMGHWILL

SEQ ID NO: 164659 - protein, 9 aa, Homo Sapiens
ATMKDFTSL

SEQ ID NO: 164660 - protein, 9 aa, Homo Sapiens
ATMKRMLSL

SEQ ID NO: 164661 - protein, 9 aa, Homo Sapiens
ATMPVTMLI

SEQ ID NO: 164662 - protein, 9 aa, Homo Sapiens
ATMPVVPSV

SEQ ID NO: 164663 - protein, 9 aa, Homo Sapiens
ATNAAVTVL

SEQ ID NO: 164664 - protein, 9 aa, Homo Sapiens
ATNHKVLLF

SEQ ID NO: 164665 - protein, 9 aa, Homo Sapiens
ATNHRVLLF

SEQ ID NO: 164666 - protein, 9 aa, Homo Sapiens
ATNLLKLFL

SEQ ID NO: 164667 - protein, 9 aa, Homo Sapiens
ATNNLMKLV

SEQ ID NO: 164668 - protein, 9 aa, Homo Sapiens
ATNPEHLEI

SEQ ID NO: 164669 - protein, 9 aa, Homo Sapiens
ATNPISRVL

SEQ ID NO: 164670 - protein, 9 aa, Homo Sapiens
ATNPKPVKL

SEQ ID NO: 164671 - protein, 9 aa, Homo Sapiens
ATNVVRLLL

SEQ ID NO: 164672 - protein, 9 aa, Homo Sapiens
ATQTQFFHV

SEQ ID NO: 164673 - protein, 9 aa, Homo Sapiens
ATSGDYLRV

SEQ ID NO: 164674 - protein, 9 aa, Homo Sapiens
ATSPTVLYV

SEQ ID NO: 164675 - protein, 9 aa, Homo Sapiens
ATTDLLTKL

SEQ ID NO: 164676 - protein, 9 aa, Homo Sapiens
ATTVRPVFL

SEQ ID NO: 164677 - protein, 9 aa, Homo Sapiens
ATVKIIQML

SEQ ID NO: 164678 - protein, 9 aa, Homo Sapiens
ATVKRVNIL

SEQ ID NO: 164679 - protein, 9 aa, Homo Sapiens
ATVPFLLQL

SEQ ID NO: 164680 - protein, 9 aa, Homo Sapiens
ATVPGLLKV

SEQ ID NO: 164681 - protein, 9 aa, Homo Sapiens
ATVPIRLII

SEQ ID NO: 164682 - protein, 9 aa, Homo Sapiens
ATVPKVTVI

SEQ ID NO: 164683 - protein, 9 aa, Homo Sapiens
ATVPNALEF

SEQ ID NO: 164684 - protein, 9 aa, Homo Sapiens
ATVPNTIVV

SEQ ID NO: 164685 - protein, 9 aa, Homo Sapiens
ATVQRLPEL

SEQ ID NO: 164686 - protein, 9 aa, Homo Sapiens
ATVTQMHFL

SEQ ID NO: 164687 - protein, 9 aa, Homo Sapiens
ATVTSYLKL

SEQ ID NO: 164688 - protein, 9 aa, Homo Sapiens
ATVVTQLLV

SEQ ID NO: 164689 - protein, 9 aa, Homo Sapiens
ATYEDIVTL

SEQ ID NO: 164690 - protein, 9 aa, Homo Sapiens
ATYHHIIRL

SEQ ID NO: 164691 - protein, 9 aa, Homo Sapiens
ATYHRAIKV

SEQ ID NO: 164692 - protein, 9 aa, Homo Sapiens
ATYIFLQTF

SEQ ID NO: 164693 - protein, 9 aa, Homo Sapiens
ATYLRFIIV

SEQ ID NO: 164694 - protein, 9 aa, Homo Sapiens
ATYNFSQSL

SEQ ID NO: 164695 - protein, 9 aa, Homo Sapiens
ATYVFLHTV

SEQ ID NO: 164696 - protein, 9 aa, Homo Sapiens
AVAQYALFL

SEQ ID NO: 164697 - protein, 9 aa, Homo Sapiens
AVFGVPLIV

SEQ ID NO: 164698 - protein, 9 aa, Homo Sapiens
AVFPHLTVV

SEQ ID NO: 164699 - protein, 9 aa, Homo Sapiens
AVGPVHNSV

SEQ ID NO: 164700 - protein, 9 aa, Homo Sapiens
AVHNVPLSV

SEQ ID NO: 164701 - protein, 9 aa, Homo Sapiens
AVIGNFLYV

SEQ ID NO: 164702 - protein, 9 aa, Homo Sapiens
AVINRVQKV

SEQ ID NO: 164703 - protein, 9 aa, Homo Sapiens
AVMKQFAFV

SEQ ID NO: 164704 - protein, 9 aa, Homo Sapiens
AVNDHVLKV

SEQ ID NO: 164705 - protein, 9 aa, Homo Sapiens
AVNGKFVYV

SEQ ID NO: 164706 - protein, 9 aa, Homo Sapiens
AVNNFLLKV

SEQ ID NO: 164707 - protein, 9 aa, Homo Sapiens
AVNPHLFSL

SEQ ID NO: 164708 - protein, 9 aa, Homo Sapiens
AVNPLLRVI

SEQ ID NO: 164709 - protein, 9 aa, Homo Sapiens
AVTNMFLTV

SEQ ID NO: 164710 - protein, 9 aa, Homo Sapiens
AVVPKILTV

SEQ ID NO: 164711 - protein, 9 aa, Homo Sapiens
CSSPHALVL

SEQ ID NO: 164712 - protein, 9 aa, Homo Sapiens
DIRGKLLQV

SEQ ID NO: 164713 - protein, 9 aa, Homo Sapiens
DTNADKQLS

SEQ ID NO: 164714 - protein, 9 aa, Homo Sapiens
EALHYMLLV

SEQ ID NO: 164715 - protein, 9 aa, Homo Sapiens
ENGIKPVYV

SEQ ID NO: 164716 - protein, 9 aa, Homo Sapiens
ERTPHFALV

SEQ ID NO: 164717 - protein, 9 aa, Homo Sapiens
ESIPIRLFL

SEQ ID NO: 164718 - protein, 9 aa, Homo Sapiens
ESNHLLLMV

SEQ ID NO: 164719 - protein, 9 aa, Homo Sapiens
ESNTIHLKV

SEQ ID NO: 164720 - protein, 9 aa, Homo Sapiens
ESNVQILKL

SEQ ID NO: 164721 - protein, 9 aa, Homo Sapiens
ESYGNPLRV

SEQ ID NO: 164722 - protein, 9 aa, Homo Sapiens
ETNPSILEV

SEQ ID NO: 164723 - protein, 9 aa, Homo Sapiens
FADGHVLEL

SEQ ID NO: 164724 - protein, 9 aa, Homo Sapiens
FADKHIQVL

SEQ ID NO: 164725 - protein, 9 aa, Homo Sapiens
FAFRNFLYL

SEQ ID NO: 164726 - protein, 9 aa, Homo Sapiens
FAIDPHLLL

SEQ ID NO: 164727 - protein, 9 aa, Homo Sapiens
FAIKSLRKL

SEQ ID NO: 164728 - protein, 9 aa, Homo Sapiens
FALRVQQLV

SEQ ID NO: 164729 - protein, 9 aa, Homo Sapiens
FAMPYFIQV

SEQ ID NO: 164730 - protein, 9 aa, Homo Sapiens
FANNVQLSL

SEQ ID NO: 164731 - protein, 9 aa, Homo Sapiens
FASGLIHRV

SEQ ID NO: 164732 - protein, 9 aa, Homo Sapiens
FASHVSPEV

SEQ ID NO: 164733 - protein, 9 aa, Homo Sapiens
FATGVWHQM

SEQ ID NO: 164734 - protein, 9 aa, Homo Sapiens
FAYKNVKFV

SEQ ID NO: 164735 - protein, 9 aa, Homo Sapiens
FAYPAIRYL

SEQ ID NO: 164736 - protein, 9 aa, Homo Sapiens
FAYPAPLEV

SEQ ID NO: 164737 - protein, 9 aa, Homo Sapiens
FAYRGFKYL

SEQ ID NO: 164738 - protein, 9 aa, Homo Sapiens
FAYTARISV

SEQ ID NO: 164739 - protein, 9 aa, Homo Sapiens
FGNGFVLYV

SEQ ID NO: 164740 - protein, 9 aa, Homo Sapiens
FGNVVELRI

SEQ ID NO: 164741 - protein, 9 aa, Homo Sapiens
FGQRHRLLL

SEQ ID NO: 164742 - protein, 9 aa, Homo Sapiens
FGQRHRLVL

SEQ ID NO: 164743 - protein, 9 aa, Homo Sapiens
FGTIVNIQV

SEQ ID NO: 164744 - protein, 9 aa, Homo Sapiens
FGTKWMMFL

SEQ ID NO: 164745 - protein, 9 aa, Homo Sapiens
FINSRIITV

SEQ ID NO: 164746 - protein, 9 aa, Homo Sapiens
FLNKLVILV

SEQ ID NO: 164747 - protein, 9 aa, Homo Sapiens
FLTAAKKAR

SEQ ID NO: 164748 - protein, 9 aa, Homo Sapiens
FMNPHLISV

SEQ ID NO: 164749 - protein, 9 aa, Homo Sapiens
FNFFAPPEV

SEQ ID NO: 164750 - protein, 9 aa, Homo Sapiens
FNFFNPLKA

SEQ ID NO: 164751 - protein, 9 aa, Homo Sapiens
FNGAPVLYL

SEQ ID NO: 164752 - protein, 9 aa, Homo Sapiens
FNHPNILRL

SEQ ID NO: 164753 - protein, 9 aa, Homo Sapiens
FNIDKAREI

SEQ ID NO: 164754 - protein, 9 aa, Homo Sapiens
FNIDRLQEL

SEQ ID NO: 164755 - protein, 9 aa, Homo Sapiens
FNIEKGRLV

SEQ ID NO: 164756 - protein, 9 aa, Homo Sapiens
FNLSRIVTL

SEQ ID NO: 164757 - protein, 9 aa, Homo Sapiens
FNNGWMIKI

SEQ ID NO: 164758 - protein, 9 aa, Homo Sapiens
FNQERIVDV

SEQ ID NO: 164759 - protein, 9 aa, Homo Sapiens
FNQKFFQEL

SEQ ID NO: 164760 - protein, 9 aa, Homo Sapiens
FNRWFAEKF

SEQ ID NO: 164761 - protein, 9 aa, Homo Sapiens
FNSKQLLYL

SEQ ID NO: 164762 - protein, 9 aa, Homo Sapiens
FNSNVMVKV

SEQ ID NO: 164763 - protein, 9 aa, Homo Sapiens
FNSPRNLAM

SEQ ID NO: 164764 - protein, 9 aa, Homo Sapiens
FNTASALHL

SEQ ID NO: 164765 - protein, 9 aa, Homo Sapiens
FNTWKPMWV

SEQ ID NO: 164766 - protein, 9 aa, Homo Sapiens
FNVPAFLTV

SEQ ID NO: 164767 - protein, 9 aa, Homo Sapiens
FNWGRVVAL

SEQ ID NO: 164768 - protein, 9 aa, Homo Sapiens
FNYKSILIV

SEQ ID NO: 164769 - protein, 9 aa, Homo Sapiens
FQDPVPLTV

SEQ ID NO: 164770 - protein, 9 aa, Homo Sapiens
FQIGKMRYV

SEQ ID NO: 164771 - protein, 9 aa, Homo Sapiens
FQNDFLRLL

SEQ ID NO: 164772 - protein, 9 aa, Homo Sapiens
FQNIRPLFI

SEQ ID NO: 164773 - protein, 9 aa, Homo Sapiens
FQNLKVLLV

SEQ ID NO: 164774 - protein, 9 aa, Homo Sapiens
FQNVKQLYA

SEQ ID NO: 164775 - protein, 9 aa, Homo Sapiens
FQYPDTRYL

SEQ ID NO: 164776 - protein, 9 aa, Homo Sapiens
FSAGTFLYV

SEQ ID NO: 164777 - protein, 9 aa, Homo Sapiens
FSALRFLVV

SEQ ID NO: 164778 - protein, 9 aa, Homo Sapiens
FSAPSALRV

SEQ ID NO: 164779 - protein, 9 aa, Homo Sapiens
FSEGGERLL

SEQ ID NO: 164780 - protein, 9 aa, Homo Sapiens
FSEPFHLIV

SEQ ID NO: 164781 - protein, 9 aa, Homo Sapiens
FSESHLVII

SEQ ID NO: 164782 - protein, 9 aa, Homo Sapiens
FSFHHVLSL

SEQ ID NO: 164783 - protein, 9 aa, Homo Sapiens
FSFKKPFKL

SEQ ID NO: 164784 - protein, 9 aa, Homo Sapiens
FSFKKSFKL

SEQ ID NO: 164785 - protein, 9 aa, Homo Sapiens
FSFQRPLLV

SEQ ID NO: 164786 - protein, 9 aa, Homo Sapiens
FSFYFHEAL

SEQ ID NO: 164787 - protein, 9 aa, Homo Sapiens
FSHAQTVVL

SEQ ID NO: 164788 - protein, 9 aa, Homo Sapiens
FSHGQVVSL

SEQ ID NO: 164789 - protein, 9 aa, Homo Sapiens
FSHTVNLIV

SEQ ID NO: 164790 - protein, 9 aa, Homo Sapiens
FSIDPDLLV

SEQ ID NO: 164791 - protein, 9 aa, Homo Sapiens
FSIDRALNV

SEQ ID NO: 164792 - protein, 9 aa, Homo Sapiens
FSIEPWLKV

SEQ ID NO: 164793 - protein, 9 aa, Homo Sapiens
FSIKHPHTL

SEQ ID NO: 164794 - protein, 9 aa, Homo Sapiens
FSIKKIRFL

SEQ ID NO: 164795 - protein, 9 aa, Homo Sapiens
FSIKKTKQL

SEQ ID NO: 164796 - protein, 9 aa, Homo Sapiens
FSIKMFLTV

SEQ ID NO: 164797 - protein, 9 aa, Homo Sapiens
FSINVGHMV

SEQ ID NO: 164798 - protein, 9 aa, Homo Sapiens
FSIPDSLLI

SEQ ID NO: 164799 - protein, 9 aa, Homo Sapiens
FSIPILMQL

SEQ ID NO: 164800 - protein, 9 aa, Homo Sapiens
FSIPVVSDV

SEQ ID NO: 164801 - protein, 9 aa, Homo Sapiens
FSIRYQYLL

SEQ ID NO: 164802 - protein, 9 aa, Homo Sapiens
FSITPLSEL

SEQ ID NO: 164803 - protein, 9 aa, Homo Sapiens
FSKTEELNR

SEQ ID NO: 164804 - protein, 9 aa, Homo Sapiens
FSLDLVHTL

SEQ ID NO: 164805 - protein, 9 aa, Homo Sapiens
FSLDNARQV

SEQ ID NO: 164806 - protein, 9 aa, Homo Sapiens
FSLGVPRLI

SEQ ID NO: 164807 - protein, 9 aa, Homo Sapiens
FSNAGILKM

SEQ ID NO: 164808 - protein, 9 aa, Homo Sapiens
FSNDIPHVV

SEQ ID NO: 164809 - protein, 9 aa, Homo Sapiens
FSNGHIKVL

SEQ ID NO: 164810 - protein, 9 aa, Homo Sapiens
FSNPETLDL

SEQ ID NO: 164811 - protein, 9 aa, Homo Sapiens
FSNPNIQKI

SEQ ID NO: 164812 - protein, 9 aa, Homo Sapiens
FSNPRALYL

SEQ ID NO: 164813 - protein, 9 aa, Homo Sapiens
FSNVFEHYL

SEQ ID NO: 164814 - protein, 9 aa, Homo Sapiens
FSNVMIHVV

SEQ ID NO: 164815 - protein, 9 aa, Homo Sapiens
FSQKSFLVL

SEQ ID NO: 164816 - protein, 9 aa, Homo Sapiens
FSQPRHISV

SEQ ID NO: 164817 - protein, 9 aa, Homo Sapiens
FSQRTSLIV

SEQ ID NO: 164818 - protein, 9 aa, Homo Sapiens
FSREEFPTL

SEQ ID NO: 164819 - protein, 9 aa, Homo Sapiens
FSSDFTLKI

SEQ ID NO: 164820 - protein, 9 aa, Homo Sapiens
FSSDVTHEM

SEQ ID NO: 164821 - protein, 9 aa, Homo Sapiens
FSSHILVVV

SEQ ID NO: 164822 - protein, 9 aa, Homo Sapiens
FSSPHLVQV

SEQ ID NO: 164823 - protein, 9 aa, Homo Sapiens
FSSSYITAI

SEQ ID NO: 164824 - protein, 9 aa, Homo Sapiens
FSSWVQLEV

SEQ ID NO: 164825 - protein, 9 aa, Homo Sapiens
FSTASIMHL

SEQ ID NO: 164826 - protein, 9 aa, Homo Sapiens
FSTLFLETV

SEQ ID NO: 164827 - protein, 9 aa, Homo Sapiens
FSTSLVHSI

SEQ ID NO: 164828 - protein, 9 aa, Homo Sapiens
FSTTVIQNV

SEQ ID NO: 164829 - protein, 9 aa, Homo Sapiens
FSTVVIHFL

SEQ ID NO: 164830 - protein, 9 aa, Homo Sapiens
FSVGGLLKL

SEQ ID NO: 164831 - protein, 9 aa, Homo Sapiens
FSVNLFRTL

SEQ ID NO: 164832 - protein, 9 aa, Homo Sapiens
FSVPVKQEV

SEQ ID NO: 164833 - protein, 9 aa, Homo Sapiens
FSVVPSPKV

SEQ ID NO: 164834 - protein, 9 aa, Homo Sapiens
FSWKGINFV

SEQ ID NO: 164835 - protein, 9 aa, Homo Sapiens
FSYAFPKAV

SEQ ID NO: 164836 - protein, 9 aa, Homo Sapiens
FSYKDFDTL

SEQ ID NO: 164837 - protein, 9 aa, Homo Sapiens
FTAKFPLYM

SEQ ID NO: 164838 - protein, 9 aa, Homo Sapiens
FTAWRILEV

SEQ ID NO: 164839 - protein, 9 aa, Homo Sapiens
FTEKSGRLL

SEQ ID NO: 164840 - protein, 9 aa, Homo Sapiens
FTFKRIGYL

SEQ ID NO: 164841 - protein, 9 aa, Homo Sapiens
FTHDWMVFV

SEQ ID NO: 164842 - protein, 9 aa, Homo Sapiens
FTHLYTLIV

SEQ ID NO: 164843 - protein, 9 aa, Homo Sapiens
FTHSQFIVV

SEQ ID NO: 164844 - protein, 9 aa, Homo Sapiens
FTIFKAMMV

SEQ ID NO: 164845 - protein, 9 aa, Homo Sapiens
FTIFRTISV

SEQ ID NO: 164846 - protein, 9 aa, Homo Sapiens
FTISDPKLV

SEQ ID NO: 164847 - protein, 9 aa, Homo Sapiens
FTKTEELNR

SEQ ID NO: 164848 - protein, 9 aa, Homo Sapiens
FTLKKLLLL

SEQ ID NO: 164849 - protein, 9 aa, Homo Sapiens
FTLKTVLMI

SEQ ID NO: 164850 - protein, 9 aa, Homo Sapiens
FTLSHITQL

SEQ ID NO: 164851 - protein, 9 aa, Homo Sapiens
FTMKTVLML

SEQ ID NO: 164852 - protein, 9 aa, Homo Sapiens
FTNDKIINL

SEQ ID NO: 164853 - protein, 9 aa, Homo Sapiens
FTNGQTVNL

SEQ ID NO: 164854 - protein, 9 aa, Homo Sapiens
FTNRTVLEL

SEQ ID NO: 164855 - protein, 9 aa, Homo Sapiens
FTNTIKLIV

SEQ ID NO: 164856 - protein, 9 aa, Homo Sapiens
FTQKNILLV

SEQ ID NO: 164857 - protein, 9 aa, Homo Sapiens
FTRKGVLRV

SEQ ID NO: 164858 - protein, 9 aa, Homo Sapiens
FTSDIALRL

SEQ ID NO: 164859 - protein, 9 aa, Homo Sapiens
FTSPFCLQV

SEQ ID NO: 164860 - protein, 9 aa, Homo Sapiens
FTTSNIRKV

SEQ ID NO: 164861 - protein, 9 aa, Homo Sapiens
FTVDQIRAI

SEQ ID NO: 164862 - protein, 9 aa, Homo Sapiens
FTVKLRLLV

SEQ ID NO: 164863 - protein, 9 aa, Homo Sapiens
FTYHHIQEI

SEQ ID NO: 164864 - protein, 9 aa, Homo Sapiens
FTYKGLRAL

SEQ ID NO: 164865 - protein, 9 aa, Homo Sapiens
FTYNPFMRV

SEQ ID NO: 164866 - protein, 9 aa, Homo Sapiens
FVNDYILYY

SEQ ID NO: 164867 - protein, 9 aa, Homo Sapiens
GANEVLLVV

SEQ ID NO: 164868 - protein, 9 aa, Homo Sapiens
GAQLHQLVL

SEQ ID NO: 164869 - protein, 9 aa, Homo Sapiens
GAYKYIQEL

SEQ ID NO: 164870 - protein, 9 aa, Homo Sapiens
GAYTKILEV

SEQ ID NO: 164871 - protein, 9 aa, Homo Sapiens
GIMDRFLQV

SEQ ID NO: 164872 - protein, 9 aa, Homo Sapiens
GINPHVLQI

SEQ ID NO: 164873 - protein, 9 aa, Homo Sapiens
GIYTGFIKV

SEQ ID NO: 164874 - protein, 9 aa, Homo Sapiens
GKELPILQV

SEQ ID NO: 164875 - protein, 9 aa, Homo Sapiens
GLNTIPLFV

SEQ ID NO: 164876 - protein, 9 aa, Homo Sapiens
GNFFSPKVV

SEQ ID NO: 164877 - protein, 9 aa, Homo Sapiens
GNSGHFTII

SEQ ID NO: 164878 - protein, 9 aa, Homo Sapiens
GSDPRVTQL

SEQ ID NO: 164879 - protein, 9 aa, Homo Sapiens
GSFGKAILV

SEQ ID NO: 164880 - protein, 9 aa, Homo Sapiens
GSFGKVFLV

SEQ ID NO: 164881 - protein, 9 aa, Homo Sapiens
GSFGRVMLV

SEQ ID NO: 164882 - protein, 9 aa, Homo Sapiens
GSFHFDYEV

SEQ ID NO: 164883 - protein, 9 aa, Homo Sapiens
GSIPRSLEV

SEQ ID NO: 164884 - protein, 9 aa, Homo Sapiens
GSISGITMV

SEQ ID NO: 164885 - protein, 9 aa, Homo Sapiens
GSIWKQLYV

SEQ ID NO: 164886 - protein, 9 aa, Homo Sapiens
GSLPTILHV

SEQ ID NO: 164887 - protein, 9 aa, Homo Sapiens
GSLVHISYL

SEQ ID NO: 164888 - protein, 9 aa, Homo Sapiens
GSNLFKLEV

SEQ ID NO: 164889 - protein, 9 aa, Homo Sapiens
GSNPLKREI

SEQ ID NO: 164890 - protein, 9 aa, Homo Sapiens
GSNVKIVKV

SEQ ID NO: 164891 - protein, 9 aa, Homo Sapiens
GSSDRILEL

SEQ ID NO: 164892 - protein, 9 aa, Homo Sapiens
GSTDHIIRV

SEQ ID NO: 164893 - protein, 9 aa, Homo Sapiens
GSTEKVLRV

SEQ ID NO: 164894 - protein, 9 aa, Homo Sapiens
GSTRIITRL

SEQ ID NO: 164895 - protein, 9 aa, Homo Sapiens
GSTTVFHSL

SEQ ID NO: 164896 - protein, 9 aa, Homo Sapiens
GSVHIVHRL

SEQ ID NO: 164897 - protein, 9 aa, Homo Sapiens
GSVNRVTIL

SEQ ID NO: 164898 - protein, 9 aa, Homo Sapiens
GSVSNPLFL

SEQ ID NO: 164899 - protein, 9 aa, Homo Sapiens
GSVTVYYEV

SEQ ID NO: 164900 - protein, 9 aa, Homo Sapiens
GSWDGTLRL

SEQ ID NO: 164901 - protein, 9 aa, Homo Sapiens
GSYAKVLLV

SEQ ID NO: 164902 - protein, 9 aa, Homo Sapiens
GSYDKSVAL

SEQ ID NO: 164903 - protein, 9 aa, Homo Sapiens
GSYHRIRAL

SEQ ID NO: 164904 - protein, 9 aa, Homo Sapiens
GSYPQELIV

SEQ ID NO: 164905 - protein, 9 aa, Homo Sapiens
GSYVFENTV

SEQ ID NO: 164906 - protein, 9 aa, Homo Sapiens
GTFGKVILV

SEQ ID NO: 164907 - protein, 9 aa, Homo Sapiens
GTFLFLAEV

SEQ ID NO: 164908 - protein, 9 aa, Homo Sapiens
GTIGLIHAV

SEQ ID NO: 164909 - protein, 9 aa, Homo Sapiens
GTIKKFLSL

SEQ ID NO: 164910 - protein, 9 aa, Homo Sapiens
GTIMRVVEL

SEQ ID NO: 164911 - protein, 9 aa, Homo Sapiens
GTIPWFMEI

SEQ ID NO: 164912 - protein, 9 aa, Homo Sapiens
GTLNVFQTV

SEQ ID NO: 164913 - protein, 9 aa, Homo Sapiens
GTNFRVLLV

SEQ ID NO: 164914 - protein, 9 aa, Homo Sapiens
GTNFRVLWV

SEQ ID NO: 164915 - protein, 9 aa, Homo Sapiens
GTTDHVIVL

SEQ ID NO: 164916 - protein, 9 aa, Homo Sapiens
GTVPTPLVV

SEQ ID NO: 164917 - protein, 9 aa, Homo Sapiens
GTYTGFIKV

SEQ ID NO: 164918 - protein, 9 aa, Homo Sapiens
GVNVTQVFV

SEQ ID NO: 164919 - protein, 9 aa, Homo Sapiens
HAAKVILQV

SEQ ID NO: 164920 - protein, 9 aa, Homo Sapiens
HAASVFLTL

SEQ ID NO: 164921 - protein, 9 aa, Homo Sapiens
HAIHKVLQL

SEQ ID NO: 164922 - protein, 9 aa, Homo Sapiens
HAIQKYLEI

SEQ ID NO: 164923 - protein, 9 aa, Homo Sapiens
HANAKKILL

SEQ ID NO: 164924 - protein, 9 aa, Homo Sapiens
HANPILLLV

SEQ ID NO: 164925 - protein, 9 aa, Homo Sapiens
HAQPHHLLL

SEQ ID NO: 164926 - protein, 9 aa, Homo Sapiens
HAQTVVLCV

SEQ ID NO: 164927 - protein, 9 aa, Homo Sapiens
HASPGVLVV

SEQ ID NO: 164928 - protein, 9 aa, Homo Sapiens
HATLVFHNL

SEQ ID NO: 164929 - protein, 9 aa, Homo Sapiens
HAVHVALVL

SEQ ID NO: 164930 - protein, 9 aa, Homo Sapiens
HAVQYFLHV

SEQ ID NO: 164931 - protein, 9 aa, Homo Sapiens
HEGLPEPLT

SEQ ID NO: 164932 - protein, 9 aa, Homo Sapiens
HGLHRILVV

SEQ ID NO: 164933 - protein, 9 aa, Homo Sapiens
HGNWIRLYL

SEQ ID NO: 164934 - protein, 9 aa, Homo Sapiens
HIIEDALVV

SEQ ID NO: 164935 - protein, 9 aa, Homo Sapiens
HIIFHITLV

SEQ ID NO: 164936 - protein, 9 aa, Homo Sapiens
HILPHPVVV

SEQ ID NO: 164937 - protein, 9 aa, Homo Sapiens
HILTKILYL

SEQ ID NO: 164938 - protein, 9 aa, Homo Sapiens
HINIGALEL

SEQ ID NO: 164939 - protein, 9 aa, Homo Sapiens
HIPEVYLIV

SEQ ID NO: 164940 - protein, 9 aa, Homo Sapiens
HIVQKFLIL

SEQ ID NO: 164941 - protein, 9 aa, Homo Sapiens
HLTDITLKV

SEQ ID NO: 164942 - protein, 9 aa, Homo Sapiens
HLTPVTLEL

SEQ ID NO: 164943 - protein, 9 aa, Homo Sapiens
HMHIHISTV

SEQ ID NO: 164944 - protein, 9 aa, Homo Sapiens
HMSTVFLTL

SEQ ID NO: 164945 - protein, 9 aa, Homo Sapiens
HNADQPLRV

SEQ ID NO: 164946 - protein, 9 aa, Homo Sapiens
HNAGISFSV

SEQ ID NO: 164947 - protein, 9 aa, Homo Sapiens
HNEGYILEL

SEQ ID NO: 164948 - protein, 9 aa, Homo Sapiens
HNGIIFQFV

SEQ ID NO: 164949 - protein, 9 aa, Homo Sapiens
HNIAYQLQL

SEQ ID NO: 164950 - protein, 9 aa, Homo Sapiens
HNIGQTCCL

SEQ ID NO: 164951 - protein, 9 aa, Homo Sapiens
HNINRPLTM

SEQ ID NO: 164952 - protein, 9 aa, Homo Sapiens
HNISLVAQL

SEQ ID NO: 164953 - protein, 9 aa, Homo Sapiens
HNIWVILVV

SEQ ID NO: 164954 - protein, 9 aa, Homo Sapiens
HNLGRFITV

SEQ ID NO: 164955 - protein, 9 aa, Homo Sapiens
HNLISLLEV

SEQ ID NO: 164956 - protein, 9 aa, Homo Sapiens
HNLSKIMKL

SEQ ID NO: 164957 - protein, 9 aa, Homo Sapiens
HNLVHLLLL

SEQ ID NO: 164958 - protein, 9 aa, Homo Sapiens
HNNIIVLIV

SEQ ID NO: 164959 - protein, 9 aa, Homo Sapiens
HNQFIPLQV

SEQ ID NO: 164960 - protein, 9 aa, Homo Sapiens
HNSGVPVYL

SEQ ID NO: 164961 - protein, 9 aa, Homo Sapiens
HNSNIIKKL

SEQ ID NO: 164962 - protein, 9 aa, Homo Sapiens
HNVDIVLQV

SEQ ID NO: 164963 - protein, 9 aa, Homo Sapiens
HNVNRVVYI

SEQ ID NO: 164964 - protein, 9 aa, Homo Sapiens
HNYLQNVSM

SEQ ID NO: 164965 - protein, 9 aa, Homo Sapiens
HPDSHQLFI

SEQ ID NO: 164966 - protein, 9 aa, Homo Sapiens
HPNSAVLMV

SEQ ID NO: 164967 - protein, 9 aa, Homo Sapiens
HQIFHVLVV

SEQ ID NO: 164968 - protein, 9 aa, Homo Sapiens
HQMWHVRKL

SEQ ID NO: 164969 - protein, 9 aa, Homo Sapiens
HQNHLIVKV

SEQ ID NO: 164970 - protein, 9 aa, Homo Sapiens
HQTPLHLAV

SEQ ID NO: 164971 - protein, 9 aa, Homo Sapiens
HSAELALNV

SEQ ID NO: 164972 - protein, 9 aa, Homo Sapiens
HSAFIILLL

SEQ ID NO: 164973 - protein, 9 aa, Homo Sapiens
HSATPFLKV

SEQ ID NO: 164974 - protein, 9 aa, Homo Sapiens
HSAYTTLLL

SEQ ID NO: 164975 - protein, 9 aa, Homo Sapiens
HSDDYIKFL

SEQ ID NO: 164976 - protein, 9 aa, Homo Sapiens
HSDEYIKFL

SEQ ID NO: 164977 - protein, 9 aa, Homo Sapiens
HSETHLLYV

SEQ ID NO: 164978 - protein, 9 aa, Homo Sapiens
HSFFKISYL

SEQ ID NO: 164979 - protein, 9 aa, Homo Sapiens
HSFGHLKEV

SEQ ID NO: 164980 - protein, 9 aa, Homo Sapiens
HSFNIPMQL

SEQ ID NO: 164981 - protein, 9 aa, Homo Sapiens
HSFNVPMQL

SEQ ID NO: 164982 - protein, 9 aa, Homo Sapiens
HSFYNELRV

SEQ ID NO: 164983 - protein, 9 aa, Homo Sapiens
HSGPIHVLL

SEQ ID NO: 164984 - protein, 9 aa, Homo Sapiens
HSGPVVAMV

SEQ ID NO: 164985 - protein, 9 aa, Homo Sapiens
HSHHFLELV

SEQ ID NO: 164986 - protein, 9 aa, Homo Sapiens
HSHPRVVEL

SEQ ID NO: 164987 - protein, 9 aa, Homo Sapiens
HSIHWPCRL

SEQ ID NO: 164988 - protein, 9 aa, Homo Sapiens
HSIPVTVEV

SEQ ID NO: 164989 - protein, 9 aa, Homo Sapiens
HSISIPTKL

SEQ ID NO: 164990 - protein, 9 aa, Homo Sapiens
HSLDHLLKL

SEQ ID NO: 164991 - protein, 9 aa, Homo Sapiens
HSLDVIAFL

SEQ ID NO: 164992 - protein, 9 aa, Homo Sapiens
HSLIKVLRL

SEQ ID NO: 164993 - protein, 9 aa, Homo Sapiens
HSLPFELAL

SEQ ID NO: 164994 - protein, 9 aa, Homo Sapiens
HSLPLLLFI

SEQ ID NO: 164995 - protein, 9 aa, Homo Sapiens
HSLQHLLYV

SEQ ID NO: 164996 - protein, 9 aa, Homo Sapiens
HSLSFETQL

SEQ ID NO: 164997 - protein, 9 aa, Homo Sapiens
HSMSQPIMV

SEQ ID NO: 164998 - protein, 9 aa, Homo Sapiens
HSNEVIMTI

SEQ ID NO: 164999 - protein, 9 aa, Homo Sapiens
HSNSVPLAL

SEQ ID NO: 165000 - protein, 9 aa, Homo Sapiens
HSQLMRLMV

SEQ ID NO: 165001 - protein, 9 aa, Homo Sapiens
HSQQHVLVM

SEQ ID NO: 165002 - protein, 9 aa, Homo Sapiens
HSRFIFNYV

SEQ ID NO: 165003 - protein, 9 aa, Homo Sapiens
HSSIRSLEV

SEQ ID NO: 165004 - protein, 9 aa, Homo Sapiens
HSSSHIFKL

SEQ ID NO: 165005 - protein, 9 aa, Homo Sapiens
HSTDRVVLI

SEQ ID NO: 165006 - protein, 9 aa, Homo Sapiens
HSTIHLLKL

SEQ ID NO: 165007 - protein, 9 aa, Homo Sapiens
HSTNVLLSL

SEQ ID NO: 165008 - protein, 9 aa, Homo Sapiens
HSTVHLIEF

SEQ ID NO: 165009 - protein, 9 aa, Homo Sapiens
HSTYVFLMV

SEQ ID NO: 165010 - protein, 9 aa, Homo Sapiens
HSVDQYLNI

SEQ ID NO: 165011 - protein, 9 aa, Homo Sapiens
HSVPAPQHL

SEQ ID NO: 165012 - protein, 9 aa, Homo Sapiens
HSVPLQLEL

SEQ ID NO: 165013 - protein, 9 aa, Homo Sapiens
HSVPVVTVV

SEQ ID NO: 165014 - protein, 9 aa, Homo Sapiens
HSVSQPIMV

SEQ ID NO: 165015 - protein, 9 aa, Homo Sapiens
HSYADMREL

SEQ ID NO: 165016 - protein, 9 aa, Homo Sapiens
HTDTTVKFV

SEQ ID NO: 165017 - protein, 9 aa, Homo Sapiens
HTFYNELRV

SEQ ID NO: 165018 - protein, 9 aa, Homo Sapiens
HTIDTILTV

SEQ ID NO: 165019 - protein, 9 aa, Homo Sapiens
HTMDPQLRL

SEQ ID NO: 165020 - protein, 9 aa, Homo Sapiens
HTNIHLLVT

SEQ ID NO: 165021 - protein, 9 aa, Homo Sapiens
HTQIVRLLV

SEQ ID NO: 165022 - protein, 9 aa, Homo Sapiens
HTQNVPLSV

SEQ ID NO: 165023 - protein, 9 aa, Homo Sapiens
HTTAAFIRV

SEQ ID NO: 165024 - protein, 9 aa, Homo Sapiens
HTVGFILQL

SEQ ID NO: 165025 - protein, 9 aa, Homo Sapiens
HVITKTMEL

SEQ ID NO: 165026 - protein, 9 aa, Homo Sapiens
HVYPDHRLV

SEQ ID NO: 165027 - protein, 9 aa, Homo Sapiens
IAAKKVLRL

SEQ ID NO: 165028 - protein, 9 aa, Homo Sapiens
IAFYHKMEM

SEQ ID NO: 165029 - protein, 9 aa, Homo Sapiens
IAIGKVLKL

SEQ ID NO: 165030 - protein, 9 aa, Homo Sapiens
IANHQVLII

SEQ ID NO: 165031 - protein, 9 aa, Homo Sapiens
IANPTAMLL

SEQ ID NO: 165032 - protein, 9 aa, Homo Sapiens
IANQVQLFY

SEQ ID NO: 165033 - protein, 9 aa, Homo Sapiens
IANTSVIFV

SEQ ID NO: 165034 - protein, 9 aa, Homo Sapiens
IANTVELRV

SEQ ID NO: 165035 - protein, 9 aa, Homo Sapiens
IASNYHLEV

SEQ ID NO: 165036 - protein, 9 aa, Homo Sapiens
IATEIILEI

SEQ ID NO: 165037 - protein, 9 aa, Homo Sapiens
IAVNAVLTV

SEQ ID NO: 165038 - protein, 9 aa, Homo Sapiens
IAYKFGKTV

SEQ ID NO: 165039 - protein, 9 aa, Homo Sapiens
IFLMLTVIL

SEQ ID NO: 165040 - protein, 9 aa, Homo Sapiens
IGNGVVIHL

SEQ ID NO: 165041 - protein, 9 aa, Homo Sapiens
IGNLNTLVV

SEQ ID NO: 165042 - protein, 9 aa, Homo Sapiens
IGSKFRLVV

SEQ ID NO: 165043 - protein, 9 aa, Homo Sapiens
IGSKPLQIW

SEQ ID NO: 165044 - protein, 9 aa, Homo Sapiens
IGTDVYLRL

SEQ ID NO: 165045 - protein, 9 aa, Homo Sapiens
IGVSHPLSI

SEQ ID NO: 165046 - protein, 9 aa, Homo Sapiens
IGYGHVRAV

SEQ ID NO: 165047 - protein, 9 aa, Homo Sapiens
IGYPHLQEV

SEQ ID NO: 165048 - protein, 9 aa, Homo Sapiens
IIATPGRLV

SEQ ID NO: 165049 - protein, 9 aa, Homo Sapiens
IIDPVALEI

SEQ ID NO: 165050 - protein, 9 aa, Homo Sapiens
IIFDRDLVV

SEQ ID NO: 165051 - protein, 9 aa, Homo Sapiens
IIFEQIRFV

SEQ ID NO: 165052 - protein, 9 aa, Homo Sapiens
IIFETPLRV

SEQ ID NO: 165053 - protein, 9 aa, Homo Sapiens
IIFNKFRSV

SEQ ID NO: 165054 - protein, 9 aa, Homo Sapiens
IILGKSHYV

SEQ ID NO: 165055 - protein, 9 aa, Homo Sapiens
IILSKMMLM

SEQ ID NO: 165056 - protein, 9 aa, Homo Sapiens
IINEVVLKL

SEQ ID NO: 165057 - protein, 9 aa, Homo Sapiens
IINKHYMEV

SEQ ID NO: 165058 - protein, 9 aa, Homo Sapiens
IINPMGLLV

SEQ ID NO: 165059 - protein, 9 aa, Homo Sapiens
IINSNPIEL

SEQ ID NO: 165060 - protein, 9 aa, Homo Sapiens
IINTHTLLL

SEQ ID NO: 165061 - protein, 9 aa, Homo Sapiens
IIQTKALQV

SEQ ID NO: 165062 - protein, 9 aa, Homo Sapiens
IITKAYLEV

SEQ ID NO: 165063 - protein, 9 aa, Homo Sapiens
IIVDIFHGL

SEQ ID NO: 165064 - protein, 9 aa, Homo Sapiens
IIVDLARYV

SEQ ID NO: 165065 - protein, 9 aa, Homo Sapiens
IIYPRQQLL

SEQ ID NO: 165066 - protein, 9 aa, Homo Sapiens
IIYPTPKVV

SEQ ID NO: 165067 - protein, 9 aa, Homo Sapiens
ILLGNGMLL

SEQ ID NO: 165068 - protein, 9 aa, Homo Sapiens
ILNPYNLFL

SEQ ID NO: 165069 - protein, 9 aa, Homo Sapiens
ILSNKFLIV

SEQ ID NO: 165070 - protein, 9 aa, Homo Sapiens
ILYPKTLFL

SEQ ID NO: 165071 - protein, 9 aa, Homo Sapiens
INTENIRLV

SEQ ID NO: 165072 - protein, 9 aa, Homo Sapiens
INTPEVLRV

SEQ ID NO: 165073 - protein, 9 aa, Homo Sapiens
IQGNRVLVV

SEQ ID NO: 165074 - protein, 9 aa, Homo Sapiens
IQHVFQNLI

SEQ ID NO: 165075 - protein, 9 aa, Homo Sapiens
IQKLHIRTV

SEQ ID NO: 165076 - protein, 9 aa, Homo Sapiens
IQNLSLLLV

SEQ ID NO: 165077 - protein, 9 aa, Homo Sapiens
IQNPQILKV

SEQ ID NO: 165078 - protein, 9 aa, Homo Sapiens
IQRIFLITL

SEQ ID NO: 165079 - protein, 9 aa, Homo Sapiens
IQTAVRLLL

SEQ ID NO: 165080 - protein, 9 aa, Homo Sapiens
IQYDRTLLV

SEQ ID NO: 165081 - protein, 9 aa, Homo Sapiens
IQYIRPVFV

SEQ ID NO: 165082 - protein, 9 aa, Homo Sapiens
IRNIHNDEL

SEQ ID NO: 165083 - protein, 9 aa, Homo Sapiens
ISDGVVLFI

SEQ ID NO: 165084 - protein, 9 aa, Homo Sapiens
ISDKVLKKI

SEQ ID NO: 165085 - protein, 9 aa, Homo Sapiens
ISDYAVKIV

SEQ ID NO: 165086 - protein, 9 aa, Homo Sapiens
ISEEGFHYL

SEQ ID NO: 165087 - protein, 9 aa, Homo Sapiens
ISFENYRKV

SEQ ID NO: 165088 - protein, 9 aa, Homo Sapiens
ISFEYDLRL

SEQ ID NO: 165089 - protein, 9 aa, Homo Sapiens
ISFPAPLYI

SEQ ID NO: 165090 - protein, 9 aa, Homo Sapiens
ISFQNPRTV

SEQ ID NO: 165091 - protein, 9 aa, Homo Sapiens
ISGGKPLEV

SEQ ID NO: 165092 - protein, 9 aa, Homo Sapiens
ISHKRVLEV

SEQ ID NO: 165093 - protein, 9 aa, Homo Sapiens
ISHTQTRLL

SEQ ID NO: 165094 - protein, 9 aa, Homo Sapiens
ISIDSPQKL

SEQ ID NO: 165095 - protein, 9 aa, Homo Sapiens
ISIPAVQKV

SEQ ID NO: 165096 - protein, 9 aa, Homo Sapiens
ISISAVQWL

SEQ ID NO: 165097 - protein, 9 aa, Homo Sapiens
ISISRVDKL

SEQ ID NO: 165098 - protein, 9 aa, Homo Sapiens
ISLEHEILL

SEQ ID NO: 165099 - protein, 9 aa, Homo Sapiens
ISLEKQLQV

SEQ ID NO: 165100 - protein, 9 aa, Homo Sapiens
ISLLHLSLL

SEQ ID NO: 165101 - protein, 9 aa, Homo Sapiens
ISLLMRLVV

SEQ ID NO: 165102 - protein, 9 aa, Homo Sapiens
ISLPHPMEI

SEQ ID NO: 165103 - protein, 9 aa, Homo Sapiens
ISLQHALYL

SEQ ID NO: 165104 - protein, 9 aa, Homo Sapiens
ISMEVPVMV

SEQ ID NO: 165105 - protein, 9 aa, Homo Sapiens
ISNDKFEYL

SEQ ID NO: 165106 - protein, 9 aa, Homo Sapiens
ISNEFIVLI

SEQ ID NO: 165107 - protein, 9 aa, Homo Sapiens
ISNEFVVLL

SEQ ID NO: 165108 - protein, 9 aa, Homo Sapiens
ISNFHVLLL

SEQ ID NO: 165109 - protein, 9 aa, Homo Sapiens
ISNPNSIIL

SEQ ID NO: 165110 - protein, 9 aa, Homo Sapiens
ISNPPILLV

SEQ ID NO: 165111 - protein, 9 aa, Homo Sapiens
ISNPYSRKV

SEQ ID NO: 165112 - protein, 9 aa, Homo Sapiens
ISNSHPLSL

SEQ ID NO: 165113 - protein, 9 aa, Homo Sapiens
ISNSSVVKV

SEQ ID NO: 165114 - protein, 9 aa, Homo Sapiens
ISNVLKLYL

SEQ ID NO: 165115 - protein, 9 aa, Homo Sapiens
ISSFQYLIV

SEQ ID NO: 165116 - protein, 9 aa, Homo Sapiens
ISSHIPLII

SEQ ID NO: 165117 - protein, 9 aa, Homo Sapiens
ISSPVILQF

SEQ ID NO: 165118 - protein, 9 aa, Homo Sapiens
ISSPVVTSL

SEQ ID NO: 165119 - protein, 9 aa, Homo Sapiens
ISSSIQLLV

SEQ ID NO: 165120 - protein, 9 aa, Homo Sapiens
ISSVPHGEL

SEQ ID NO: 165121 - protein, 9 aa, Homo Sapiens
ISTVEVLKV

SEQ ID NO: 165122 - protein, 9 aa, Homo Sapiens
ISYDRTLVI

SEQ ID NO: 165123 - protein, 9 aa, Homo Sapiens
ISYENMRFL

SEQ ID NO: 165124 - protein, 9 aa, Homo Sapiens
ISYLRVRKL

SEQ ID NO: 165125 - protein, 9 aa, Homo Sapiens
ITDPRTVFV

SEQ ID NO: 165126 - protein, 9 aa, Homo Sapiens
ITFPGLHEL

SEQ ID NO: 165127 - protein, 9 aa, Homo Sapiens
ITFSNPKEV

SEQ ID NO: 165128 - protein, 9 aa, Homo Sapiens
ITLDLIRVL

SEQ ID NO: 165129 - protein, 9 aa, Homo Sapiens
ITNELILRL

SEQ ID NO: 165130 - protein, 9 aa, Homo Sapiens
ITNGSRIEI

SEQ ID NO: 165131 - protein, 9 aa, Homo Sapiens
ITNIVILSL

SEQ ID NO: 165132 - protein, 9 aa, Homo Sapiens
ITNKYQLVF

SEQ ID NO: 165133 - protein, 9 aa, Homo Sapiens
ITNLQLLKI

SEQ ID NO: 165134 - protein, 9 aa, Homo Sapiens
ITNVAELLV

SEQ ID NO: 165135 - protein, 9 aa, Homo Sapiens
ITNVQILIL

SEQ ID NO: 165136 - protein, 9 aa, Homo Sapiens
ITPENLPQI

SEQ ID NO: 165137 - protein, 9 aa, Homo Sapiens
ITPQKLPSL

SEQ ID NO: 165138 - protein, 9 aa, Homo Sapiens
ITQERIVFL

SEQ ID NO: 165139 - protein, 9 aa, Homo Sapiens
ITRARFEEL

SEQ ID NO: 165140 - protein, 9 aa, Homo Sapiens
ITSPVHVSF

SEQ ID NO: 165141 - protein, 9 aa, Homo Sapiens
ITSVFITKV

SEQ ID NO: 165142 - protein, 9 aa, Homo Sapiens
ITTLHNLLL

SEQ ID NO: 165143 - protein, 9 aa, Homo Sapiens
ITVEKALAI

SEQ ID NO: 165144 - protein, 9 aa, Homo Sapiens
ITVHRHLML

SEQ ID NO: 165145 - protein, 9 aa, Homo Sapiens
ITVPVFHLF

SEQ ID NO: 165146 - protein, 9 aa, Homo Sapiens
ITYGQFAQL

SEQ ID NO: 165147 - protein, 9 aa, Homo Sapiens
IVATKPLYV

SEQ ID NO: 165148 - protein, 9 aa, Homo Sapiens
IVGSKPLYV

SEQ ID NO: 165149 - protein, 9 aa, Homo Sapiens
IVIGIIKTV

SEQ ID NO: 165150 - protein, 9 aa, Homo Sapiens
IVMEHVVFL

SEQ ID NO: 165151 - protein, 9 aa, Homo Sapiens
IVMPNILVL

SEQ ID NO: 165152 - protein, 9 aa, Homo Sapiens
IVNGHTLLV

SEQ ID NO: 165153 - protein, 9 aa, Homo Sapiens
IVNGQIHSV

SEQ ID NO: 165154 - protein, 9 aa, Homo Sapiens
IVNPTIVLL

SEQ ID NO: 165155 - protein, 9 aa, Homo Sapiens
IVNRISLFL

SEQ ID NO: 165156 - protein, 9 aa, Homo Sapiens
IVQNGRLIV

SEQ ID NO: 165157 - protein, 9 aa, Homo Sapiens
IVVPKAAIV

SEQ ID NO: 165158 - protein, 9 aa, Homo Sapiens
IVYPKPTWL

SEQ ID NO: 165159 - protein, 9 aa, Homo Sapiens
KAADRLPNL

SEQ ID NO: 165160 - protein, 9 aa, Homo Sapiens
KAAHFFSTL

SEQ ID NO: 165161 - protein, 9 aa, Homo Sapiens
KADMNVHLL

SEQ ID NO: 165162 - protein, 9 aa, Homo Sapiens
KAEEHILKL

SEQ ID NO: 165163 - protein, 9 aa, Homo Sapiens
KAEGKVRLL

SEQ ID NO: 165164 - protein, 9 aa, Homo Sapiens
KAFEHLQQL

SEQ ID NO: 165165 - protein, 9 aa, Homo Sapiens
KAFFAKMVV

SEQ ID NO: 165166 - protein, 9 aa, Homo Sapiens
KAFKGSIFV

SEQ ID NO: 165167 - protein, 9 aa, Homo Sapiens
KAFNWFSTL

SEQ ID NO: 165168 - protein, 9 aa, Homo Sapiens
KAFYFLNSV

SEQ ID NO: 165169 - protein, 9 aa, Homo Sapiens
KAGVAPLQV

SEQ ID NO: 165170 - protein, 9 aa, Homo Sapiens
KAHLMEIQV

SEQ ID NO: 165171 - protein, 9 aa, Homo Sapiens
KAIDFAASL

SEQ ID NO: 165172 - protein, 9 aa, Homo Sapiens
KAIDVVVMV

SEQ ID NO: 165173 - protein, 9 aa, Homo Sapiens
KAIDYIKYL

SEQ ID NO: 165174 - protein, 9 aa, Homo Sapiens
KAIDYIRFL

SEQ ID NO: 165175 - protein, 9 aa, Homo Sapiens
KAIDYYLKA

SEQ ID NO: 165176 - protein, 9 aa, Homo Sapiens
KAIELQLQV

SEQ ID NO: 165177 - protein, 9 aa, Homo Sapiens
KAIEVLLTL

SEQ ID NO: 165178 - protein, 9 aa, Homo Sapiens
KAISGVHTV

SEQ ID NO: 165179 - protein, 9 aa, Homo Sapiens
KALELWMQL

SEQ ID NO: 165180 - protein, 9 aa, Homo Sapiens
KALETLRQV

SEQ ID NO: 165181 - protein, 9 aa, Homo Sapiens
KALEVFPEF

SEQ ID NO: 165182 - protein, 9 aa, Homo Sapiens
KALQHERLV

SEQ ID NO: 165183 - protein, 9 aa, Homo Sapiens
KALSIFNEL

SEQ ID NO: 165184 - protein, 9 aa, Homo Sapiens
KALSIILHL

SEQ ID NO: 165185 - protein, 9 aa, Homo Sapiens
KAMELIREL

SEQ ID NO: 165186 - protein, 9 aa, Homo Sapiens
KAMGYQPLV

SEQ ID NO: 165187 - protein, 9 aa, Homo Sapiens
KANDWLQFI

SEQ ID NO: 165188 - protein, 9 aa, Homo Sapiens
KANEVISKL

SEQ ID NO: 165189 - protein, 9 aa, Homo Sapiens
KANHAELIL

SEQ ID NO: 165190 - protein, 9 aa, Homo Sapiens
KANIVHLML

SEQ ID NO: 165191 - protein, 9 aa, Homo Sapiens
KANMRALEL

SEQ ID NO: 165192 - protein, 9 aa, Homo Sapiens
KANPALYVL

SEQ ID NO: 165193 - protein, 9 aa, Homo Sapiens
KAQTKLLIL

SEQ ID NO: 165194 - protein, 9 aa, Homo Sapiens
KASEKILQV

SEQ ID NO: 165195 - protein, 9 aa, Homo Sapiens
KASHILISV

SEQ ID NO: 165196 - protein, 9 aa, Homo Sapiens
KASPLTFTV

SEQ ID NO: 165197 - protein, 9 aa, Homo Sapiens
KATAYILSV

SEQ ID NO: 165198 - protein, 9 aa, Homo Sapiens
KATEKILKM

SEQ ID NO: 165199 - protein, 9 aa, Homo Sapiens
KAVDIVKQV

SEQ ID NO: 165200 - protein, 9 aa, Homo Sapiens
KAVDRSLQL

SEQ ID NO: 165201 - protein, 9 aa, Homo Sapiens
KAVEAGLRV

SEQ ID NO: 165202 - protein, 9 aa, Homo Sapiens
KAVEIYASV

SEQ ID NO: 165203 - protein, 9 aa, Homo Sapiens
KAVFPLLYV

SEQ ID NO: 165204 - protein, 9 aa, Homo Sapiens
KAVHVIYTV

SEQ ID NO: 165205 - protein, 9 aa, Homo Sapiens
KAVLAGQFV

SEQ ID NO: 165206 - protein, 9 aa, Homo Sapiens
KAVQPLLKV

SEQ ID NO: 165207 - protein, 9 aa, Homo Sapiens
KAVQQVQRL

SEQ ID NO: 165208 - protein, 9 aa, Homo Sapiens
KAYEIMREL

SEQ ID NO: 165209 - protein, 9 aa, Homo Sapiens
KAYELALYL

SEQ ID NO: 165210 - protein, 9 aa, Homo Sapiens
KAYHEQLSV

SEQ ID NO: 165211 - protein, 9 aa, Homo Sapiens
KAYHEQLTV

SEQ ID NO: 165212 - protein, 9 aa, Homo Sapiens
KAYKAYRLL

SEQ ID NO: 165213 - protein, 9 aa, Homo Sapiens
KCLELFSEL

SEQ ID NO: 165214 - protein, 9 aa, Homo Sapiens
KCLELFTEL

SEQ ID NO: 165215 - protein, 9 aa, Homo Sapiens
KGFDFTLMV

SEQ ID NO: 165216 - protein, 9 aa, Homo Sapiens
KGFDWPLLV

SEQ ID NO: 165217 - protein, 9 aa, Homo Sapiens
KGFLFLHTL

SEQ ID NO: 165218 - protein, 9 aa, Homo Sapiens
KGIETYLII

SEQ ID NO: 165219 - protein, 9 aa, Homo Sapiens
KGIGHVIKV

SEQ ID NO: 165220 - protein, 9 aa, Homo Sapiens
KGNDTPLAL

SEQ ID NO: 165221 - protein, 9 aa, Homo Sapiens
KGQWSPLKV

SEQ ID NO: 165222 - protein, 9 aa, Homo Sapiens
KGSSYKLLV

SEQ ID NO: 165223 - protein, 9 aa, Homo Sapiens
KGTEFFLKV

SEQ ID NO: 165224 - protein, 9 aa, Homo Sapiens
KGYGKILEV

SEQ ID NO: 165225 - protein, 9 aa, Homo Sapiens
KIAPNTPQL

SEQ ID NO: 165226 - protein, 9 aa, Homo Sapiens
KIDDTIRYL

SEQ ID NO: 165227 - protein, 9 aa, Homo Sapiens
KIEVSFREL

SEQ ID NO: 165228 - protein, 9 aa, Homo Sapiens
KIFDNFSNL

SEQ ID NO: 165229 - protein, 9 aa, Homo Sapiens
KIFPAALQL

SEQ ID NO: 165230 - protein, 9 aa, Homo Sapiens
KIFQEMLYI

SEQ ID NO: 165231 - protein, 9 aa, Homo Sapiens
KIHSSFRSL

SEQ ID NO: 165232 - protein, 9 aa, Homo Sapiens
KIIDEQLVC

SEQ ID NO: 165233 - protein, 9 aa, Homo Sapiens
KIIDFLSAL

SEQ ID NO: 165234 - protein, 9 aa, Homo Sapiens
KIIDGLLVM

SEQ ID NO: 165235 - protein, 9 aa, Homo Sapiens
KIIDIFTTL

SEQ ID NO: 165236 - protein, 9 aa, Homo Sapiens
KIIEARLKM

SEQ ID NO: 165237 - protein, 9 aa, Homo Sapiens
KIIEILQFI

SEQ ID NO: 165238 - protein, 9 aa, Homo Sapiens
KIIEYSVYL

SEQ ID NO: 165239 - protein, 9 aa, Homo Sapiens
KIIGIMEEV

SEQ ID NO: 165240 - protein, 9 aa, Homo Sapiens
KIIWMPQEL

SEQ ID NO: 165241 - protein, 9 aa, Homo Sapiens
KILAAILHL

SEQ ID NO: 165242 - protein, 9 aa, Homo Sapiens
KILASFREM

SEQ ID NO: 165243 - protein, 9 aa, Homo Sapiens
KILEIIRVI

SEQ ID NO: 165244 - protein, 9 aa, Homo Sapiens
KILERTEIL

SEQ ID NO: 165245 - protein, 9 aa, Homo Sapiens
KILISILYV

SEQ ID NO: 165246 - protein, 9 aa, Homo Sapiens
KILTHVAEM

SEQ ID NO: 165247 - protein, 9 aa, Homo Sapiens
KILTKLLEV

SEQ ID NO: 165248 - protein, 9 aa, Homo Sapiens
KIMDYSLLL

SEQ ID NO: 165249 - protein, 9 aa, Homo Sapiens
KIMDYSLLM

SEQ ID NO: 165250 - protein, 9 aa, Homo Sapiens
KIMDYSLLV

SEQ ID NO: 165251 - protein, 9 aa, Homo Sapiens
KIMQQFQEL

SEQ ID NO: 165252 - protein, 9 aa, Homo Sapiens
KINALMHAL

SEQ ID NO: 165253 - protein, 9 aa, Homo Sapiens
KINEAFIEM

SEQ ID NO: 165254 - protein, 9 aa, Homo Sapiens
KINEAIVAV

SEQ ID NO: 165255 - protein, 9 aa, Homo Sapiens
KINEKPQVI

SEQ ID NO: 165256 - protein, 9 aa, Homo Sapiens
KINEKVLQV

SEQ ID NO: 165257 - protein, 9 aa, Homo Sapiens
KINELELRL

SEQ ID NO: 165258 - protein, 9 aa, Homo Sapiens
KINEWLTLV

SEQ ID NO: 165259 - protein, 9 aa, Homo Sapiens
KINFNTRFV

SEQ ID NO: 165260 - protein, 9 aa, Homo Sapiens
KINGFPIFL

SEQ ID NO: 165261 - protein, 9 aa, Homo Sapiens
KINNKVVQL

SEQ ID NO: 165262 - protein, 9 aa, Homo Sapiens
KINPMQLGV

SEQ ID NO: 165263 - protein, 9 aa, Homo Sapiens
KINQLPLFL

SEQ ID NO: 165264 - protein, 9 aa, Homo Sapiens
KIQEILTQV

SEQ ID NO: 165265 - protein, 9 aa, Homo Sapiens
KIRPHIATL

SEQ ID NO: 165266 - protein, 9 aa, Homo Sapiens
KISDWALKL

SEQ ID NO: 165267 - protein, 9 aa, Homo Sapiens
KISEWQVKL

SEQ ID NO: 165268 - protein, 9 aa, Homo Sapiens
KITDHFMRL

SEQ ID NO: 165269 - protein, 9 aa, Homo Sapiens
KITEDFRAL

SEQ ID NO: 165270 - protein, 9 aa, Homo Sapiens
KITEPFLVV

SEQ ID NO: 165271 - protein, 9 aa, Homo Sapiens
KITGMLLEI

SEQ ID NO: 165272 - protein, 9 aa, Homo Sapiens
KITQQMPKV

SEQ ID NO: 165273 - protein, 9 aa, Homo Sapiens
KITTVIQHV

SEQ ID NO: 165274 - protein, 9 aa, Homo Sapiens
KITWYILVL

SEQ ID NO: 165275 - protein, 9 aa, Homo Sapiens
KIYAIPQEV

SEQ ID NO: 165276 - protein, 9 aa, Homo Sapiens
KIYEEPIIL

SEQ ID NO: 165277 - protein, 9 aa, Homo Sapiens
KIYEGQVEV

SEQ ID NO: 165278 - protein, 9 aa, Homo Sapiens
KIYEHHIKV

SEQ ID NO: 165279 - protein, 9 aa, Homo Sapiens
KIYEPPRYM

SEQ ID NO: 165280 - protein, 9 aa, Homo Sapiens
KIYERTMAV

SEQ ID NO: 165281 - protein, 9 aa, Homo Sapiens
KIYISKIVV

SEQ ID NO: 165282 - protein, 9 aa, Homo Sapiens
KIYPGWLKV

SEQ ID NO: 165283 - protein, 9 aa, Homo Sapiens
KIYSGDLVV

SEQ ID NO: 165284 - protein, 9 aa, Homo Sapiens
KLAEIRHEV

SEQ ID NO: 165285 - protein, 9 aa, Homo Sapiens
KLFDRPQEL

SEQ ID NO: 165286 - protein, 9 aa, Homo Sapiens
KLFEEFLEL

SEQ ID NO: 165287 - protein, 9 aa, Homo Sapiens
KLITSFLEL

SEQ ID NO: 165288 - protein, 9 aa, Homo Sapiens
KLLEFQLAL

SEQ ID NO: 165289 - protein, 9 aa, Homo Sapiens
KLNATNIEL

SEQ ID NO: 165290 - protein, 9 aa, Homo Sapiens
KLNGQVLVF

SEQ ID NO: 165291 - protein, 9 aa, Homo Sapiens
KLNPNFLQL

SEQ ID NO: 165292 - protein, 9 aa, Homo Sapiens
KLNPQQFEV

SEQ ID NO: 165293 - protein, 9 aa, Homo Sapiens
KLNQAHLEV

SEQ ID NO: 165294 - protein, 9 aa, Homo Sapiens
KLNQDVLLV

SEQ ID NO: 165295 - protein, 9 aa, Homo Sapiens
KLNVWVALL

SEQ ID NO: 165296 - protein, 9 aa, Homo Sapiens
KLPSNLPQL

SEQ ID NO: 165297 - protein, 9 aa, Homo Sapiens
KLSELQLRV

SEQ ID NO: 165298 - protein, 9 aa, Homo Sapiens
KLSETFLHI

SEQ ID NO: 165299 - protein, 9 aa, Homo Sapiens
KLTEIRHEV

SEQ ID NO: 165300 - protein, 9 aa, Homo Sapiens
KLVGEFLEV

SEQ ID NO: 165301 - protein, 9 aa, Homo Sapiens
KLYDGFQYL

SEQ ID NO: 165302 - protein, 9 aa, Homo Sapiens
KLYEKFLEF

SEQ ID NO: 165303 - protein, 9 aa, Homo Sapiens
KLYGKPIRV

SEQ ID NO: 165304 - protein, 9 aa, Homo Sapiens
KLYTGLREV

SEQ ID NO: 165305 - protein, 9 aa, Homo Sapiens
KMAPALRKV

SEQ ID NO: 165306 - protein, 9 aa, Homo Sapiens
KMDDKALLV

SEQ ID NO: 165307 - protein, 9 aa, Homo Sapiens
KMLGYFSLV

SEQ ID NO: 165308 - protein, 9 aa, Homo Sapiens
KMMDVTVTI

SEQ ID NO: 165309 - protein, 9 aa, Homo Sapiens
KMMELFIRL

SEQ ID NO: 165310 - protein, 9 aa, Homo Sapiens
KMNEKLYTV

SEQ ID NO: 165311 - protein, 9 aa, Homo Sapiens
KMNGHLRLL

SEQ ID NO: 165312 - protein, 9 aa, Homo Sapiens
KMSEKILLL

SEQ ID NO: 165313 - protein, 9 aa, Homo Sapiens
KNADHLLHL

SEQ ID NO: 165314 - protein, 9 aa, Homo Sapiens
KNADKVLEL

SEQ ID NO: 165315 - protein, 9 aa, Homo Sapiens
KNFEEFFNL

SEQ ID NO: 165316 - protein, 9 aa, Homo Sapiens
KNFKAFASL

SEQ ID NO: 165317 - protein, 9 aa, Homo Sapiens
KNFSVSHLL

SEQ ID NO: 165318 - protein, 9 aa, Homo Sapiens
KNIDHMLWL

SEQ ID NO: 165319 - protein, 9 aa, Homo Sapiens
KNIEKIIHV

SEQ ID NO: 165320 - protein, 9 aa, Homo Sapiens
KNIERTLYF

SEQ ID NO: 165321 - protein, 9 aa, Homo Sapiens
KNIFLNQVL

SEQ ID NO: 165322 - protein, 9 aa, Homo Sapiens
KNINKPLDI

SEQ ID NO: 165323 - protein, 9 aa, Homo Sapiens
KNIPEILKI

SEQ ID NO: 165324 - protein, 9 aa, Homo Sapiens
KNIPEIVAV

SEQ ID NO: 165325 - protein, 9 aa, Homo Sapiens
KNIPMTLEL

SEQ ID NO: 165326 - protein, 9 aa, Homo Sapiens
KNIYTIREV

SEQ ID NO: 165327 - protein, 9 aa, Homo Sapiens
KNIYVLQEL

SEQ ID NO: 165328 - protein, 9 aa, Homo Sapiens
KNKWFFQKL

SEQ ID NO: 165329 - protein, 9 aa, Homo Sapiens
KNLDLLSQL

SEQ ID NO: 165330 - protein, 9 aa, Homo Sapiens
KNLEVFMHV

SEQ ID NO: 165331 - protein, 9 aa, Homo Sapiens
KNLGRLTRL

SEQ ID NO: 165332 - protein, 9 aa, Homo Sapiens
KNLLHAEFL

SEQ ID NO: 165333 - protein, 9 aa, Homo Sapiens
KNMEKLVKL

SEQ ID NO: 165334 - protein, 9 aa, Homo Sapiens
KNNASKLLL

SEQ ID NO: 165335 - protein, 9 aa, Homo Sapiens
KNQDHLLKL

SEQ ID NO: 165336 - protein, 9 aa, Homo Sapiens
KNSGVLMVV

SEQ ID NO: 165337 - protein, 9 aa, Homo Sapiens
KNSHLINVL

SEQ ID NO: 165338 - protein, 9 aa, Homo Sapiens
KNSPLVSRL

SEQ ID NO: 165339 - protein, 9 aa, Homo Sapiens
KNTEMVISV

SEQ ID NO: 165340 - protein, 9 aa, Homo Sapiens
KNTEVNLML

SEQ ID NO: 165341 - protein, 9 aa, Homo Sapiens
KNTIYPLTV

SEQ ID NO: 165342 - protein, 9 aa, Homo Sapiens
KNVDKVLEV

SEQ ID NO: 165343 - protein, 9 aa, Homo Sapiens
KNYDFAQVL

SEQ ID NO: 165344 - protein, 9 aa, Homo Sapiens
KNYDRFHYL

SEQ ID NO: 165345 - protein, 9 aa, Homo Sapiens
KQIDQFLVV

SEQ ID NO: 165346 - protein, 9 aa, Homo Sapiens
KQIDVYRSV

SEQ ID NO: 165347 - protein, 9 aa, Homo Sapiens
KQNGHIKFL

SEQ ID NO: 165348 - protein, 9 aa, Homo Sapiens
KQNIKLLDL

SEQ ID NO: 165349 - protein, 9 aa, Homo Sapiens
KQQQWLLYL

SEQ ID NO: 165350 - protein, 9 aa, Homo Sapiens
KQSDVMRFL

SEQ ID NO: 165351 - protein, 9 aa, Homo Sapiens
KQSNVQILV

SEQ ID NO: 165352 - protein, 9 aa, Homo Sapiens
KQSTSFLVL

SEQ ID NO: 165353 - protein, 9 aa, Homo Sapiens
KQTPKVLVV

SEQ ID NO: 165354 - protein, 9 aa, Homo Sapiens
KQYDKALEI

SEQ ID NO: 165355 - protein, 9 aa, Homo Sapiens
KQYGFFSYL

SEQ ID NO: 165356 - protein, 9 aa, Homo Sapiens
KQYPISLVL

SEQ ID NO: 165357 - protein, 9 aa, Homo Sapiens
KSAIPHPLI

SEQ ID NO: 165358 - protein, 9 aa, Homo Sapiens
KSANRVLRI

SEQ ID NO: 165359 - protein, 9 aa, Homo Sapiens
KSAVVQLTV

SEQ ID NO: 165360 - protein, 9 aa, Homo Sapiens
KSCEKIHFI

SEQ ID NO: 165361 - protein, 9 aa, Homo Sapiens
KSDLRLIEV

SEQ ID NO: 165362 - protein, 9 aa, Homo Sapiens
KSDPSIVRL

SEQ ID NO: 165363 - protein, 9 aa, Homo Sapiens
KSDSHVRML

SEQ ID NO: 165364 - protein, 9 aa, Homo Sapiens
KSDYIKLYV

SEQ ID NO: 165365 - protein, 9 aa, Homo Sapiens
KSESGLRVL

SEQ ID NO: 165366 - protein, 9 aa, Homo Sapiens
KSFAHILEL

SEQ ID NO: 165367 - protein, 9 aa, Homo Sapiens
KSFALLPRL

SEQ ID NO: 165368 - protein, 9 aa, Homo Sapiens
KSFEAPIKL

SEQ ID NO: 165369 - protein, 9 aa, Homo Sapiens
KSFEGLFYF

SEQ ID NO: 165370 - protein, 9 aa, Homo Sapiens
KSFEGNVFM

SEQ ID NO: 165371 - protein, 9 aa, Homo Sapiens
KSFEKLMKI

SEQ ID NO: 165372 - protein, 9 aa, Homo Sapiens
KSFFEAKKL

SEQ ID NO: 165373 - protein, 9 aa, Homo Sapiens
KSFGDTKFV

SEQ ID NO: 165374 - protein, 9 aa, Homo Sapiens
KSFHFPLFM

SEQ ID NO: 165375 - protein, 9 aa, Homo Sapiens
KSFIHIKEV

SEQ ID NO: 165376 - protein, 9 aa, Homo Sapiens
KSFLFEPVV

SEQ ID NO: 165377 - protein, 9 aa, Homo Sapiens
KSFLGVKEL

SEQ ID NO: 165378 - protein, 9 aa, Homo Sapiens
KSFNIPLLV

SEQ ID NO: 165379 - protein, 9 aa, Homo Sapiens
KSFQEILQI

SEQ ID NO: 165380 - protein, 9 aa, Homo Sapiens
KSFSFVRVI

SEQ ID NO: 165381 - protein, 9 aa, Homo Sapiens
KSFSHWSKL

SEQ ID NO: 165382 - protein, 9 aa, Homo Sapiens
KSFWGPLEL

SEQ ID NO: 165383 - protein, 9 aa, Homo Sapiens
KSFYDARLL

SEQ ID NO: 165384 - protein, 9 aa, Homo Sapiens
KSGEQILRL

SEQ ID NO: 165385 - protein, 9 aa, Homo Sapiens
KSGVPVLAV

SEQ ID NO: 165386 - protein, 9 aa, Homo Sapiens
KSIAEELEL

SEQ ID NO: 165387 - protein, 9 aa, Homo Sapiens
KSIARVLTV

SEQ ID NO: 165388 - protein, 9 aa, Homo Sapiens
KSIDRVLDI

SEQ ID NO: 165389 - protein, 9 aa, Homo Sapiens
KSIDTFFGV

SEQ ID NO: 165390 - protein, 9 aa, Homo Sapiens
KSIFVFTHV

SEQ ID NO: 165391 - protein, 9 aa, Homo Sapiens
KSIGLWNYI

SEQ ID NO: 165392 - protein, 9 aa, Homo Sapiens
KSIGSPVKV

SEQ ID NO: 165393 - protein, 9 aa, Homo Sapiens
KSIHIVVTM

SEQ ID NO: 165394 - protein, 9 aa, Homo Sapiens
KSIIKATNL

SEQ ID NO: 165395 - protein, 9 aa, Homo Sapiens
KSIILPKSL

SEQ ID NO: 165396 - protein, 9 aa, Homo Sapiens
KSIKIVKKL

SEQ ID NO: 165397 - protein, 9 aa, Homo Sapiens
KSIKNIQKI

SEQ ID NO: 165398 - protein, 9 aa, Homo Sapiens
KSIKNVTEL

SEQ ID NO: 165399 - protein, 9 aa, Homo Sapiens
KSIPGFSSL

SEQ ID NO: 165400 - protein, 9 aa, Homo Sapiens
KSIPGLLRL

SEQ ID NO: 165401 - protein, 9 aa, Homo Sapiens
KSIPVGTIL

SEQ ID NO: 165402 - protein, 9 aa, Homo Sapiens
KSIPVTQEL

SEQ ID NO: 165403 - protein, 9 aa, Homo Sapiens
KSISRLIVV

SEQ ID NO: 165404 - protein, 9 aa, Homo Sapiens
KSIVPVTKL

SEQ ID NO: 165405 - protein, 9 aa, Homo Sapiens
KSIWNNRWL

SEQ ID NO: 165406 - protein, 9 aa, Homo Sapiens
KSIYAALYF

SEQ ID NO: 165407 - protein, 9 aa, Homo Sapiens
KSIYPTLEI

SEQ ID NO: 165408 - protein, 9 aa, Homo Sapiens
KSIYTPLEL

SEQ ID NO: 165409 - protein, 9 aa, Homo Sapiens
KSKGWVNTL

SEQ ID NO: 165410 - protein, 9 aa, Homo Sapiens
KSLDIYSFI

SEQ ID NO: 165411 - protein, 9 aa, Homo Sapiens
KSLDWQIDV

SEQ ID NO: 165412 - protein, 9 aa, Homo Sapiens
KSLEVHLQV

SEQ ID NO: 165413 - protein, 9 aa, Homo Sapiens
KSLFLGQKL

SEQ ID NO: 165414 - protein, 9 aa, Homo Sapiens
KSLGSLPKV

SEQ ID NO: 165415 - protein, 9 aa, Homo Sapiens
KSLHQLLEV

SEQ ID NO: 165416 - protein, 9 aa, Homo Sapiens
KSLLFVNTL

SEQ ID NO: 165417 - protein, 9 aa, Homo Sapiens
KSLNFNMSV

SEQ ID NO: 165418 - protein, 9 aa, Homo Sapiens
KSLNISTKV

SEQ ID NO: 165419 - protein, 9 aa, Homo Sapiens
KSLPLPSSV

SEQ ID NO: 165420 - protein, 9 aa, Homo Sapiens
KSLQMIRQL

SEQ ID NO: 165421 - protein, 9 aa, Homo Sapiens
KSLQVRLEL

SEQ ID NO: 165422 - protein, 9 aa, Homo Sapiens
KSLSVVTEV

SEQ ID NO: 165423 - protein, 9 aa, Homo Sapiens
KSLTKLLIM

SEQ ID NO: 165424 - protein, 9 aa, Homo Sapiens
KSMDAIRSL

SEQ ID NO: 165425 - protein, 9 aa, Homo Sapiens
KSMEIEVLV

SEQ ID NO: 165426 - protein, 9 aa, Homo Sapiens
KSMESFLKV

SEQ ID NO: 165427 - protein, 9 aa, Homo Sapiens
KSMLEFQEL

SEQ ID NO: 165428 - protein, 9 aa, Homo Sapiens
KSMNHMNYL

SEQ ID NO: 165429 - protein, 9 aa, Homo Sapiens
KSMPTVTQI

SEQ ID NO: 165430 - protein, 9 aa, Homo Sapiens
KSNELWTEI

SEQ ID NO: 165431 - protein, 9 aa, Homo Sapiens
KSNFKPSLL

SEQ ID NO: 165432 - protein, 9 aa, Homo Sapiens
KSNGTIIHV

SEQ ID NO: 165433 - protein, 9 aa, Homo Sapiens
KSNNIMILV

SEQ ID NO: 165434 - protein, 9 aa, Homo Sapiens
KSNPIIRTV

SEQ ID NO: 165435 - protein, 9 aa, Homo Sapiens
KSNPKPLVL

SEQ ID NO: 165436 - protein, 9 aa, Homo Sapiens
KSNPYFEFV

SEQ ID NO: 165437 - protein, 9 aa, Homo Sapiens
KSNQIPTEV

SEQ ID NO: 165438 - protein, 9 aa, Homo Sapiens
KSNYKMMFV

SEQ ID NO: 165439 - protein, 9 aa, Homo Sapiens
KSQDIYLRL

SEQ ID NO: 165440 - protein, 9 aa, Homo Sapiens
KSQDNVIKV

SEQ ID NO: 165441 - protein, 9 aa, Homo Sapiens
KSQEIFLNL

SEQ ID NO: 165442 - protein, 9 aa, Homo Sapiens
KSQEQVHLL

SEQ ID NO: 165443 - protein, 9 aa, Homo Sapiens
KSQVPHIVV

SEQ ID NO: 165444 - protein, 9 aa, Homo Sapiens
KSSDFPLSV

SEQ ID NO: 165445 - protein, 9 aa, Homo Sapiens
KSSDLLKHL

SEQ ID NO: 165446 - protein, 9 aa, Homo Sapiens
KSSDQPLTV

SEQ ID NO: 165447 - protein, 9 aa, Homo Sapiens
KSSLKTLFI

SEQ ID NO: 165448 - protein, 9 aa, Homo Sapiens
KSSPLLVYL

SEQ ID NO: 165449 - protein, 9 aa, Homo Sapiens
KSSQLVTHL

SEQ ID NO: 165450 - protein, 9 aa, Homo Sapiens
KSSVKAVIL

SEQ ID NO: 165451 - protein, 9 aa, Homo Sapiens
KSTAISLFY

SEQ ID NO: 165452 - protein, 9 aa, Homo Sapiens
KSTEMALRV

SEQ ID NO: 165453 - protein, 9 aa, Homo Sapiens
KSTKVITFI

SEQ ID NO: 165454 - protein, 9 aa, Homo Sapiens
KSTPVTVVL

SEQ ID NO: 165455 - protein, 9 aa, Homo Sapiens
KSTSNITKL

SEQ ID NO: 165456 - protein, 9 aa, Homo Sapiens
KSVARIAKL

SEQ ID NO: 165457 - protein, 9 aa, Homo Sapiens
KSVDWLLVF

SEQ ID NO: 165458 - protein, 9 aa, Homo Sapiens
KSVESFLKV

SEQ ID NO: 165459 - protein, 9 aa, Homo Sapiens
KSVGKGLQV

SEQ ID NO: 165460 - protein, 9 aa, Homo Sapiens
KSVVRALFI

SEQ ID NO: 165461 - protein, 9 aa, Homo Sapiens
KSVYWENTL

SEQ ID NO: 165462 - protein, 9 aa, Homo Sapiens
KSWADVVKL

SEQ ID NO: 165463 - protein, 9 aa, Homo Sapiens
KSWVFGVHF

SEQ ID NO: 165464 - protein, 9 aa, Homo Sapiens
KSYAGEKIL

SEQ ID NO: 165465 - protein, 9 aa, Homo Sapiens
KSYEAKLRL

SEQ ID NO: 165466 - protein, 9 aa, Homo Sapiens
KSYGERLQL

SEQ ID NO: 165467 - protein, 9 aa, Homo Sapiens
KSYKGRQII

SEQ ID NO: 165468 - protein, 9 aa, Homo Sapiens
KSYPETHII

SEQ ID NO: 165469 - protein, 9 aa, Homo Sapiens
KSYPLVHVV

SEQ ID NO: 165470 - protein, 9 aa, Homo Sapiens
KSYSFIARM

SEQ ID NO: 165471 - protein, 9 aa, Homo Sapiens
KSYSKAFTL

SEQ ID NO: 165472 - protein, 9 aa, Homo Sapiens
KSYVKLRHL

SEQ ID NO: 165473 - protein, 9 aa, Homo Sapiens
KSYYDILGV

SEQ ID NO: 165474 - protein, 9 aa, Homo Sapiens
KSYYHVYKL

SEQ ID NO: 165475 - protein, 9 aa, Homo Sapiens
KSYYTVRQL

SEQ ID NO: 165476 - protein, 9 aa, Homo Sapiens
KTAEFLSKL

SEQ ID NO: 165477 - protein, 9 aa, Homo Sapiens
KTAEGFLFV

SEQ ID NO: 165478 - protein, 9 aa, Homo Sapiens
KTAENFRAL

SEQ ID NO: 165479 - protein, 9 aa, Homo Sapiens
KTAFYSFYL

SEQ ID NO: 165480 - protein, 9 aa, Homo Sapiens
KTALKLLLV

SEQ ID NO: 165481 - protein, 9 aa, Homo Sapiens
KTASIELRV

SEQ ID NO: 165482 - protein, 9 aa, Homo Sapiens
KTDQFPLFL

SEQ ID NO: 165483 - protein, 9 aa, Homo Sapiens
KTDWHRYNL

SEQ ID NO: 165484 - protein, 9 aa, Homo Sapiens
KTDYFFLEV

SEQ ID NO: 165485 - protein, 9 aa, Homo Sapiens
KTEETLRFL

SEQ ID NO: 165486 - protein, 9 aa, Homo Sapiens
KTFDAPPAL

SEQ ID NO: 165487 - protein, 9 aa, Homo Sapiens
KTFFHQENV

SEQ ID NO: 165488 - protein, 9 aa, Homo Sapiens
KTFKRILVL

SEQ ID NO: 165489 - protein, 9 aa, Homo Sapiens
KTFLFSATM

SEQ ID NO: 165490 - protein, 9 aa, Homo Sapiens
KTFNLPLLM

SEQ ID NO: 165491 - protein, 9 aa, Homo Sapiens
KTFNYPLDL

SEQ ID NO: 165492 - protein, 9 aa, Homo Sapiens
KTFSYPLDL

SEQ ID NO: 165493 - protein, 9 aa, Homo Sapiens
KTFVMGLIL

SEQ ID NO: 165494 - protein, 9 aa, Homo Sapiens
KTFYHKSLL

SEQ ID NO: 165495 - protein, 9 aa, Homo Sapiens
KTGIPLNVL

SEQ ID NO: 165496 - protein, 9 aa, Homo Sapiens
KTIDAMKRV

SEQ ID NO: 165497 - protein, 9 aa, Homo Sapiens
KTIDGILLL

SEQ ID NO: 165498 - protein, 9 aa, Homo Sapiens
KTIDKILKC

SEQ ID NO: 165499 - protein, 9 aa, Homo Sapiens
KTIDYIQFL

SEQ ID NO: 165500 - protein, 9 aa, Homo Sapiens
KTIENFLVV

SEQ ID NO: 165501 - protein, 9 aa, Homo Sapiens
KTIEWAEEI

SEQ ID NO: 165502 - protein, 9 aa, Homo Sapiens
KTIKLWNTL

SEQ ID NO: 165503 - protein, 9 aa, Homo Sapiens
KTISVVLQL

SEQ ID NO: 165504 - protein, 9 aa, Homo Sapiens
KTITQVKKI

SEQ ID NO: 165505 - protein, 9 aa, Homo Sapiens
KTKWGTIEV

SEQ ID NO: 165506 - protein, 9 aa, Homo Sapiens
KTLARALGL

SEQ ID NO: 165507 - protein, 9 aa, Homo Sapiens
KTLDMIKKI

SEQ ID NO: 165508 - protein, 9 aa, Homo Sapiens
KTLDNVAIV

SEQ ID NO: 165509 - protein, 9 aa, Homo Sapiens
KTLDQIRTI

SEQ ID NO: 165510 - protein, 9 aa, Homo Sapiens
KTLEGEFSV

SEQ ID NO: 165511 - protein, 9 aa, Homo Sapiens
KTLEQALQL

SEQ ID NO: 165512 - protein, 9 aa, Homo Sapiens
KTLERIKAI

SEQ ID NO: 165513 - protein, 9 aa, Homo Sapiens
KTLERSYLL

SEQ ID NO: 165514 - protein, 9 aa, Homo Sapiens
KTLFLAVQV

SEQ ID NO: 165515 - protein, 9 aa, Homo Sapiens
KTLLFFTAL

SEQ ID NO: 165516 - protein, 9 aa, Homo Sapiens
KTLLFVRLL

SEQ ID NO: 165517 - protein, 9 aa, Homo Sapiens
KTLLLLSSV

SEQ ID NO: 165518 - protein, 9 aa, Homo Sapiens
KTLPSMLIL

SEQ ID NO: 165519 - protein, 9 aa, Homo Sapiens
KTLPVAFKV

SEQ ID NO: 165520 - protein, 9 aa, Homo Sapiens
KTLSAILRI

SEQ ID NO: 165521 - protein, 9 aa, Homo Sapiens
KTLVLILVV

SEQ ID NO: 165522 - protein, 9 aa, Homo Sapiens
KTMNMIQKL

SEQ ID NO: 165523 - protein, 9 aa, Homo Sapiens
KTMTDTYLL

SEQ ID NO: 165524 - protein, 9 aa, Homo Sapiens
KTNAIPLTL

SEQ ID NO: 165525 - protein, 9 aa, Homo Sapiens
KTNDQMVVV

SEQ ID NO: 165526 - protein, 9 aa, Homo Sapiens
KTNEKLYTV

SEQ ID NO: 165527 - protein, 9 aa, Homo Sapiens
KTNEMLLNF

SEQ ID NO: 165528 - protein, 9 aa, Homo Sapiens
KTNFFEKRV

SEQ ID NO: 165529 - protein, 9 aa, Homo Sapiens
KTNHVFFLL

SEQ ID NO: 165530 - protein, 9 aa, Homo Sapiens
KTNIAMLTV

SEQ ID NO: 165531 - protein, 9 aa, Homo Sapiens
KTNILLRYL

SEQ ID NO: 165532 - protein, 9 aa, Homo Sapiens
KTNPEVMVV

SEQ ID NO: 165533 - protein, 9 aa, Homo Sapiens
KTNVKFLAI

SEQ ID NO: 165534 - protein, 9 aa, Homo Sapiens
KTPNFSTLL

SEQ ID NO: 165535 - protein, 9 aa, Homo Sapiens
KTQAILLEM

SEQ ID NO: 165536 - protein, 9 aa, Homo Sapiens
KTQDLFRRV

SEQ ID NO: 165537 - protein, 9 aa, Homo Sapiens
KTRLINQVL

SEQ ID NO: 165538 - protein, 9 aa, Homo Sapiens
KTRPLIPEM

SEQ ID NO: 165539 - protein, 9 aa, Homo Sapiens
KTRQIISTI

SEQ ID NO: 165540 - protein, 9 aa, Homo Sapiens
KTSDFLKVL

SEQ ID NO: 165541 - protein, 9 aa, Homo Sapiens
KTSFRIIFL

SEQ ID NO: 165542 - protein, 9 aa, Homo Sapiens
KTSGKIRLL

SEQ ID NO: 165543 - protein, 9 aa, Homo Sapiens
KTSPKALVI

SEQ ID NO: 165544 - protein, 9 aa, Homo Sapiens
KTSSFIRHV

SEQ ID NO: 165545 - protein, 9 aa, Homo Sapiens
KTSTQKFFL

SEQ ID NO: 165546 - protein, 9 aa, Homo Sapiens
KTSVVFHQL

SEQ ID NO: 165547 - protein, 9 aa, Homo Sapiens
KTSVVGLFL

SEQ ID NO: 165548 - protein, 9 aa, Homo Sapiens
KTTLALHHL

SEQ ID NO: 165549 - protein, 9 aa, Homo Sapiens
KTTPDVIFV

SEQ ID NO: 165550 - protein, 9 aa, Homo Sapiens
KTTTIAVEV

SEQ ID NO: 165551 - protein, 9 aa, Homo Sapiens
KTVDVLLKL

SEQ ID NO: 165552 - protein, 9 aa, Homo Sapiens
KTVEQHLRL

SEQ ID NO: 165553 - protein, 9 aa, Homo Sapiens
KTVLIILEV

SEQ ID NO: 165554 - protein, 9 aa, Homo Sapiens
KTVLVFLNL

SEQ ID NO: 165555 - protein, 9 aa, Homo Sapiens
KTVNKILQI

SEQ ID NO: 165556 - protein, 9 aa, Homo Sapiens
KTVNKITVV

SEQ ID NO: 165557 - protein, 9 aa, Homo Sapiens
KTVPLLSKV

SEQ ID NO: 165558 - protein, 9 aa, Homo Sapiens
KTVQFVLQF

SEQ ID NO: 165559 - protein, 9 aa, Homo Sapiens
KTVSFHLYI

SEQ ID NO: 165560 - protein, 9 aa, Homo Sapiens
KTVSVALVL

SEQ ID NO: 165561 - protein, 9 aa, Homo Sapiens
KTWDKVAVL

SEQ ID NO: 165562 - protein, 9 aa, Homo Sapiens
KTYDKTVAL

SEQ ID NO: 165563 - protein, 9 aa, Homo Sapiens
KTYDYLFKL

SEQ ID NO: 165564 - protein, 9 aa, Homo Sapiens
KTYFSGNYF

SEQ ID NO: 165565 - protein, 9 aa, Homo Sapiens
KTYGNVLVL

SEQ ID NO: 165566 - protein, 9 aa, Homo Sapiens
KTYLQQIGV

SEQ ID NO: 165567 - protein, 9 aa, Homo Sapiens
KTYNILRNV

SEQ ID NO: 165568 - protein, 9 aa, Homo Sapiens
KTYPAHAFL

SEQ ID NO: 165569 - protein, 9 aa, Homo Sapiens
KTYQFLNDI

SEQ ID NO: 165570 - protein, 9 aa, Homo Sapiens
KTYSFLTAV

SEQ ID NO: 165571 - protein, 9 aa, Homo Sapiens
KVADGFKVV

SEQ ID NO: 165572 - protein, 9 aa, Homo Sapiens
KVADLVLML

SEQ ID NO: 165573 - protein, 9 aa, Homo Sapiens
KVADTILFL

SEQ ID NO: 165574 - protein, 9 aa, Homo Sapiens
KVARAILYV

SEQ ID NO: 165575 - protein, 9 aa, Homo Sapiens
KVFDAFLNM

SEQ ID NO: 165576 - protein, 9 aa, Homo Sapiens
KVFERQLQL

SEQ ID NO: 165577 - protein, 9 aa, Homo Sapiens
KVFGGFQVV

SEQ ID NO: 165578 - protein, 9 aa, Homo Sapiens
KVFKDFSEL

SEQ ID NO: 165579 - protein, 9 aa, Homo Sapiens
KVFLHEATV

SEQ ID NO: 165580 - protein, 9 aa, Homo Sapiens
KVFNRYLEV

SEQ ID NO: 165581 - protein, 9 aa, Homo Sapiens
KVFSAFITV

SEQ ID NO: 165582 - protein, 9 aa, Homo Sapiens
KVIDTQQKV

SEQ ID NO: 165583 - protein, 9 aa, Homo Sapiens
KVIEINPYL

SEQ ID NO: 165584 - protein, 9 aa, Homo Sapiens
KVIVRFLTV

SEQ ID NO: 165585 - protein, 9 aa, Homo Sapiens
KVIYVLPML

SEQ ID NO: 165586 - protein, 9 aa, Homo Sapiens
KVLDFEHFL

SEQ ID NO: 165587 - protein, 9 aa, Homo Sapiens
KVLDKPSRL

SEQ ID NO: 165588 - protein, 9 aa, Homo Sapiens
KVLELQTEL

SEQ ID NO: 165589 - protein, 9 aa, Homo Sapiens
KVLGALLFV

SEQ ID NO: 165590 - protein, 9 aa, Homo Sapiens
KVLNWFSEL

SEQ ID NO: 165591 - protein, 9 aa, Homo Sapiens
KVMELLVHL

SEQ ID NO: 165592 - protein, 9 aa, Homo Sapiens
KVMGFGLYL

SEQ ID NO: 165593 - protein, 9 aa, Homo Sapiens
KVNAQFLEL

SEQ ID NO: 165594 - protein, 9 aa, Homo Sapiens
KVNIIPIIA

SEQ ID NO: 165595 - protein, 9 aa, Homo Sapiens
KVNSHIAKL

SEQ ID NO: 165596 - protein, 9 aa, Homo Sapiens
KVNYIKILV

SEQ ID NO: 165597 - protein, 9 aa, Homo Sapiens
KVREEFKEL

SEQ ID NO: 165598 - protein, 9 aa, Homo Sapiens
KVSDILLRL

SEQ ID NO: 165599 - protein, 9 aa, Homo Sapiens
KVSDSVLLL

SEQ ID NO: 165600 - protein, 9 aa, Homo Sapiens
KVSDYEMKL

SEQ ID NO: 165601 - protein, 9 aa, Homo Sapiens
KVSERYLTM

SEQ ID NO: 165602 - protein, 9 aa, Homo Sapiens
KVSHHQLIL

SEQ ID NO: 165603 - protein, 9 aa, Homo Sapiens
KVSTQGLFV

SEQ ID NO: 165604 - protein, 9 aa, Homo Sapiens
KVTEFFLLI

SEQ ID NO: 165605 - protein, 9 aa, Homo Sapiens
KVTEVFILV

SEQ ID NO: 165606 - protein, 9 aa, Homo Sapiens
KVVALVHAV

SEQ ID NO: 165607 - protein, 9 aa, Homo Sapiens
KVVEHGLFV

SEQ ID NO: 165608 - protein, 9 aa, Homo Sapiens
KVVEIVKKL

SEQ ID NO: 165609 - protein, 9 aa, Homo Sapiens
KVVELFFYL

SEQ ID NO: 165610 - protein, 9 aa, Homo Sapiens
LAAHIPLFL

SEQ ID NO: 165611 - protein, 9 aa, Homo Sapiens
LAIRIPLLI

SEQ ID NO: 165612 - protein, 9 aa, Homo Sapiens
LALLHLLYL

SEQ ID NO: 165613 - protein, 9 aa, Homo Sapiens
LANEVKVLL

SEQ ID NO: 165614 - protein, 9 aa, Homo Sapiens
LANPHELSL

SEQ ID NO: 165615 - protein, 9 aa, Homo Sapiens
LANRFQLQL

SEQ ID NO: 165616 - protein, 9 aa, Homo Sapiens
LASAFFLVV

SEQ ID NO: 165617 - protein, 9 aa, Homo Sapiens
LATSHMLEL

SEQ ID NO: 165618 - protein, 9 aa, Homo Sapiens
LDTNADKQL

SEQ ID NO: 165619 - protein, 9 aa, Homo Sapiens
LGIAAPNLA

SEQ ID NO: 165620 - protein, 9 aa, Homo Sapiens
LGNIARLEL

SEQ ID NO: 165621 - protein, 9 aa, Homo Sapiens
LGNPKILLL

SEQ ID NO: 165622 - protein, 9 aa, Homo Sapiens
LGSQAHLTV

SEQ ID NO: 165623 - protein, 9 aa, Homo Sapiens
LGTDSHLVV

SEQ ID NO: 165624 - protein, 9 aa, Homo Sapiens
LGYSVYRTV

SEQ ID NO: 165625 - protein, 9 aa, Homo Sapiens
LIGPPLLIP

SEQ ID NO: 165626 - protein, 9 aa, Homo Sapiens
LINALVLYV

SEQ ID NO: 165627 - protein, 9 aa, Homo Sapiens
LINANMMVL

SEQ ID NO: 165628 - protein, 9 aa, Homo Sapiens
LIQERQLFL

SEQ ID NO: 165629 - protein, 9 aa, Homo Sapiens
LISESFLTV

SEQ ID NO: 165630 - protein, 9 aa, Homo Sapiens
LIYGRPVYV

SEQ ID NO: 165631 - protein, 9 aa, Homo Sapiens
LIYSGKLLL

SEQ ID NO: 165632 - protein, 9 aa, Homo Sapiens
LLIPIHLEV

SEQ ID NO: 165633 - protein, 9 aa, Homo Sapiens
LLNDHIYVV

SEQ ID NO: 165634 - protein, 9 aa, Homo Sapiens
LLNDRKVFV

SEQ ID NO: 165635 - protein, 9 aa, Homo Sapiens
LLNKSIIRV

SEQ ID NO: 165636 - protein, 9 aa, Homo Sapiens
LLNPHALVI

SEQ ID NO: 165637 - protein, 9 aa, Homo Sapiens
LLNRHLLAV

SEQ ID NO: 165638 - protein, 9 aa, Homo Sapiens
LLNSNIPLE

SEQ ID NO: 165639 - protein, 9 aa, Homo Sapiens
LLRAFILKI

SEQ ID NO: 165640 - protein, 9 aa, Homo Sapiens
LMNNHQLEL

SEQ ID NO: 165641 - protein, 9 aa, Homo Sapiens
LNMQFVVRV

SEQ ID NO: 165642 - protein, 9 aa, Homo Sapiens
LPFDRFSEV

SEQ ID NO: 165643 - protein, 9 aa, Homo Sapiens
LPINGNGKQ

SEQ ID NO: 165644 - protein, 9 aa, Homo Sapiens
LQNADPLKV

SEQ ID NO: 165645 - protein, 9 aa, Homo Sapiens
LQNEYALSL

SEQ ID NO: 165646 - protein, 9 aa, Homo Sapiens
LQNNTILRL

SEQ ID NO: 165647 - protein, 9 aa, Homo Sapiens
LQNQRVLYV

SEQ ID NO: 165648 - protein, 9 aa, Homo Sapiens
LQYPDFSVV

SEQ ID NO: 165649 - protein, 9 aa, Homo Sapiens
LRLSYPLEL

SEQ ID NO: 165650 - protein, 9 aa, Homo Sapiens
LSAGRVVVV

SEQ ID NO: 165651 - protein, 9 aa, Homo Sapiens
LSAPIHTQM

SEQ ID NO: 165652 - protein, 9 aa, Homo Sapiens
LSAQQILHV

SEQ ID NO: 165653 - protein, 9 aa, Homo Sapiens
LSDDHVLIL

SEQ ID NO: 165654 - protein, 9 aa, Homo Sapiens
LSDETLLEI

SEQ ID NO: 165655 - protein, 9 aa, Homo Sapiens
LSDIHTRFL

SEQ ID NO: 165656 - protein, 9 aa, Homo Sapiens
LSDLALHFL

SEQ ID NO: 165657 - protein, 9 aa, Homo Sapiens
LSDLHAHKL

SEQ ID NO: 165658 - protein, 9 aa, Homo Sapiens
LSDPQVHTV

SEQ ID NO: 165659 - protein, 9 aa, Homo Sapiens
LSEHNVLVV

SEQ ID NO: 165660 - protein, 9 aa, Homo Sapiens
LSHAGILKV

SEQ ID NO: 165661 - protein, 9 aa, Homo Sapiens
LSHDQLLEV

SEQ ID NO: 165662 - protein, 9 aa, Homo Sapiens
LSHSLLVTL

SEQ ID NO: 165663 - protein, 9 aa, Homo Sapiens
LSIDHPQKV

SEQ ID NO: 165664 - protein, 9 aa, Homo Sapiens
LSIEIGHEV

SEQ ID NO: 165665 - protein, 9 aa, Homo Sapiens
LSIPRVFYV

SEQ ID NO: 165666 - protein, 9 aa, Homo Sapiens
LSIPYRLIF

SEQ ID NO: 165667 - protein, 9 aa, Homo Sapiens
LSIRHLMEL

SEQ ID NO: 165668 - protein, 9 aa, Homo Sapiens
LSIRSVRLV

SEQ ID NO: 165669 - protein, 9 aa, Homo Sapiens
LSISKQTRL

SEQ ID NO: 165670 - protein, 9 aa, Homo Sapiens
LSKGPGLEV

SEQ ID NO: 165671 - protein, 9 aa, Homo Sapiens
LSLKLIQQL

SEQ ID NO: 165672 - protein, 9 aa, Homo Sapiens
LSMKTLLEL

SEQ ID NO: 165673 - protein, 9 aa, Homo Sapiens
LSNAKHLEI

SEQ ID NO: 165674 - protein, 9 aa, Homo Sapiens
LSNDLKLNL

SEQ ID NO: 165675 - protein, 9 aa, Homo Sapiens
LSNEKLPNL

SEQ ID NO: 165676 - protein, 9 aa, Homo Sapiens
LSNGQKVLV

SEQ ID NO: 165677 - protein, 9 aa, Homo Sapiens
LSNKHELQL

SEQ ID NO: 165678 - protein, 9 aa, Homo Sapiens
LSNLHQLQM

SEQ ID NO: 165679 - protein, 9 aa, Homo Sapiens
LSNMKILTL

SEQ ID NO: 165680 - protein, 9 aa, Homo Sapiens
LSNPDPRLL

SEQ ID NO: 165681 - protein, 9 aa, Homo Sapiens
LSNPKLLQM

SEQ ID NO: 165682 - protein, 9 aa, Homo Sapiens
LSNSHLVLI

SEQ ID NO: 165683 - protein, 9 aa, Homo Sapiens
LSNWYHFLV

SEQ ID NO: 165684 - protein, 9 aa, Homo Sapiens
LSQGQVLKL

SEQ ID NO: 165685 - protein, 9 aa, Homo Sapiens
LSQPQMLIV

SEQ ID NO: 165686 - protein, 9 aa, Homo Sapiens
LSRLFRVFV

SEQ ID NO: 165687 - protein, 9 aa, Homo Sapiens
LSSFSNLKV

SEQ ID NO: 165688 - protein, 9 aa, Homo Sapiens
LSSLVILEV

SEQ ID NO: 165689 - protein, 9 aa, Homo Sapiens
LSSNAIREV

SEQ ID NO: 165690 - protein, 9 aa, Homo Sapiens
LSSNVILHV

SEQ ID NO: 165691 - protein, 9 aa, Homo Sapiens
LSSQVVLWV

SEQ ID NO: 165692 - protein, 9 aa, Homo Sapiens
LSSSVIREL

SEQ ID NO: 165693 - protein, 9 aa, Homo Sapiens
LSSTLEHQV

SEQ ID NO: 165694 - protein, 9 aa, Homo Sapiens
LSSWVYLRF

SEQ ID NO: 165695 - protein, 9 aa, Homo Sapiens
LSTGKYLNV

SEQ ID NO: 165696 - protein, 9 aa, Homo Sapiens
LSVEIVHEL

SEQ ID NO: 165697 - protein, 9 aa, Homo Sapiens
LSYDGRLVI

SEQ ID NO: 165698 - protein, 9 aa, Homo Sapiens
LSYLDARSL

SEQ ID NO: 165699 - protein, 9 aa, Homo Sapiens
LSYNLPLEL

SEQ ID NO: 165700 - protein, 9 aa, Homo Sapiens
LSYSEILRL

SEQ ID NO: 165701 - protein, 9 aa, Homo Sapiens
LSYWKPFLV

SEQ ID NO: 165702 - protein, 9 aa, Homo Sapiens
LTDPSQRLV

SEQ ID NO: 165703 - protein, 9 aa, Homo Sapiens
LTDTTILQV

SEQ ID NO: 165704 - protein, 9 aa, Homo Sapiens
LTHEVLQLI

SEQ ID NO: 165705 - protein, 9 aa, Homo Sapiens
LTIDRQQKL

SEQ ID NO: 165706 - protein, 9 aa, Homo Sapiens
LTIPGIKYV

SEQ ID NO: 165707 - protein, 9 aa, Homo Sapiens
LTLYPPDIL

SEQ ID NO: 165708 - protein, 9 aa, Homo Sapiens
LTMEVIRQV

SEQ ID NO: 165709 - protein, 9 aa, Homo Sapiens
LTNATIMVV

SEQ ID NO: 165710 - protein, 9 aa, Homo Sapiens
LTNDWEDHL

SEQ ID NO: 165711 - protein, 9 aa, Homo Sapiens
LTNPELLKV

SEQ ID NO: 165712 - protein, 9 aa, Homo Sapiens
LTNPQKLMV

SEQ ID NO: 165713 - protein, 9 aa, Homo Sapiens
LTNPRTLKI

SEQ ID NO: 165714 - protein, 9 aa, Homo Sapiens
LTSKASLIV

SEQ ID NO: 165715 - protein, 9 aa, Homo Sapiens
LTTKHLTAL

SEQ ID NO: 165716 - protein, 9 aa, Homo Sapiens
LTTLELLEV

SEQ ID NO: 165717 - protein, 9 aa, Homo Sapiens
LTTRIAHFL

SEQ ID NO: 165718 - protein, 9 aa, Homo Sapiens
LTVLHPLKV

SEQ ID NO: 165719 - protein, 9 aa, Homo Sapiens
LTYGTMVFV

SEQ ID NO: 165720 - protein, 9 aa, Homo Sapiens
LTYHGHLYL

SEQ ID NO: 165721 - protein, 9 aa, Homo Sapiens
LVIGRVLEL

SEQ ID NO: 165722 - protein, 9 aa, Homo Sapiens
LVLLLEHLL

SEQ ID NO: 165723 - protein, 9 aa, Homo Sapiens
LVNAGVVHV

SEQ ID NO: 165724 - protein, 9 aa, Homo Sapiens
LVNAIVLVL

SEQ ID NO: 165725 - protein, 9 aa, Homo Sapiens
LVNDHLLNF

SEQ ID NO: 165726 - protein, 9 aa, Homo Sapiens
LVNGKSLEL

SEQ ID NO: 165727 - protein, 9 aa, Homo Sapiens
LVNLRELYL

SEQ ID NO: 165728 - protein, 9 aa, Homo Sapiens
LVNQRLLEV

SEQ ID NO: 165729 - protein, 9 aa, Homo Sapiens
LVNSYHLLL

SEQ ID NO: 165730 - protein, 9 aa, Homo Sapiens
LVNTHRLLL

SEQ ID NO: 165731 - protein, 9 aa, Homo Sapiens
LVSQYFQTV

SEQ ID NO: 165732 - protein, 9 aa, Homo Sapiens
LVYKNFPQL

SEQ ID NO: 165733 - protein, 9 aa, Homo Sapiens
MADPNIRFL

SEQ ID NO: 165734 - protein, 9 aa, Homo Sapiens
MADVYKLLV

SEQ ID NO: 165735 - protein, 9 aa, Homo Sapiens
MANGAVIHL

SEQ ID NO: 165736 - protein, 9 aa, Homo Sapiens
MANPRELRI

SEQ ID NO: 165737 - protein, 9 aa, Homo Sapiens
MANPTALLL

SEQ ID NO: 165738 - protein, 9 aa, Homo Sapiens
MATAHVTEI

SEQ ID NO: 165739 - protein, 9 aa, Homo Sapiens
MATRAGLQV

SEQ ID NO: 165740 - protein, 9 aa, Homo Sapiens
MAYAGARFV

SEQ ID NO: 165741 - protein, 9 aa, Homo Sapiens
MGAPAGLKM

SEQ ID NO: 165742 - protein, 9 aa, Homo Sapiens
MGYERERVV

SEQ ID NO: 165743 - protein, 9 aa, Homo Sapiens
MIDNVILLI

SEQ ID NO: 165744 - protein, 9 aa, Homo Sapiens
MIFAKFDEV

SEQ ID NO: 165745 - protein, 9 aa, Homo Sapiens
MILNKALLL

SEQ ID NO: 165746 - protein, 9 aa, Homo Sapiens
MINSSVHVI

SEQ ID NO: 165747 - protein, 9 aa, Homo Sapiens
MISSHELFI

SEQ ID NO: 165748 - protein, 9 aa, Homo Sapiens
MLFGHPLLV

SEQ ID NO: 165749 - protein, 9 aa, Homo Sapiens
MLTELEKAL

SEQ ID NO: 165750 - protein, 9 aa, Homo Sapiens
MMNDSILRL

SEQ ID NO: 165751 - protein, 9 aa, Homo Sapiens
MQNPQILAA

SEQ ID NO: 165752 - protein, 9 aa, Homo Sapiens
MQNPRQYKI

SEQ ID NO: 165753 - protein, 9 aa, Homo Sapiens
MSADVPLVV

SEQ ID NO: 165754 - protein, 9 aa, Homo Sapiens
MSFGNVVEL

SEQ ID NO: 165755 - protein, 9 aa, Homo Sapiens
MSLKWMSVF

SEQ ID NO: 165756 - protein, 9 aa, Homo Sapiens
MSNALAIQV

SEQ ID NO: 165757 - protein, 9 aa, Homo Sapiens
MSNSTIVRL

SEQ ID NO: 165758 - protein, 9 aa, Homo Sapiens
MSQYLELKL

SEQ ID NO: 165759 - protein, 9 aa, Homo Sapiens
MSSDVFPLL

SEQ ID NO: 165760 - protein, 9 aa, Homo Sapiens
MSSPLSKEL

SEQ ID NO: 165761 - protein, 9 aa, Homo Sapiens
MSSSVVVRL

SEQ ID NO: 165762 - protein, 9 aa, Homo Sapiens
MSTSKVTVL

SEQ ID NO: 165763 - protein, 9 aa, Homo Sapiens
MSVDRYIAV

SEQ ID NO: 165764 - protein, 9 aa, Homo Sapiens
MSVDRYLAI

SEQ ID NO: 165765 - protein, 9 aa, Homo Sapiens
MSVDRYLSI

SEQ ID NO: 165766 - protein, 9 aa, Homo Sapiens
MSVPLVHQV

SEQ ID NO: 165767 - protein, 9 aa, Homo Sapiens
MSYAEVMRL

SEQ ID NO: 165768 - protein, 9 aa, Homo Sapiens
MSYEQLMQL

SEQ ID NO: 165769 - protein, 9 aa, Homo Sapiens
MSYPAKVTL

SEQ ID NO: 165770 - protein, 9 aa, Homo Sapiens
MSYYFLHVV

SEQ ID NO: 165771 - protein, 9 aa, Homo Sapiens
MSYYRFGEM

SEQ ID NO: 165772 - protein, 9 aa, Homo Sapiens
MTDPIRILV

SEQ ID NO: 165773 - protein, 9 aa, Homo Sapiens
MTISVEKKV

SEQ ID NO: 165774 - protein, 9 aa, Homo Sapiens
MTNLQELHL

SEQ ID NO: 165775 - protein, 9 aa, Homo Sapiens
MTVQILLKL

SEQ ID NO: 165776 - protein, 9 aa, Homo Sapiens
MTYERILYI

SEQ ID NO: 165777 - protein, 9 aa, Homo Sapiens
MVATWMLEV

SEQ ID NO: 165778 - protein, 9 aa, Homo Sapiens
MVDGTLLLL

SEQ ID NO: 165779 - protein, 9 aa, Homo Sapiens
MVNEFKLEL

SEQ ID NO: 165780 - protein, 9 aa, Homo Sapiens
MVNSKILLL

SEQ ID NO: 165781 - protein, 9 aa, Homo Sapiens
MVVDIVQEL

SEQ ID NO: 165782 - protein, 9 aa, Homo Sapiens
NALGVILQV

SEQ ID NO: 165783 - protein, 9 aa, Homo Sapiens
NNGIPPVQV

SEQ ID NO: 165784 - protein, 9 aa, Homo Sapiens
NNIPIIASV

SEQ ID NO: 165785 - protein, 9 aa, Homo Sapiens
NNNIPPVEF

SEQ ID NO: 165786 - protein, 9 aa, Homo Sapiens
NNQIKELFI

SEQ ID NO: 165787 - protein, 9 aa, Homo Sapiens
NQFPGFKEV

SEQ ID NO: 165788 - protein, 9 aa, Homo Sapiens
NQTPVTLQV

SEQ ID NO: 165789 - protein, 9 aa, Homo Sapiens
NSFGFPQYV

SEQ ID NO: 165790 - protein, 9 aa, Homo Sapiens
NSFKGIKYL

SEQ ID NO: 165791 - protein, 9 aa, Homo Sapiens
NSGINVMQV

SEQ ID NO: 165792 - protein, 9 aa, Homo Sapiens
NSGNVNLTL

SEQ ID NO: 165793 - protein, 9 aa, Homo Sapiens
NSISKLTQL

SEQ ID NO: 165794 - protein, 9 aa, Homo Sapiens
NSNAVPLKL

SEQ ID NO: 165795 - protein, 9 aa, Homo Sapiens
NSNPFEVKV

SEQ ID NO: 165796 - protein, 9 aa, Homo Sapiens
NSNTQVVLL

SEQ ID NO: 165797 - protein, 9 aa, Homo Sapiens
NSSDIFLLV

SEQ ID NO: 165798 - protein, 9 aa, Homo Sapiens
NSTDLPLNI

SEQ ID NO: 165799 - protein, 9 aa, Homo Sapiens
NSTGVLLEV

SEQ ID NO: 165800 - protein, 9 aa, Homo Sapiens
NTSKIWLIV

SEQ ID NO: 165801 - protein, 9 aa, Homo Sapiens
NVLDHFSEL

SEQ ID NO: 165802 - protein, 9 aa, Homo Sapiens
NVNENFLLV

SEQ ID NO: 165803 - protein, 9 aa, Homo Sapiens
PSMGHPLEV

SEQ ID NO: 165804 - protein, 9 aa, Homo Sapiens
PSSDIYLVV

SEQ ID NO: 165805 - protein, 9 aa, Homo Sapiens
PSVPVFLEV

SEQ ID NO: 165806 - protein, 9 aa, Homo Sapiens
QAADFALKV

SEQ ID NO: 165807 - protein, 9 aa, Homo Sapiens
QADVAVLVV

SEQ ID NO: 165808 - protein, 9 aa, Homo Sapiens
QAIERYLVV

SEQ ID NO: 165809 - protein, 9 aa, Homo Sapiens
QALDYFLKM

SEQ ID NO: 165810 - protein, 9 aa, Homo Sapiens
QANRHMSLL

SEQ ID NO: 165811 - protein, 9 aa, Homo Sapiens
QAQYHSLKL

SEQ ID NO: 165812 - protein, 9 aa, Homo Sapiens
QASHQPLYL

SEQ ID NO: 165813 - protein, 9 aa, Homo Sapiens
QAYPEVRIV

SEQ ID NO: 165814 - protein, 9 aa, Homo Sapiens
QGAHIVLEV

SEQ ID NO: 165815 - protein, 9 aa, Homo Sapiens
QGNDIVVKV

SEQ ID NO: 165816 - protein, 9 aa, Homo Sapiens
QIFSKFGTV

SEQ ID NO: 165817 - protein, 9 aa, Homo Sapiens
QIIQTYLTV

SEQ ID NO: 165818 - protein, 9 aa, Homo Sapiens
QILQKTREV

SEQ ID NO: 165819 - protein, 9 aa, Homo Sapiens
QISPFFPLV

SEQ ID NO: 165820 - protein, 9 aa, Homo Sapiens
QITEKQLQV

SEQ ID NO: 165821 - protein, 9 aa, Homo Sapiens
QNAIQPLFV

SEQ ID NO: 165822 - protein, 9 aa, Homo Sapiens
QNLSIIQYL

SEQ ID NO: 165823 - protein, 9 aa, Homo Sapiens
QNNMVILKL

SEQ ID NO: 165824 - protein, 9 aa, Homo Sapiens
QNSSVILFL

SEQ ID NO: 165825 - protein, 9 aa, Homo Sapiens
QNTEEFLRV

SEQ ID NO: 165826 - protein, 9 aa, Homo Sapiens
QNTEVVLYL

SEQ ID NO: 165827 - protein, 9 aa, Homo Sapiens
QNTPVTWLV

SEQ ID NO: 165828 - protein, 9 aa, Homo Sapiens
QPNPLPLRL

SEQ ID NO: 165829 - protein, 9 aa, Homo Sapiens
QQNGTPLKV

SEQ ID NO: 165830 - protein, 9 aa, Homo Sapiens
QQNPQPLIF

SEQ ID NO: 165831 - protein, 9 aa, Homo Sapiens
QQSIERLLV

SEQ ID NO: 165832 - protein, 9 aa, Homo Sapiens
QQTPLHLAV

SEQ ID NO: 165833 - protein, 9 aa, Homo Sapiens
QSAQHALRL

SEQ ID NO: 165834 - protein, 9 aa, Homo Sapiens
QSFFFTHLL

SEQ ID NO: 165835 - protein, 9 aa, Homo Sapiens
QSFPEPLII

SEQ ID NO: 165836 - protein, 9 aa, Homo Sapiens
QSHAYQQFL

SEQ ID NO: 165837 - protein, 9 aa, Homo Sapiens
QSIAFISRL

SEQ ID NO: 165838 - protein, 9 aa, Homo Sapiens
QSIEWPLKF

SEQ ID NO: 165839 - protein, 9 aa, Homo Sapiens
QSIGLIQHL

SEQ ID NO: 165840 - protein, 9 aa, Homo Sapiens
QSIHLEQKL

SEQ ID NO: 165841 - protein, 9 aa, Homo Sapiens
QSILKPMML

SEQ ID NO: 165842 - protein, 9 aa, Homo Sapiens
QSINKKLEL

SEQ ID NO: 165843 - protein, 9 aa, Homo Sapiens
QSIPAVLEI

SEQ ID NO: 165844 - protein, 9 aa, Homo Sapiens
QSISVAKEV

SEQ ID NO: 165845 - protein, 9 aa, Homo Sapiens
QSIVPALEI

SEQ ID NO: 165846 - protein, 9 aa, Homo Sapiens
QSLGKPLVL

SEQ ID NO: 165847 - protein, 9 aa, Homo Sapiens
QSLPHSATV

SEQ ID NO: 165848 - protein, 9 aa, Homo Sapiens
QSLQHYLEL

SEQ ID NO: 165849 - protein, 9 aa, Homo Sapiens
QSLRLFREV

SEQ ID NO: 165850 - protein, 9 aa, Homo Sapiens
QSMEQIRRI

SEQ ID NO: 165851 - protein, 9 aa, Homo Sapiens
QSMPVFKEV

SEQ ID NO: 165852 - protein, 9 aa, Homo Sapiens
QSNAVPLFL

SEQ ID NO: 165853 - protein, 9 aa, Homo Sapiens
QSNPKVMNL

SEQ ID NO: 165854 - protein, 9 aa, Homo Sapiens
QSNPLLIHV

SEQ ID NO: 165855 - protein, 9 aa, Homo Sapiens
QSQALILKI

SEQ ID NO: 165856 - protein, 9 aa, Homo Sapiens
QSSERPLFL

SEQ ID NO: 165857 - protein, 9 aa, Homo Sapiens
QSSSLTVHV

SEQ ID NO: 165858 - protein, 9 aa, Homo Sapiens
QSTDIIRYL

SEQ ID NO: 165859 - protein, 9 aa, Homo Sapiens
QSTEILKKL

SEQ ID NO: 165860 - protein, 9 aa, Homo Sapiens
QSTLSDLRV

SEQ ID NO: 165861 - protein, 9 aa, Homo Sapiens
QSTQRSLAL

SEQ ID NO: 165862 - protein, 9 aa, Homo Sapiens
QSTSDYLVV

SEQ ID NO: 165863 - protein, 9 aa, Homo Sapiens
QSTSIKLAL

SEQ ID NO: 165864 - protein, 9 aa, Homo Sapiens
QSVDLVFPV

SEQ ID NO: 165865 - protein, 9 aa, Homo Sapiens
QSVMNVLKV

SEQ ID NO: 165866 - protein, 9 aa, Homo Sapiens
QSYGNVVEL

SEQ ID NO: 165867 - protein, 9 aa, Homo Sapiens
QSYWNHREL

SEQ ID NO: 165868 - protein, 9 aa, Homo Sapiens
QTIALITYL

SEQ ID NO: 165869 - protein, 9 aa, Homo Sapiens
QTIGYQIRL

SEQ ID NO: 165870 - protein, 9 aa, Homo Sapiens
QTNLTLLQV

SEQ ID NO: 165871 - protein, 9 aa, Homo Sapiens
QTNLVKLLL

SEQ ID NO: 165872 - protein, 9 aa, Homo Sapiens
QTNSFPVLL

SEQ ID NO: 165873 - protein, 9 aa, Homo Sapiens
QTSATFLRV

SEQ ID NO: 165874 - protein, 9 aa, Homo Sapiens
QTTEHIVKL

SEQ ID NO: 165875 - protein, 9 aa, Homo Sapiens
QTVAAVLMV

SEQ ID NO: 165876 - protein, 9 aa, Homo Sapiens
QTYFFPIHL

SEQ ID NO: 165877 - protein, 9 aa, Homo Sapiens
QVLPHLLEV

SEQ ID NO: 165878 - protein, 9 aa, Homo Sapiens
QVNPVLLTL

SEQ ID NO: 165879 - protein, 9 aa, Homo Sapiens
QVNSRPMFI

SEQ ID NO: 165880 - protein, 9 aa, Homo Sapiens
RAADGFLFV

SEQ ID NO: 165881 - protein, 9 aa, Homo Sapiens
RAAERALQL

SEQ ID NO: 165882 - protein, 9 aa, Homo Sapiens
RAAMPVLKV

SEQ ID NO: 165883 - protein, 9 aa, Homo Sapiens
RAASVFIRV

SEQ ID NO: 165884 - protein, 9 aa, Homo Sapiens
RAATFPLQV

SEQ ID NO: 165885 - protein, 9 aa, Homo Sapiens
RADASIRLL

SEQ ID NO: 165886 - protein, 9 aa, Homo Sapiens
RADSVGKLV

SEQ ID NO: 165887 - protein, 9 aa, Homo Sapiens
RAFDHVLHL

SEQ ID NO: 165888 - protein, 9 aa, Homo Sapiens
RAFGFMTRV

SEQ ID NO: 165889 - protein, 9 aa, Homo Sapiens
RAFGIPIRV

SEQ ID NO: 165890 - protein, 9 aa, Homo Sapiens
RAFNFLNEI

SEQ ID NO: 165891 - protein, 9 aa, Homo Sapiens
RAGKPHLVL

SEQ ID NO: 165892 - protein, 9 aa, Homo Sapiens
RAGSIVLKV

SEQ ID NO: 165893 - protein, 9 aa, Homo Sapiens
RAHNVPLKL

SEQ ID NO: 165894 - protein, 9 aa, Homo Sapiens
RAHSEPLAL

SEQ ID NO: 165895 - protein, 9 aa, Homo Sapiens
RAIAKIKML

SEQ ID NO: 165896 - protein, 9 aa, Homo Sapiens
RAIDFSPYL

SEQ ID NO: 165897 - protein, 9 aa, Homo Sapiens
RAIDSIHQL

SEQ ID NO: 165898 - protein, 9 aa, Homo Sapiens
RAIPELTKL

SEQ ID NO: 165899 - protein, 9 aa, Homo Sapiens
RAIPFGTMV

SEQ ID NO: 165900 - protein, 9 aa, Homo Sapiens
RAIPNNQVL

SEQ ID NO: 165901 - protein, 9 aa, Homo Sapiens
RAIQFYLEF

SEQ ID NO: 165902 - protein, 9 aa, Homo Sapiens
RAITYYLDV

SEQ ID NO: 165903 - protein, 9 aa, Homo Sapiens
RALDHAMSV

SEQ ID NO: 165904 - protein, 9 aa, Homo Sapiens
RALDHYLTL

SEQ ID NO: 165905 - protein, 9 aa, Homo Sapiens
RALDTPVMV

SEQ ID NO: 165906 - protein, 9 aa, Homo Sapiens
RALDYALQI

SEQ ID NO: 165907 - protein, 9 aa, Homo Sapiens
RALEHFTDL

SEQ ID NO: 165908 - protein, 9 aa, Homo Sapiens
RALKGVLRV

SEQ ID NO: 165909 - protein, 9 aa, Homo Sapiens
RALNVFYYL

SEQ ID NO: 165910 - protein, 9 aa, Homo Sapiens
RALPHFILV

SEQ ID NO: 165911 - protein, 9 aa, Homo Sapiens
RALQFSLML

SEQ ID NO: 165912 - protein, 9 aa, Homo Sapiens
RALQQFLYV

SEQ ID NO: 165913 - protein, 9 aa, Homo Sapiens
RALVMLLEV

SEQ ID NO: 165914 - protein, 9 aa, Homo Sapiens
RAMSIAQRV

SEQ ID NO: 165915 - protein, 9 aa, Homo Sapiens
RANNLYMEL

SEQ ID NO: 165916 - protein, 9 aa, Homo Sapiens
RANTFVAEL

SEQ ID NO: 165917 - protein, 9 aa, Homo Sapiens
RANYWLKLV

SEQ ID NO: 165918 - protein, 9 aa, Homo Sapiens
RAQDRIVEV

SEQ ID NO: 165919 - protein, 9 aa, Homo Sapiens
RAQGVVLKV

SEQ ID NO: 165920 - protein, 9 aa, Homo Sapiens
RAQLHQLQL

SEQ ID NO: 165921 - protein, 9 aa, Homo Sapiens
RAQLTQLFL

SEQ ID NO: 165922 - protein, 9 aa, Homo Sapiens
RAQQEQLLL

SEQ ID NO: 165923 - protein, 9 aa, Homo Sapiens
RASEYITDV

SEQ ID NO: 165924 - protein, 9 aa, Homo Sapiens
RASFIFISV

SEQ ID NO: 165925 - protein, 9 aa, Homo Sapiens
RASGIFLRL

SEQ ID NO: 165926 - protein, 9 aa, Homo Sapiens
RATEGILFF

SEQ ID NO: 165927 - protein, 9 aa, Homo Sapiens
RATHRLLLL

SEQ ID NO: 165928 - protein, 9 aa, Homo Sapiens
RATLSTLAV

SEQ ID NO: 165929 - protein, 9 aa, Homo Sapiens
RAVDCYLKV

SEQ ID NO: 165930 - protein, 9 aa, Homo Sapiens
RAVPVGSGL

SEQ ID NO: 165931 - protein, 9 aa, Homo Sapiens
RAYDGTTYL

SEQ ID NO: 165932 - protein, 9 aa, Homo Sapiens
RAYEQALNL

SEQ ID NO: 165933 - protein, 9 aa, Homo Sapiens
RAYLFAHAV

SEQ ID NO: 165934 - protein, 9 aa, Homo Sapiens
RAYPAAITI

SEQ ID NO: 165935 - protein, 9 aa, Homo Sapiens
RAYQRQLVM

SEQ ID NO: 165936 - protein, 9 aa, Homo Sapiens
RAYSFKVVL

SEQ ID NO: 165937 - protein, 9 aa, Homo Sapiens
RAYSNLRRL

SEQ ID NO: 165938 - protein, 9 aa, Homo Sapiens
RDMGYPLAV

SEQ ID NO: 165939 - protein, 9 aa, Homo Sapiens
RGAPPLQLP

SEQ ID NO: 165940 - protein, 9 aa, Homo Sapiens
RGDPHILVV

SEQ ID NO: 165941 - protein, 9 aa, Homo Sapiens
RGFDKAYVV

SEQ ID NO: 165942 - protein, 9 aa, Homo Sapiens
RGFEFTLMV

SEQ ID NO: 165943 - protein, 9 aa, Homo Sapiens
RGFYFNTVL

SEQ ID NO: 165944 - protein, 9 aa, Homo Sapiens
RGLAHAIRL

SEQ ID NO: 165945 - protein, 9 aa, Homo Sapiens
RGLDKVITV

SEQ ID NO: 165946 - protein, 9 aa, Homo Sapiens
RGLQVHVVV

SEQ ID NO: 165947 - protein, 9 aa, Homo Sapiens
RGMDWILAL

SEQ ID NO: 165948 - protein, 9 aa, Homo Sapiens
RGNDLLLKL

SEQ ID NO: 165949 - protein, 9 aa, Homo Sapiens
RGNPFMLFL

SEQ ID NO: 165950 - protein, 9 aa, Homo Sapiens
RGNPLVVRF

SEQ ID NO: 165951 - protein, 9 aa, Homo Sapiens
RGQLHVLRV

SEQ ID NO: 165952 - protein, 9 aa, Homo Sapiens
RGSNVALML

SEQ ID NO: 165953 - protein, 9 aa, Homo Sapiens
RGSSLHLHV

SEQ ID NO: 165954 - protein, 9 aa, Homo Sapiens
RGTKVILHL

SEQ ID NO: 165955 - protein, 9 aa, Homo Sapiens
RGTTIANVV

SEQ ID NO: 165956 - protein, 9 aa, Homo Sapiens
RGYLFLEVF

SEQ ID NO: 165957 - protein, 9 aa, Homo Sapiens
RGYYSVETV

SEQ ID NO: 165958 - protein, 9 aa, Homo Sapiens
RHMYHSLYL

SEQ ID NO: 165959 - protein, 9 aa, Homo Sapiens
RHNSVQLQV

SEQ ID NO: 165960 - protein, 9 aa, Homo Sapiens
RIADSFQVI

SEQ ID NO: 165961 - protein, 9 aa, Homo Sapiens
RIAEFTTNL

SEQ ID NO: 165962 - protein, 9 aa, Homo Sapiens
RIAPPDRRF

SEQ ID NO: 165963 - protein, 9 aa, Homo Sapiens
RIDGVSLLV

SEQ ID NO: 165964 - protein, 9 aa, Homo Sapiens
RIDSRIIEV

SEQ ID NO: 165965 - protein, 9 aa, Homo Sapiens
RIEELFSIV

SEQ ID NO: 165966 - protein, 9 aa, Homo Sapiens
RIFEKMFAM

SEQ ID NO: 165967 - protein, 9 aa, Homo Sapiens
RIFKDFMHV

SEQ ID NO: 165968 - protein, 9 aa, Homo Sapiens
RIFQTLLEV

SEQ ID NO: 165969 - protein, 9 aa, Homo Sapiens
RIFSRFNAL

SEQ ID NO: 165970 - protein, 9 aa, Homo Sapiens
RIHAHFTGL

SEQ ID NO: 165971 - protein, 9 aa, Homo Sapiens
RIHPFHILI

SEQ ID NO: 165972 - protein, 9 aa, Homo Sapiens
RIHVNFELM

SEQ ID NO: 165973 - protein, 9 aa, Homo Sapiens
RIIAHAQLL

SEQ ID NO: 165974 - protein, 9 aa, Homo Sapiens
RIIDTVAQV

SEQ ID NO: 165975 - protein, 9 aa, Homo Sapiens
RIIERLLKL

SEQ ID NO: 165976 - protein, 9 aa, Homo Sapiens
RIIPRHLQL

SEQ ID NO: 165977 - protein, 9 aa, Homo Sapiens
RIIPWIQQL

SEQ ID NO: 165978 - protein, 9 aa, Homo Sapiens
RIIPYLLRL

SEQ ID NO: 165979 - protein, 9 aa, Homo Sapiens
RIISLFSLL

SEQ ID NO: 165980 - protein, 9 aa, Homo Sapiens
RIKDEFQFL

SEQ ID NO: 165981 - protein, 9 aa, Homo Sapiens
RIKDEFQLL

SEQ ID NO: 165982 - protein, 9 aa, Homo Sapiens
RILSKPIEV

SEQ ID NO: 165983 - protein, 9 aa, Homo Sapiens
RILTDILEV

SEQ ID NO: 165984 - protein, 9 aa, Homo Sapiens
RILVQQFEV

SEQ ID NO: 165985 - protein, 9 aa, Homo Sapiens
RIMEFTTTL

SEQ ID NO: 165986 - protein, 9 aa, Homo Sapiens
RIMNLYQFI

SEQ ID NO: 165987 - protein, 9 aa, Homo Sapiens
RIMYHASKL

SEQ ID NO: 165988 - protein, 9 aa, Homo Sapiens
RINEIVYFL

SEQ ID NO: 165989 - protein, 9 aa, Homo Sapiens
RIPAHRLVL

SEQ ID NO: 165990 - protein, 9 aa, Homo Sapiens
RIPAYFVTV

SEQ ID NO: 165991 - protein, 9 aa, Homo Sapiens
RIPSFVTEL

SEQ ID NO: 165992 - protein, 9 aa, Homo Sapiens
RIQAQFAQL

SEQ ID NO: 165993 - protein, 9 aa, Homo Sapiens
RIQVRFAEL

SEQ ID NO: 165994 - protein, 9 aa, Homo Sapiens
RIRELTAVV

SEQ ID NO: 165995 - protein, 9 aa, Homo Sapiens
RIRESFFRV

SEQ ID NO: 165996 - protein, 9 aa, Homo Sapiens
RIREYFYGF

SEQ ID NO: 165997 - protein, 9 aa, Homo Sapiens
RISDIRLFI

SEQ ID NO: 165998 - protein, 9 aa, Homo Sapiens
RISDVHFSV

SEQ ID NO: 165999 - protein, 9 aa, Homo Sapiens
RISLVFLLL

SEQ ID NO: 166000 - protein, 9 aa, Homo Sapiens
RISPWLLRV

SEQ ID NO: 166001 - protein, 9 aa, Homo Sapiens
RISSKSLKV

SEQ ID NO: 166002 - protein, 9 aa, Homo Sapiens
RITELMQVL

SEQ ID NO: 166003 - protein, 9 aa, Homo Sapiens
RITEYMEHV

SEQ ID NO: 166004 - protein, 9 aa, Homo Sapiens
RITKLFHFL

SEQ ID NO: 166005 - protein, 9 aa, Homo Sapiens
RITPRHLQL

SEQ ID NO: 166006 - protein, 9 aa, Homo Sapiens
RIVAHAVEV

SEQ ID NO: 166007 - protein, 9 aa, Homo Sapiens
RIVELFRNL

SEQ ID NO: 166008 - protein, 9 aa, Homo Sapiens
RIVPRFSEL

SEQ ID NO: 166009 - protein, 9 aa, Homo Sapiens
RIWAPPLLL

SEQ ID NO: 166010 - protein, 9 aa, Homo Sapiens
RIYDITNVL

SEQ ID NO: 166011 - protein, 9 aa, Homo Sapiens
RIYKYIHKV

SEQ ID NO: 166012 - protein, 9 aa, Homo Sapiens
RIYPFLLMV

SEQ ID NO: 166013 - protein, 9 aa, Homo Sapiens
RIYPHGLVL

SEQ ID NO: 166014 - protein, 9 aa, Homo Sapiens
RIYPKGQRL

SEQ ID NO: 166015 - protein, 9 aa, Homo Sapiens
RIYPTFLHL

SEQ ID NO: 166016 - protein, 9 aa, Homo Sapiens
RLFEVPHEL

SEQ ID NO: 166017 - protein, 9 aa, Homo Sapiens
RLINQVLEL

SEQ ID NO: 166018 - protein, 9 aa, Homo Sapiens
RLLEQVLLV

SEQ ID NO: 166019 - protein, 9 aa, Homo Sapiens
RLLPAFLKV

SEQ ID NO: 166020 - protein, 9 aa, Homo Sapiens
RLLPRLLLL

SEQ ID NO: 166021 - protein, 9 aa, Homo Sapiens
RLMGRTLTV

SEQ ID NO: 166022 - protein, 9 aa, Homo Sapiens
RLNKKVVLL

SEQ ID NO: 166023 - protein, 9 aa, Homo Sapiens
RLNPEMLQI

SEQ ID NO: 166024 - protein, 9 aa, Homo Sapiens
RLNPHDIRL

SEQ ID NO: 166025 - protein, 9 aa, Homo Sapiens
RLNPKALTL

SEQ ID NO: 166026 - protein, 9 aa, Homo Sapiens
RLNPLVLLL

SEQ ID NO: 166027 - protein, 9 aa, Homo Sapiens
RLQSKTIKV

SEQ ID NO: 166028 - protein, 9 aa, Homo Sapiens
RLQSKVLKL

SEQ ID NO: 166029 - protein, 9 aa, Homo Sapiens
RLSDVQIYV

SEQ ID NO: 166030 - protein, 9 aa, Homo Sapiens
RLSYNFLQV

SEQ ID NO: 166031 - protein, 9 aa, Homo Sapiens
RMFFHFSEI

SEQ ID NO: 166032 - protein, 9 aa, Homo Sapiens
RMIILPLVV

SEQ ID NO: 166033 - protein, 9 aa, Homo Sapiens
RMLAHPLHV

SEQ ID NO: 166034 - protein, 9 aa, Homo Sapiens
RMLIKLLEV

SEQ ID NO: 166035 - protein, 9 aa, Homo Sapiens
RMLPHAPGV

SEQ ID NO: 166036 - protein, 9 aa, Homo Sapiens
RMNADPLEV

SEQ ID NO: 166037 - protein, 9 aa, Homo Sapiens
RMNSKIMSL

SEQ ID NO: 166038 - protein, 9 aa, Homo Sapiens
RMNTVMLQL

SEQ ID NO: 166039 - protein, 9 aa, Homo Sapiens
RMYEKALQI

SEQ ID NO: 166040 - protein, 9 aa, Homo Sapiens
RNAASFKEV

SEQ ID NO: 166041 - protein, 9 aa, Homo Sapiens
RNADVFLKY

SEQ ID NO: 166042 - protein, 9 aa, Homo Sapiens
RNAELFLQL

SEQ ID NO: 166043 - protein, 9 aa, Homo Sapiens
RNDWLDLRV

SEQ ID NO: 166044 - protein, 9 aa, Homo Sapiens
RNEDVQLRL

SEQ ID NO: 166045 - protein, 9 aa, Homo Sapiens
RNFDEILRV

SEQ ID NO: 166046 - protein, 9 aa, Homo Sapiens
RNFFGPEFV

SEQ ID NO: 166047 - protein, 9 aa, Homo Sapiens
RNFGTVLRL

SEQ ID NO: 166048 - protein, 9 aa, Homo Sapiens
RNFHPFAEL

SEQ ID NO: 166049 - protein, 9 aa, Homo Sapiens
RNFHVFLEY

SEQ ID NO: 166050 - protein, 9 aa, Homo Sapiens
RNFYDFYLV

SEQ ID NO: 166051 - protein, 9 aa, Homo Sapiens
RNGITPLHV

SEQ ID NO: 166052 - protein, 9 aa, Homo Sapiens
RNHPLDLRV

SEQ ID NO: 166053 - protein, 9 aa, Homo Sapiens
RNIAEMQVL

SEQ ID NO: 166054 - protein, 9 aa, Homo Sapiens
RNIAVTTSM

SEQ ID NO: 166055 - protein, 9 aa, Homo Sapiens
RNIDLHYIV

SEQ ID NO: 166056 - protein, 9 aa, Homo Sapiens
RNIEGKQYL

SEQ ID NO: 166057 - protein, 9 aa, Homo Sapiens
RNIFPSNLV

SEQ ID NO: 166058 - protein, 9 aa, Homo Sapiens
RNIGKTLVT

SEQ ID NO: 166059 - protein, 9 aa, Homo Sapiens
RNIGRILGL

SEQ ID NO: 166060 - protein, 9 aa, Homo Sapiens
RNIILMSLL

SEQ ID NO: 166061 - protein, 9 aa, Homo Sapiens
RNIMFMQEL

SEQ ID NO: 166062 - protein, 9 aa, Homo Sapiens
RNIPETLEL

SEQ ID NO: 166063 - protein, 9 aa, Homo Sapiens
RNIPFFPDL

SEQ ID NO: 166064 - protein, 9 aa, Homo Sapiens
RNIPGITLL

SEQ ID NO: 166065 - protein, 9 aa, Homo Sapiens
RNIPGPHMV

SEQ ID NO: 166066 - protein, 9 aa, Homo Sapiens
RNISRIMRV

SEQ ID NO: 166067 - protein, 9 aa, Homo Sapiens
RNLDWFPRM

SEQ ID NO: 166068 - protein, 9 aa, Homo Sapiens
RNLEQVLRL

SEQ ID NO: 166069 - protein, 9 aa, Homo Sapiens
RNLLHDNEL

SEQ ID NO: 166070 - protein, 9 aa, Homo Sapiens
RNLPFMREL

SEQ ID NO: 166071 - protein, 9 aa, Homo Sapiens
RNLPVNFEV

SEQ ID NO: 166072 - protein, 9 aa, Homo Sapiens
RNLYLIMEF

SEQ ID NO: 166073 - protein, 9 aa, Homo Sapiens
RNMAIQQEL

SEQ ID NO: 166074 - protein, 9 aa, Homo Sapiens
RNMEKIQVI

SEQ ID NO: 166075 - protein, 9 aa, Homo Sapiens
RNMPVSFEV

SEQ ID NO: 166076 - protein, 9 aa, Homo Sapiens
RNNSVVQVL

SEQ ID NO: 166077 - protein, 9 aa, Homo Sapiens
RNQDMKLKL

SEQ ID NO: 166078 - protein, 9 aa, Homo Sapiens
RNQLLNIFV

SEQ ID NO: 166079 - protein, 9 aa, Homo Sapiens
RNQNLMLEL

SEQ ID NO: 166080 - protein, 9 aa, Homo Sapiens
RNQPMALSL

SEQ ID NO: 166081 - protein, 9 aa, Homo Sapiens
RNQPVTLDM

SEQ ID NO: 166082 - protein, 9 aa, Homo Sapiens
RNQYQMLVL

SEQ ID NO: 166083 - protein, 9 aa, Homo Sapiens
RNRIIKNEV

SEQ ID NO: 166084 - protein, 9 aa, Homo Sapiens
RNSEQIVEV

SEQ ID NO: 166085 - protein, 9 aa, Homo Sapiens
RNSQWVPTL

SEQ ID NO: 166086 - protein, 9 aa, Homo Sapiens
RNTDEMVEL

SEQ ID NO: 166087 - protein, 9 aa, Homo Sapiens
RNTEYFNQL

SEQ ID NO: 166088 - protein, 9 aa, Homo Sapiens
RNTGQVVHL

SEQ ID NO: 166089 - protein, 9 aa, Homo Sapiens
RNTSRITEL

SEQ ID NO: 166090 - protein, 9 aa, Homo Sapiens
RNVGFQVRL

SEQ ID NO: 166091 - protein, 9 aa, Homo Sapiens
RNVNHLPSL

SEQ ID NO: 166092 - protein, 9 aa, Homo Sapiens
RNVPVNLEL

SEQ ID NO: 166093 - protein, 9 aa, Homo Sapiens
RNVPWDLKL

SEQ ID NO: 166094 - protein, 9 aa, Homo Sapiens
RNYAKAVEL

SEQ ID NO: 166095 - protein, 9 aa, Homo Sapiens
RNYDGLTAL

SEQ ID NO: 166096 - protein, 9 aa, Homo Sapiens
RNYEYLIRL

SEQ ID NO: 166097 - protein, 9 aa, Homo Sapiens
RNYFSELTM

SEQ ID NO: 166098 - protein, 9 aa, Homo Sapiens
RNYFSKLWL

SEQ ID NO: 166099 - protein, 9 aa, Homo Sapiens
RNYPGMLYI

SEQ ID NO: 166100 - protein, 9 aa, Homo Sapiens
RNYVQQVTI

SEQ ID NO: 166101 - protein, 9 aa, Homo Sapiens
RQADFVQVL

SEQ ID NO: 166102 - protein, 9 aa, Homo Sapiens
RQAPPHIEL

SEQ ID NO: 166103 - protein, 9 aa, Homo Sapiens
RQFDHPHIV

SEQ ID NO: 166104 - protein, 9 aa, Homo Sapiens
RQFDNFKRV

SEQ ID NO: 166105 - protein, 9 aa, Homo Sapiens
RQHEIVLKV

SEQ ID NO: 166106 - protein, 9 aa, Homo Sapiens
RQIDQFLVV

SEQ ID NO: 166107 - protein, 9 aa, Homo Sapiens
RQIEYYFSV

SEQ ID NO: 166108 - protein, 9 aa, Homo Sapiens
RQLEKLKEV

SEQ ID NO: 166109 - protein, 9 aa, Homo Sapiens
RQLGHALLV

SEQ ID NO: 166110 - protein, 9 aa, Homo Sapiens
RQMTVIRKV

SEQ ID NO: 166111 - protein, 9 aa, Homo Sapiens
RQNFLALRL

SEQ ID NO: 166112 - protein, 9 aa, Homo Sapiens
RQNHSILKI

SEQ ID NO: 166113 - protein, 9 aa, Homo Sapiens
RQNTIVVKV

SEQ ID NO: 166114 - protein, 9 aa, Homo Sapiens
RQQLHDITV

SEQ ID NO: 166115 - protein, 9 aa, Homo Sapiens
RQTGKILKV

SEQ ID NO: 166116 - protein, 9 aa, Homo Sapiens
RQVGKTLRI

SEQ ID NO: 166117 - protein, 9 aa, Homo Sapiens
RQYENHIFV

SEQ ID NO: 166118 - protein, 9 aa, Homo Sapiens
RSADFLGKV

SEQ ID NO: 166119 - protein, 9 aa, Homo Sapiens
RSAEVTLEV

SEQ ID NO: 166120 - protein, 9 aa, Homo Sapiens
RSAFKLIQL

SEQ ID NO: 166121 - protein, 9 aa, Homo Sapiens
RSAFKLLEV

SEQ ID NO: 166122 - protein, 9 aa, Homo Sapiens
RSAILKMIL

SEQ ID NO: 166123 - protein, 9 aa, Homo Sapiens
RSALPTKTV

SEQ ID NO: 166124 - protein, 9 aa, Homo Sapiens
RSAQLWSQL

SEQ ID NO: 166125 - protein, 9 aa, Homo Sapiens
RSAVVEMLI

SEQ ID NO: 166126 - protein, 9 aa, Homo Sapiens
RSAYFANML

SEQ ID NO: 166127 - protein, 9 aa, Homo Sapiens
RSDSLIRVL

SEQ ID NO: 166128 - protein, 9 aa, Homo Sapiens
RSEAKPLAV

SEQ ID NO: 166129 - protein, 9 aa, Homo Sapiens
RSEEVFLQV

SEQ ID NO: 166130 - protein, 9 aa, Homo Sapiens
RSEEVVRLL

SEQ ID NO: 166131 - protein, 9 aa, Homo Sapiens
RSFDSEFKL

SEQ ID NO: 166132 - protein, 9 aa, Homo Sapiens
RSFEHALML

SEQ ID NO: 166133 - protein, 9 aa, Homo Sapiens
RSFEKAVHV

SEQ ID NO: 166134 - protein, 9 aa, Homo Sapiens
RSFEPILRL

SEQ ID NO: 166135 - protein, 9 aa, Homo Sapiens
RSFFGSLML

SEQ ID NO: 166136 - protein, 9 aa, Homo Sapiens
RSFFHQHYL

SEQ ID NO: 166137 - protein, 9 aa, Homo Sapiens
RSFIFYENL

SEQ ID NO: 166138 - protein, 9 aa, Homo Sapiens
RSFIKAAKL

SEQ ID NO: 166139 - protein, 9 aa, Homo Sapiens
RSFLQALVL

SEQ ID NO: 166140 - protein, 9 aa, Homo Sapiens
RSFPGFQAF

SEQ ID NO: 166141 - protein, 9 aa, Homo Sapiens
RSFPSVREL

SEQ ID NO: 166142 - protein, 9 aa, Homo Sapiens
RSFPTLPTL

SEQ ID NO: 166143 - protein, 9 aa, Homo Sapiens
RSFQRALEL

SEQ ID NO: 166144 - protein, 9 aa, Homo Sapiens
RSFQVALHI

SEQ ID NO: 166145 - protein, 9 aa, Homo Sapiens
RSFTKLPHL

SEQ ID NO: 166146 - protein, 9 aa, Homo Sapiens
RSFTNQIIL

SEQ ID NO: 166147 - protein, 9 aa, Homo Sapiens
RSFVFFSQL

SEQ ID NO: 166148 - protein, 9 aa, Homo Sapiens
RSGHQLIVV

SEQ ID NO: 166149 - protein, 9 aa, Homo Sapiens
RSGNIALSL

SEQ ID NO: 166150 - protein, 9 aa, Homo Sapiens
RSHFQHVFI

SEQ ID NO: 166151 - protein, 9 aa, Homo Sapiens
RSHGFAAEF

SEQ ID NO: 166152 - protein, 9 aa, Homo Sapiens
RSHGVLLEV

SEQ ID NO: 166153 - protein, 9 aa, Homo Sapiens
RSHLNFSML

SEQ ID NO: 166154 - protein, 9 aa, Homo Sapiens
RSHPTILDI

SEQ ID NO: 166155 - protein, 9 aa, Homo Sapiens
RSHSVFTLV

SEQ ID NO: 166156 - protein, 9 aa, Homo Sapiens
RSHYFEGVL

SEQ ID NO: 166157 - protein, 9 aa, Homo Sapiens
RSHYFEVEI

SEQ ID NO: 166158 - protein, 9 aa, Homo Sapiens
RSHYSPIYL

SEQ ID NO: 166159 - protein, 9 aa, Homo Sapiens
RSIAFHSAV

SEQ ID NO: 166160 - protein, 9 aa, Homo Sapiens
RSIAWEKSV

SEQ ID NO: 166161 - protein, 9 aa, Homo Sapiens
RSIDDVVRL

SEQ ID NO: 166162 - protein, 9 aa, Homo Sapiens
RSIDGPIRL

SEQ ID NO: 166163 - protein, 9 aa, Homo Sapiens
RSIDKPFRL

SEQ ID NO: 166164 - protein, 9 aa, Homo Sapiens
RSIDLNRLI

SEQ ID NO: 166165 - protein, 9 aa, Homo Sapiens
RSIDLTVKL

SEQ ID NO: 166166 - protein, 9 aa, Homo Sapiens
RSIDQFANL

SEQ ID NO: 166167 - protein, 9 aa, Homo Sapiens
RSIEEVLRI

SEQ ID NO: 166168 - protein, 9 aa, Homo Sapiens
RSIEEVYYL

SEQ ID NO: 166169 - protein, 9 aa, Homo Sapiens
RSIEHLKQI

SEQ ID NO: 166170 - protein, 9 aa, Homo Sapiens
RSIEVLQKV

SEQ ID NO: 166171 - protein, 9 aa, Homo Sapiens
RSIGALNQV

SEQ ID NO: 166172 - protein, 9 aa, Homo Sapiens
RSIGVYDVV

SEQ ID NO: 166173 - protein, 9 aa, Homo Sapiens
RSIHIFDTL

SEQ ID NO: 166174 - protein, 9 aa, Homo Sapiens
RSIHVIQDL

SEQ ID NO: 166175 - protein, 9 aa, Homo Sapiens
RSIIFANYI

SEQ ID NO: 166176 - protein, 9 aa, Homo Sapiens
RSIILRHLL

SEQ ID NO: 166177 - protein, 9 aa, Homo Sapiens
RSIMEPMSL

SEQ ID NO: 166178 - protein, 9 aa, Homo Sapiens
RSINKLIRI

SEQ ID NO: 166179 - protein, 9 aa, Homo Sapiens
RSIPTMLSV

SEQ ID NO: 166180 - protein, 9 aa, Homo Sapiens
RSIPVWIKI

SEQ ID NO: 166181 - protein, 9 aa, Homo Sapiens
RSISSLLRF

SEQ ID NO: 166182 - protein, 9 aa, Homo Sapiens
RSITVEQHI

SEQ ID NO: 166183 - protein, 9 aa, Homo Sapiens
RSIVLLLKV

SEQ ID NO: 166184 - protein, 9 aa, Homo Sapiens
RSKDIFDQL

SEQ ID NO: 166185 - protein, 9 aa, Homo Sapiens
RSLAHQHVV

SEQ ID NO: 166186 - protein, 9 aa, Homo Sapiens
RSLAQFSYL

SEQ ID NO: 166187 - protein, 9 aa, Homo Sapiens
RSLDDALKL

SEQ ID NO: 166188 - protein, 9 aa, Homo Sapiens
RSLDGRLQV

SEQ ID NO: 166189 - protein, 9 aa, Homo Sapiens
RSLDQQMYL

SEQ ID NO: 166190 - protein, 9 aa, Homo Sapiens
RSLDWQMVF

SEQ ID NO: 166191 - protein, 9 aa, Homo Sapiens
RSLDYVAQL

SEQ ID NO: 166192 - protein, 9 aa, Homo Sapiens
RSLEGRWEV

SEQ ID NO: 166193 - protein, 9 aa, Homo Sapiens
RSLEQDLKV

SEQ ID NO: 166194 - protein, 9 aa, Homo Sapiens
RSLEQNIQL

SEQ ID NO: 166195 - protein, 9 aa, Homo Sapiens
RSLEVILRA

SEQ ID NO: 166196 - protein, 9 aa, Homo Sapiens
RSLFLGRIL

SEQ ID NO: 166197 - protein, 9 aa, Homo Sapiens
RSLGFNTQI

SEQ ID NO: 166198 - protein, 9 aa, Homo Sapiens
RSLGIMQTV

SEQ ID NO: 166199 - protein, 9 aa, Homo Sapiens
RSLGKLTKL

SEQ ID NO: 166200 - protein, 9 aa, Homo Sapiens
RSLGVHLSF

SEQ ID NO: 166201 - protein, 9 aa, Homo Sapiens
RSLHLAVQL

SEQ ID NO: 166202 - protein, 9 aa, Homo Sapiens
RSLHMLLML

SEQ ID NO: 166203 - protein, 9 aa, Homo Sapiens
RSLKQVHLV

SEQ ID NO: 166204 - protein, 9 aa, Homo Sapiens
RSLLHTLEI

SEQ ID NO: 166205 - protein, 9 aa, Homo Sapiens
RSLLLLQLL

SEQ ID NO: 166206 - protein, 9 aa, Homo Sapiens
RSLLQTTFL

SEQ ID NO: 166207 - protein, 9 aa, Homo Sapiens
RSLNLVLMV

SEQ ID NO: 166208 - protein, 9 aa, Homo Sapiens
RSLPFPTVL

SEQ ID NO: 166209 - protein, 9 aa, Homo Sapiens
RSLPHITDV

SEQ ID NO: 166210 - protein, 9 aa, Homo Sapiens
RSLPLFLTL

SEQ ID NO: 166211 - protein, 9 aa, Homo Sapiens
RSLPSSSQL

SEQ ID NO: 166212 - protein, 9 aa, Homo Sapiens
RSLQLHLVF

SEQ ID NO: 166213 - protein, 9 aa, Homo Sapiens
RSLQLSLVM

SEQ ID NO: 166214 - protein, 9 aa, Homo Sapiens
RSLSTTNVF

SEQ ID NO: 166215 - protein, 9 aa, Homo Sapiens
RSLSVPVDL

SEQ ID NO: 166216 - protein, 9 aa, Homo Sapiens
RSLSYPFLL

SEQ ID NO: 166217 - protein, 9 aa, Homo Sapiens
RSLVIISTL

SEQ ID NO: 166218 - protein, 9 aa, Homo Sapiens
RSLVIVKKL

SEQ ID NO: 166219 - protein, 9 aa, Homo Sapiens
RSLWFPSDL

SEQ ID NO: 166220 - protein, 9 aa, Homo Sapiens
RSLWYQQTL

SEQ ID NO: 166221 - protein, 9 aa, Homo Sapiens
RSLYIMRVV

SEQ ID NO: 166222 - protein, 9 aa, Homo Sapiens
RSMAHILKA

SEQ ID NO: 166223 - protein, 9 aa, Homo Sapiens
RSMEAHNIL

SEQ ID NO: 166224 - protein, 9 aa, Homo Sapiens
RSMEEARLV

SEQ ID NO: 166225 - protein, 9 aa, Homo Sapiens
RSMEEQLLV

SEQ ID NO: 166226 - protein, 9 aa, Homo Sapiens
RSMEKVMEI

SEQ ID NO: 166227 - protein, 9 aa, Homo Sapiens
RSMEVSTQL

SEQ ID NO: 166228 - protein, 9 aa, Homo Sapiens
RSMGLPLQF

SEQ ID NO: 166229 - protein, 9 aa, Homo Sapiens
RSMGYFVEV

SEQ ID NO: 166230 - protein, 9 aa, Homo Sapiens
RSMHAIIYL

SEQ ID NO: 166231 - protein, 9 aa, Homo Sapiens
RSMPHQEIL

SEQ ID NO: 166232 - protein, 9 aa, Homo Sapiens
RSMRDLLEV

SEQ ID NO: 166233 - protein, 9 aa, Homo Sapiens
RSMVLKLTL

SEQ ID NO: 166234 - protein, 9 aa, Homo Sapiens
RSNAALLFV

SEQ ID NO: 166235 - protein, 9 aa, Homo Sapiens
RSNFKLVAV

SEQ ID NO: 166236 - protein, 9 aa, Homo Sapiens
RSNIMTLLF

SEQ ID NO: 166237 - protein, 9 aa, Homo Sapiens
RSNIWLAAV

SEQ ID NO: 166238 - protein, 9 aa, Homo Sapiens
RSNLQEIFL

SEQ ID NO: 166239 - protein, 9 aa, Homo Sapiens
RSNLRQLTL

SEQ ID NO: 166240 - protein, 9 aa, Homo Sapiens
RSNLVQVKV

SEQ ID NO: 166241 - protein, 9 aa, Homo Sapiens
RSNPKIWNV

SEQ ID NO: 166242 - protein, 9 aa, Homo Sapiens
RSNTYVIKL

SEQ ID NO: 166243 - protein, 9 aa, Homo Sapiens
RSNVIFYIV

SEQ ID NO: 166244 - protein, 9 aa, Homo Sapiens
RSQEYKIVL

SEQ ID NO: 166245 - protein, 9 aa, Homo Sapiens
RSQFRQIFL

SEQ ID NO: 166246 - protein, 9 aa, Homo Sapiens
RSQFYMLRM

SEQ ID NO: 166247 - protein, 9 aa, Homo Sapiens
RSQGKPIEL

SEQ ID NO: 166248 - protein, 9 aa, Homo Sapiens
RSQLVELLV

SEQ ID NO: 166249 - protein, 9 aa, Homo Sapiens
RSQPVPRSV

SEQ ID NO: 166250 - protein, 9 aa, Homo Sapiens
RSQSRIFYL

SEQ ID NO: 166251 - protein, 9 aa, Homo Sapiens
RSQSWILSV

SEQ ID NO: 166252 - protein, 9 aa, Homo Sapiens
RSQWSTMEL

SEQ ID NO: 166253 - protein, 9 aa, Homo Sapiens
RSRDGLLTV

SEQ ID NO: 166254 - protein, 9 aa, Homo Sapiens
RSRLEVAEV

SEQ ID NO: 166255 - protein, 9 aa, Homo Sapiens
RSSAKRLLL

SEQ ID NO: 166256 - protein, 9 aa, Homo Sapiens
RSSAQHLEV

SEQ ID NO: 166257 - protein, 9 aa, Homo Sapiens
RSSDKVVLV

SEQ ID NO: 166258 - protein, 9 aa, Homo Sapiens
RSSENILTV

SEQ ID NO: 166259 - protein, 9 aa, Homo Sapiens
RSSGRVVSL

SEQ ID NO: 166260 - protein, 9 aa, Homo Sapiens
RSSGYPLTI

SEQ ID NO: 166261 - protein, 9 aa, Homo Sapiens
RSSIRVVRV

SEQ ID NO: 166262 - protein, 9 aa, Homo Sapiens
RSSPCALRL

SEQ ID NO: 166263 - protein, 9 aa, Homo Sapiens
RSSPKALNF

SEQ ID NO: 166264 - protein, 9 aa, Homo Sapiens
RSSPQEIKV

SEQ ID NO: 166265 - protein, 9 aa, Homo Sapiens
RSSQRAVLL

SEQ ID NO: 166266 - protein, 9 aa, Homo Sapiens
RSSSLLRAV

SEQ ID NO: 166267 - protein, 9 aa, Homo Sapiens
RSSSWNMVL

SEQ ID NO: 166268 - protein, 9 aa, Homo Sapiens
RSSTYEVRL

SEQ ID NO: 166269 - protein, 9 aa, Homo Sapiens
RSSVEILRV

SEQ ID NO: 166270 - protein, 9 aa, Homo Sapiens
RSTDSIRLL

SEQ ID NO: 166271 - protein, 9 aa, Homo Sapiens
RSTELIPRL

SEQ ID NO: 166272 - protein, 9 aa, Homo Sapiens
RSTLMALMI

SEQ ID NO: 166273 - protein, 9 aa, Homo Sapiens
RSTLVLHDL

SEQ ID NO: 166274 - protein, 9 aa, Homo Sapiens
RSTPFRYLL

SEQ ID NO: 166275 - protein, 9 aa, Homo Sapiens
RSTVQFHIL

SEQ ID NO: 166276 - protein, 9 aa, Homo Sapiens
RSVDETLRL

SEQ ID NO: 166277 - protein, 9 aa, Homo Sapiens
RSVDGPIRL

SEQ ID NO: 166278 - protein, 9 aa, Homo Sapiens
RSVDIINML

SEQ ID NO: 166279 - protein, 9 aa, Homo Sapiens
RSVDLQTRI

SEQ ID NO: 166280 - protein, 9 aa, Homo Sapiens
RSVDNVQFL

SEQ ID NO: 166281 - protein, 9 aa, Homo Sapiens
RSVDRSLLL

SEQ ID NO: 166282 - protein, 9 aa, Homo Sapiens
RSVEETLRL

SEQ ID NO: 166283 - protein, 9 aa, Homo Sapiens
RSVILISTV

SEQ ID NO: 166284 - protein, 9 aa, Homo Sapiens
RSVLIANTV

SEQ ID NO: 166285 - protein, 9 aa, Homo Sapiens
RSVNIASKL

SEQ ID NO: 166286 - protein, 9 aa, Homo Sapiens
RSVPAVVRI

SEQ ID NO: 166287 - protein, 9 aa, Homo Sapiens
RSVPFQMLL

SEQ ID NO: 166288 - protein, 9 aa, Homo Sapiens
RSVPHLQKV

SEQ ID NO: 166289 - protein, 9 aa, Homo Sapiens
RSVPTWLKL

SEQ ID NO: 166290 - protein, 9 aa, Homo Sapiens
RSVPVRLHV

SEQ ID NO: 166291 - protein, 9 aa, Homo Sapiens
RSVRTVMRV

SEQ ID NO: 166292 - protein, 9 aa, Homo Sapiens
RSVSVDLNV

SEQ ID NO: 166293 - protein, 9 aa, Homo Sapiens
RSVYHQLFM

SEQ ID NO: 166294 - protein, 9 aa, Homo Sapiens
RSWDQQIKL

SEQ ID NO: 166295 - protein, 9 aa, Homo Sapiens
RSYAQNVTV

SEQ ID NO: 166296 - protein, 9 aa, Homo Sapiens
RSYDEQLRL

SEQ ID NO: 166297 - protein, 9 aa, Homo Sapiens
RSYEFFNEL

SEQ ID NO: 166298 - protein, 9 aa, Homo Sapiens
RSYEHWEYL

SEQ ID NO: 166299 - protein, 9 aa, Homo Sapiens
RSYLFLGGI

SEQ ID NO: 166300 - protein, 9 aa, Homo Sapiens
RSYPEILTL

SEQ ID NO: 166301 - protein, 9 aa, Homo Sapiens
RSYPHLRRV

SEQ ID NO: 166302 - protein, 9 aa, Homo Sapiens
RSYPYAFSV

SEQ ID NO: 166303 - protein, 9 aa, Homo Sapiens
RSYSQQLFL

SEQ ID NO: 166304 - protein, 9 aa, Homo Sapiens
RSYSYFIEV

SEQ ID NO: 166305 - protein, 9 aa, Homo Sapiens
RSYSYYVEV

SEQ ID NO: 166306 - protein, 9 aa, Homo Sapiens
RSYTYPLIF

SEQ ID NO: 166307 - protein, 9 aa, Homo Sapiens
RSYWKEVLL

SEQ ID NO: 166308 - protein, 9 aa, Homo Sapiens
RSYWSQTIL

SEQ ID NO: 166309 - protein, 9 aa, Homo Sapiens
RSYWSWVLL

SEQ ID NO: 166310 - protein, 9 aa, Homo Sapiens
RSYYYGKFM

SEQ ID NO: 166311 - protein, 9 aa, Homo Sapiens
RTADVIIMM

SEQ ID NO: 166312 - protein, 9 aa, Homo Sapiens
RTADWRLYL

SEQ ID NO: 166313 - protein, 9 aa, Homo Sapiens
RTAERELLM

SEQ ID NO: 166314 - protein, 9 aa, Homo Sapiens
RTAHVILRY

SEQ ID NO: 166315 - protein, 9 aa, Homo Sapiens
RTATYITEL

SEQ ID NO: 166316 - protein, 9 aa, Homo Sapiens
RTDPIPIVV

SEQ ID NO: 166317 - protein, 9 aa, Homo Sapiens
RTDSVIRLL

SEQ ID NO: 166318 - protein, 9 aa, Homo Sapiens
RTDVNIRVI

SEQ ID NO: 166319 - protein, 9 aa, Homo Sapiens
RTDVVELLL

SEQ ID NO: 166320 - protein, 9 aa, Homo Sapiens
RTFDEFQEL

SEQ ID NO: 166321 - protein, 9 aa, Homo Sapiens
RTFEAFMYL

SEQ ID NO: 166322 - protein, 9 aa, Homo Sapiens
RTFEKIEEV

SEQ ID NO: 166323 - protein, 9 aa, Homo Sapiens
RTFEPRLLV

SEQ ID NO: 166324 - protein, 9 aa, Homo Sapiens
RTFGFLSRL

SEQ ID NO: 166325 - protein, 9 aa, Homo Sapiens
RTFHIFYYL

SEQ ID NO: 166326 - protein, 9 aa, Homo Sapiens
RTFHLLHTV

SEQ ID NO: 166327 - protein, 9 aa, Homo Sapiens
RTFIKPKEL

SEQ ID NO: 166328 - protein, 9 aa, Homo Sapiens
RTFLRPPKV

SEQ ID NO: 166329 - protein, 9 aa, Homo Sapiens
RTFNQFSNL

SEQ ID NO: 166330 - protein, 9 aa, Homo Sapiens
RTFPVLLRL

SEQ ID NO: 166331 - protein, 9 aa, Homo Sapiens
RTFPWIIEV

SEQ ID NO: 166332 - protein, 9 aa, Homo Sapiens
RTFQAFHSV

SEQ ID NO: 166333 - protein, 9 aa, Homo Sapiens
RTFSLFQQL

SEQ ID NO: 166334 - protein, 9 aa, Homo Sapiens
RTFSLVLVL

SEQ ID NO: 166335 - protein, 9 aa, Homo Sapiens
RTGEGFLLV

SEQ ID NO: 166336 - protein, 9 aa, Homo Sapiens
RTGPPRLLV

SEQ ID NO: 166337 - protein, 9 aa, Homo Sapiens
RTGSQPLRV

SEQ ID NO: 166338 - protein, 9 aa, Homo Sapiens
RTIAKRLVL

SEQ ID NO: 166339 - protein, 9 aa, Homo Sapiens
RTIARTIVL

SEQ ID NO: 166340 - protein, 9 aa, Homo Sapiens
RTIATALEY

SEQ ID NO: 166341 - protein, 9 aa, Homo Sapiens
RTIDFVHQV

SEQ ID NO: 166342 - protein, 9 aa, Homo Sapiens
RTIEYLEEV

SEQ ID NO: 166343 - protein, 9 aa, Homo Sapiens
RTIGFFYTL

SEQ ID NO: 166344 - protein, 9 aa, Homo Sapiens
RTIGVITKL

SEQ ID NO: 166345 - protein, 9 aa, Homo Sapiens
RTIGVMTMV

SEQ ID NO: 166346 - protein, 9 aa, Homo Sapiens
RTIPGKQQL

SEQ ID NO: 166347 - protein, 9 aa, Homo Sapiens
RTIPVATTL

SEQ ID NO: 166348 - protein, 9 aa, Homo Sapiens
RTIQAPTQV

SEQ ID NO: 166349 - protein, 9 aa, Homo Sapiens
RTIQMFLVY

SEQ ID NO: 166350 - protein, 9 aa, Homo Sapiens
RTIQRPVTM

SEQ ID NO: 166351 - protein, 9 aa, Homo Sapiens
RTKDTPLSL

SEQ ID NO: 166352 - protein, 9 aa, Homo Sapiens
RTLAEQLEV

SEQ ID NO: 166353 - protein, 9 aa, Homo Sapiens
RTLALQQQL

SEQ ID NO: 166354 - protein, 9 aa, Homo Sapiens
RTLDCIHVL

SEQ ID NO: 166355 - protein, 9 aa, Homo Sapiens
RTLDGRLQV

SEQ ID NO: 166356 - protein, 9 aa, Homo Sapiens
RTLDKVLEV

SEQ ID NO: 166357 - protein, 9 aa, Homo Sapiens
RTLDLPIYV

SEQ ID NO: 166358 - protein, 9 aa, Homo Sapiens
RTLDNQLFF

SEQ ID NO: 166359 - protein, 9 aa, Homo Sapiens
RTLDSVSQI

SEQ ID NO: 166360 - protein, 9 aa, Homo Sapiens
RTLENPVNV

SEQ ID NO: 166361 - protein, 9 aa, Homo Sapiens
RTLEQARQL

SEQ ID NO: 166362 - protein, 9 aa, Homo Sapiens
RTLESKLVL

SEQ ID NO: 166363 - protein, 9 aa, Homo Sapiens
RTLETLIRL

SEQ ID NO: 166364 - protein, 9 aa, Homo Sapiens
RTLKIMLKV

SEQ ID NO: 166365 - protein, 9 aa, Homo Sapiens
RTLLAILRL

SEQ ID NO: 166366 - protein, 9 aa, Homo Sapiens
RTLLRHILV

SEQ ID NO: 166367 - protein, 9 aa, Homo Sapiens
RTLNRILTM

SEQ ID NO: 166368 - protein, 9 aa, Homo Sapiens
RTLPEPLEL

SEQ ID NO: 166369 - protein, 9 aa, Homo Sapiens
RTLPGPSWV

SEQ ID NO: 166370 - protein, 9 aa, Homo Sapiens
RTLPTLQEL

SEQ ID NO: 166371 - protein, 9 aa, Homo Sapiens
RTLPWASVL

SEQ ID NO: 166372 - protein, 9 aa, Homo Sapiens
RTLPWSSVL

SEQ ID NO: 166373 - protein, 9 aa, Homo Sapiens
RTLQNILEV

SEQ ID NO: 166374 - protein, 9 aa, Homo Sapiens
RTLRGVMRV

SEQ ID NO: 166375 - protein, 9 aa, Homo Sapiens
RTLTSWLRV

SEQ ID NO: 166376 - protein, 9 aa, Homo Sapiens
RTLYHLRLL

SEQ ID NO: 166377 - protein, 9 aa, Homo Sapiens
RTMDFGLNV

SEQ ID NO: 166378 - protein, 9 aa, Homo Sapiens
RTMEAFHFV

SEQ ID NO: 166379 - protein, 9 aa, Homo Sapiens
RTMEAPYFL

SEQ ID NO: 166380 - protein, 9 aa, Homo Sapiens
RTMEIFQLL

SEQ ID NO: 166381 - protein, 9 aa, Homo Sapiens
RTMENLVEL

SEQ ID NO: 166382 - protein, 9 aa, Homo Sapiens
RTMEWVQTI

SEQ ID NO: 166383 - protein, 9 aa, Homo Sapiens
RTMPRIPTL

SEQ ID NO: 166384 - protein, 9 aa, Homo Sapiens
RTMQPLAVL

SEQ ID NO: 166385 - protein, 9 aa, Homo Sapiens
RTNFFIQLV

SEQ ID NO: 166386 - protein, 9 aa, Homo Sapiens
RTNGVLLFI

SEQ ID NO: 166387 - protein, 9 aa, Homo Sapiens
RTNNLFKQV

SEQ ID NO: 166388 - protein, 9 aa, Homo Sapiens
RTNRPPLSL

SEQ ID NO: 166389 - protein, 9 aa, Homo Sapiens
RTPVQMMYL

SEQ ID NO: 166390 - protein, 9 aa, Homo Sapiens
RTQAFQVLL

SEQ ID NO: 166391 - protein, 9 aa, Homo Sapiens
RTQHAILYM

SEQ ID NO: 166392 - protein, 9 aa, Homo Sapiens
RTRPPSVQV

SEQ ID NO: 166393 - protein, 9 aa, Homo Sapiens
RTSKFVLRI

SEQ ID NO: 166394 - protein, 9 aa, Homo Sapiens
RTSRTLLLL

SEQ ID NO: 166395 - protein, 9 aa, Homo Sapiens
RTSSVQLRV

SEQ ID NO: 166396 - protein, 9 aa, Homo Sapiens
RTTDIVIRI

SEQ ID NO: 166397 - protein, 9 aa, Homo Sapiens
RTTEILHHL

SEQ ID NO: 166398 - protein, 9 aa, Homo Sapiens
RTTETQVLV

SEQ ID NO: 166399 - protein, 9 aa, Homo Sapiens
RTTNFAGIL

SEQ ID NO: 166400 - protein, 9 aa, Homo Sapiens
RTTPVDLCL

SEQ ID NO: 166401 - protein, 9 aa, Homo Sapiens
RTTSHLLRY

SEQ ID NO: 166402 - protein, 9 aa, Homo Sapiens
RTVDARLKL

SEQ ID NO: 166403 - protein, 9 aa, Homo Sapiens
RTVDLFPVL

SEQ ID NO: 166404 - protein, 9 aa, Homo Sapiens
RTVEKTWKL

SEQ ID NO: 166405 - protein, 9 aa, Homo Sapiens
RTVELFYDV

SEQ ID NO: 166406 - protein, 9 aa, Homo Sapiens
RTVFLPAEV

SEQ ID NO: 166407 - protein, 9 aa, Homo Sapiens
RTVFPNHTV

SEQ ID NO: 166408 - protein, 9 aa, Homo Sapiens
RTVPVFESV

SEQ ID NO: 166409 - protein, 9 aa, Homo Sapiens
RTYDMDVRL

SEQ ID NO: 166410 - protein, 9 aa, Homo Sapiens
RTYEKFFGL

SEQ ID NO: 166411 - protein, 9 aa, Homo Sapiens
RTYIIPRSV

SEQ ID NO: 166412 - protein, 9 aa, Homo Sapiens
RTYLGMSTL

SEQ ID NO: 166413 - protein, 9 aa, Homo Sapiens
RTYQEIQEL

SEQ ID NO: 166414 - protein, 9 aa, Homo Sapiens
RTYRELRLL

SEQ ID NO: 166415 - protein, 9 aa, Homo Sapiens
RTYSFLNLL

SEQ ID NO: 166416 - protein, 9 aa, Homo Sapiens
RTYTQLVRL

SEQ ID NO: 166417 - protein, 9 aa, Homo Sapiens
RTYVYVLTV

SEQ ID NO: 166418 - protein, 9 aa, Homo Sapiens
RVAPEEHPV

SEQ ID NO: 166419 - protein, 9 aa, Homo Sapiens
RVESLFRVI

SEQ ID NO: 166420 - protein, 9 aa, Homo Sapiens
RVFEYMSYL

SEQ ID NO: 166421 - protein, 9 aa, Homo Sapiens
RVFPFFRVL

SEQ ID NO: 166422 - protein, 9 aa, Homo Sapiens
RVFVKPLVL

SEQ ID NO: 166423 - protein, 9 aa, Homo Sapiens
RVGDHMMFV

SEQ ID NO: 166424 - protein, 9 aa, Homo Sapiens
RVGDRILAV

SEQ ID NO: 166425 - protein, 9 aa, Homo Sapiens
RVIDYAVKI

SEQ ID NO: 166426 - protein, 9 aa, Homo Sapiens
RVIDYILDL

SEQ ID NO: 166427 - protein, 9 aa, Homo Sapiens
RVIEPFSRV

SEQ ID NO: 166428 - protein, 9 aa, Homo Sapiens
RVIGTLEEV

SEQ ID NO: 166429 - protein, 9 aa, Homo Sapiens
RVIPLVREV

SEQ ID NO: 166430 - protein, 9 aa, Homo Sapiens
RVIPVLLQL

SEQ ID NO: 166431 - protein, 9 aa, Homo Sapiens
RVLAHMLRA

SEQ ID NO: 166432 - protein, 9 aa, Homo Sapiens
RVLDVILEV

SEQ ID NO: 166433 - protein, 9 aa, Homo Sapiens
RVLFKYFEV

SEQ ID NO: 166434 - protein, 9 aa, Homo Sapiens
RVLGKITLV

SEQ ID NO: 166435 - protein, 9 aa, Homo Sapiens
RVLHQFREL

SEQ ID NO: 166436 - protein, 9 aa, Homo Sapiens
RVLPYVLWL

SEQ ID NO: 166437 - protein, 9 aa, Homo Sapiens
RVLQWVLVL

SEQ ID NO: 166438 - protein, 9 aa, Homo Sapiens
RVMAPRTLI

SEQ ID NO: 166439 - protein, 9 aa, Homo Sapiens
RVMEHFIKL

SEQ ID NO: 166440 - protein, 9 aa, Homo Sapiens
RVMELFFTV

SEQ ID NO: 166441 - protein, 9 aa, Homo Sapiens
RVMEYINRL

SEQ ID NO: 166442 - protein, 9 aa, Homo Sapiens
RVMRTLLLV

SEQ ID NO: 166443 - protein, 9 aa, Homo Sapiens
RVMSGKLTV

SEQ ID NO: 166444 - protein, 9 aa, Homo Sapiens
RVNDQLIAV

SEQ ID NO: 166445 - protein, 9 aa, Homo Sapiens
RVNFIHLIL

SEQ ID NO: 166446 - protein, 9 aa, Homo Sapiens
RVNGRVLDL

SEQ ID NO: 166447 - protein, 9 aa, Homo Sapiens
RVNKAFVNV

SEQ ID NO: 166448 - protein, 9 aa, Homo Sapiens
RVNKLILQL

SEQ ID NO: 166449 - protein, 9 aa, Homo Sapiens
RVNNNVLTI

SEQ ID NO: 166450 - protein, 9 aa, Homo Sapiens
RVNPALAEL

SEQ ID NO: 166451 - protein, 9 aa, Homo Sapiens
RVNPVTLET

SEQ ID NO: 166452 - protein, 9 aa, Homo Sapiens
RVNYHLVNV

SEQ ID NO: 166453 - protein, 9 aa, Homo Sapiens
RVQDPPLQL

SEQ ID NO: 166454 - protein, 9 aa, Homo Sapiens
RVQSHILHL

SEQ ID NO: 166455 - protein, 9 aa, Homo Sapiens
RVRNLFNVV

SEQ ID NO: 166456 - protein, 9 aa, Homo Sapiens
RVSDILRYL

SEQ ID NO: 166457 - protein, 9 aa, Homo Sapiens
RVSDLQMLL

SEQ ID NO: 166458 - protein, 9 aa, Homo Sapiens
RVSEIHSLV

SEQ ID NO: 166459 - protein, 9 aa, Homo Sapiens
RVSELHLEV

SEQ ID NO: 166460 - protein, 9 aa, Homo Sapiens
RVSPPHLTL

SEQ ID NO: 166461 - protein, 9 aa, Homo Sapiens
RVSPVHLQI

SEQ ID NO: 166462 - protein, 9 aa, Homo Sapiens
RVTDEILHL

SEQ ID NO: 166463 - protein, 9 aa, Homo Sapiens
RVTSKALEL

SEQ ID NO: 166464 - protein, 9 aa, Homo Sapiens
RVTVVFSTV

SEQ ID NO: 166465 - protein, 9 aa, Homo Sapiens
RVVDLITNL

SEQ ID NO: 166466 - protein, 9 aa, Homo Sapiens
RVVDQPLKL

SEQ ID NO: 166467 - protein, 9 aa, Homo Sapiens
RVVDRFVEF

SEQ ID NO: 166468 - protein, 9 aa, Homo Sapiens
RVVDYLTKL

SEQ ID NO: 166469 - protein, 9 aa, Homo Sapiens
RVVEHWIEV

SEQ ID NO: 166470 - protein, 9 aa, Homo Sapiens
RVVEKFLKI

SEQ ID NO: 166471 - protein, 9 aa, Homo Sapiens
RVVGRWLLV

SEQ ID NO: 166472 - protein, 9 aa, Homo Sapiens
RVYDVTRFL

SEQ ID NO: 166473 - protein, 9 aa, Homo Sapiens
RVYEILRLL

SEQ ID NO: 166474 - protein, 9 aa, Homo Sapiens
RVYERLLYV

SEQ ID NO: 166475 - protein, 9 aa, Homo Sapiens
RVYEWFGLV

SEQ ID NO: 166476 - protein, 9 aa, Homo Sapiens
RVYFFFTEV

SEQ ID NO: 166477 - protein, 9 aa, Homo Sapiens
RVYNGRLKV

SEQ ID NO: 166478 - protein, 9 aa, Homo Sapiens
SAAPTGPLL

SEQ ID NO: 166479 - protein, 9 aa, Homo Sapiens
SADFPALVV

SEQ ID NO: 166480 - protein, 9 aa, Homo Sapiens
SADTTILFV

SEQ ID NO: 166481 - protein, 9 aa, Homo Sapiens
SAFDHFASV

SEQ ID NO: 166482 - protein, 9 aa, Homo Sapiens
SAFMPVLKV

SEQ ID NO: 166483 - protein, 9 aa, Homo Sapiens
SAFPFPVTV

SEQ ID NO: 166484 - protein, 9 aa, Homo Sapiens
SAGPVHPLV

SEQ ID NO: 166485 - protein, 9 aa, Homo Sapiens
SAIGYIHSL

SEQ ID NO: 166486 - protein, 9 aa, Homo Sapiens
SAIPHPLIM

SEQ ID NO: 166487 - protein, 9 aa, Homo Sapiens
SALNVRLFL

SEQ ID NO: 166488 - protein, 9 aa, Homo Sapiens
SALPFITYL

SEQ ID NO: 166489 - protein, 9 aa, Homo Sapiens
SALPIIQKL

SEQ ID NO: 166490 - protein, 9 aa, Homo Sapiens
SANHNILQI

SEQ ID NO: 166491 - protein, 9 aa, Homo Sapiens
SANIPPLKF

SEQ ID NO: 166492 - protein, 9 aa, Homo Sapiens
SANKCLLKV

SEQ ID NO: 166493 - protein, 9 aa, Homo Sapiens
SANKTMVIV

SEQ ID NO: 166494 - protein, 9 aa, Homo Sapiens
SANRAVVGV

SEQ ID NO: 166495 - protein, 9 aa, Homo Sapiens
SANRHSLMV

SEQ ID NO: 166496 - protein, 9 aa, Homo Sapiens
SAQGKPLAL

SEQ ID NO: 166497 - protein, 9 aa, Homo Sapiens
SASLVHLSL

SEQ ID NO: 166498 - protein, 9 aa, Homo Sapiens
SATYRILEV

SEQ ID NO: 166499 - protein, 9 aa, Homo Sapiens
SAVPKVMKV

SEQ ID NO: 166500 - protein, 9 aa, Homo Sapiens
SAVRWLLEL

SEQ ID NO: 166501 - protein, 9 aa, Homo Sapiens
SAVTRLLIL

SEQ ID NO: 166502 - protein, 9 aa, Homo Sapiens
SGNTYALYV

SEQ ID NO: 166503 - protein, 9 aa, Homo Sapiens
SGQPVPLVV

SEQ ID NO: 166504 - protein, 9 aa, Homo Sapiens
SGTPHALIV

SEQ ID NO: 166505 - protein, 9 aa, Homo Sapiens
SGTTIALKV

SEQ ID NO: 166506 - protein, 9 aa, Homo Sapiens
SGVGIFLRV

SEQ ID NO: 166507 - protein, 9 aa, Homo Sapiens
SIAAVLPKV

SEQ ID NO: 166508 - protein, 9 aa, Homo Sapiens
SIADRPLYL

SEQ ID NO: 166509 - protein, 9 aa, Homo Sapiens
SIAGIFKEV

SEQ ID NO: 166510 - protein, 9 aa, Homo Sapiens
SIFGKQLVV

SEQ ID NO: 166511 - protein, 9 aa, Homo Sapiens
SIFVFTHVL

SEQ ID NO: 166512 - protein, 9 aa, Homo Sapiens
SIHIFDTLL

SEQ ID NO: 166513 - protein, 9 aa, Homo Sapiens
SIIDEFLHI

SEQ ID NO: 166514 - protein, 9 aa, Homo Sapiens
SIIDTELKV

SEQ ID NO: 166515 - protein, 9 aa, Homo Sapiens
SIIGRLLEV

SEQ ID NO: 166516 - protein, 9 aa, Homo Sapiens
SIIPPLFTV

SEQ ID NO: 166517 - protein, 9 aa, Homo Sapiens
SIIPYILKM

SEQ ID NO: 166518 - protein, 9 aa, Homo Sapiens
SIIQRLLEV

SEQ ID NO: 166519 - protein, 9 aa, Homo Sapiens
SILEHQIQV

SEQ ID NO: 166520 - protein, 9 aa, Homo Sapiens
SILESFIHV

SEQ ID NO: 166521 - protein, 9 aa, Homo Sapiens
SILGKFAVV

SEQ ID NO: 166522 - protein, 9 aa, Homo Sapiens
SILQHFLLI

SEQ ID NO: 166523 - protein, 9 aa, Homo Sapiens
SILQHLLLI

SEQ ID NO: 166524 - protein, 9 aa, Homo Sapiens
SILQHLLLV

SEQ ID NO: 166525 - protein, 9 aa, Homo Sapiens
SILRHVAEV

SEQ ID NO: 166526 - protein, 9 aa, Homo Sapiens
SILRRFLVL

SEQ ID NO: 166527 - protein, 9 aa, Homo Sapiens
SIMDRILQI

SEQ ID NO: 166528 - protein, 9 aa, Homo Sapiens
SIMDYVVFV

SEQ ID NO: 166529 - protein, 9 aa, Homo Sapiens
SINAEEVVV

SEQ ID NO: 166530 - protein, 9 aa, Homo Sapiens
SINDKIIEL

SEQ ID NO: 166531 - protein, 9 aa, Homo Sapiens
SINDKQVVL

SEQ ID NO: 166532 - protein, 9 aa, Homo Sapiens
SINEGLLKV

SEQ ID NO: 166533 - protein, 9 aa, Homo Sapiens
SINPKKLVM

SEQ ID NO: 166534 - protein, 9 aa, Homo Sapiens
SINQFALEL

SEQ ID NO: 166535 - protein, 9 aa, Homo Sapiens
SINQTTLEL

SEQ ID NO: 166536 - protein, 9 aa, Homo Sapiens
SINSRFAKV

SEQ ID NO: 166537 - protein, 9 aa, Homo Sapiens
SINSRLQLV

SEQ ID NO: 166538 - protein, 9 aa, Homo Sapiens
SIQAHPLLL

SEQ ID NO: 166539 - protein, 9 aa, Homo Sapiens
SIQPKPLLL

SEQ ID NO: 166540 - protein, 9 aa, Homo Sapiens
SIQSLFLEL

SEQ ID NO: 166541 - protein, 9 aa, Homo Sapiens
SIRGNNIRY

SEQ ID NO: 166542 - protein, 9 aa, Homo Sapiens
SITANILAV

SEQ ID NO: 166543 - protein, 9 aa, Homo Sapiens
SITERALKL

SEQ ID NO: 166544 - protein, 9 aa, Homo Sapiens
SIYRVPLLL

SEQ ID NO: 166545 - protein, 9 aa, Homo Sapiens
SIYSRFVQL

SEQ ID NO: 166546 - protein, 9 aa, Homo Sapiens
SIYVKFPLL

SEQ ID NO: 166547 - protein, 9 aa, Homo Sapiens
SLFPGKLEV

SEQ ID NO: 166548 - protein, 9 aa, Homo Sapiens
SLHDAIMIV

SEQ ID NO: 166549 - protein, 9 aa, Homo Sapiens
SLIKYFLFV

SEQ ID NO: 166550 - protein, 9 aa, Homo Sapiens
SLLGHLMIV

SEQ ID NO: 166551 - protein, 9 aa, Homo Sapiens
SLNAQVLLL

SEQ ID NO: 166552 - protein, 9 aa, Homo Sapiens
SLPVYAIIV

SEQ ID NO: 166553 - protein, 9 aa, Homo Sapiens
SLQKLFREV

SEQ ID NO: 166554 - protein, 9 aa, Homo Sapiens
SLSQVFLHL

SEQ ID NO: 166555 - protein, 9 aa, Homo Sapiens
SLYGQFRVV

SEQ ID NO: 166556 - protein, 9 aa, Homo Sapiens
SLYPHFTLL

SEQ ID NO: 166557 - protein, 9 aa, Homo Sapiens
SMRYFYTAV

SEQ ID NO: 166558 - protein, 9 aa, Homo Sapiens
SMVTAFLVV

SEQ ID NO: 166559 - protein, 9 aa, Homo Sapiens
SMYDKVLML

SEQ ID NO: 166560 - protein, 9 aa, Homo Sapiens
SNAKHLEIL

SEQ ID NO: 166561 - protein, 9 aa, Homo Sapiens
SNFDRFSEM

SEQ ID NO: 166562 - protein, 9 aa, Homo Sapiens
SNHDVILWL

SEQ ID NO: 166563 - protein, 9 aa, Homo Sapiens
SNIDKSLYV

SEQ ID NO: 166564 - protein, 9 aa, Homo Sapiens
SNINQPLEI

SEQ ID NO: 166565 - protein, 9 aa, Homo Sapiens
SNINRQLEV

SEQ ID NO: 166566 - protein, 9 aa, Homo Sapiens
SNNEIVLVL

SEQ ID NO: 166567 - protein, 9 aa, Homo Sapiens
SNNRLFQLV

SEQ ID NO: 166568 - protein, 9 aa, Homo Sapiens
SNSDVIIYV

SEQ ID NO: 166569 - protein, 9 aa, Homo Sapiens
SNYFKMLFV

SEQ ID NO: 166570 - protein, 9 aa, Homo Sapiens
SQLPGLLEL

SEQ ID NO: 166571 - protein, 9 aa, Homo Sapiens
SQNFKVVVV

SEQ ID NO: 166572 - protein, 9 aa, Homo Sapiens
SQNPWQRLV

SEQ ID NO: 166573 - protein, 9 aa, Homo Sapiens
SQYPFPVTL

SEQ ID NO: 166574 - protein, 9 aa, Homo Sapiens
SSAHVYLRL

SEQ ID NO: 166575 - protein, 9 aa, Homo Sapiens
SSAKRPLWL

SEQ ID NO: 166576 - protein, 9 aa, Homo Sapiens
SSAPPHTIL

SEQ ID NO: 166577 - protein, 9 aa, Homo Sapiens
SSAQFALRL

SEQ ID NO: 166578 - protein, 9 aa, Homo Sapiens
SSAVRALEL

SEQ ID NO: 166579 - protein, 9 aa, Homo Sapiens
SSAYCPLEL

SEQ ID NO: 166580 - protein, 9 aa, Homo Sapiens
SSDGHEFIV

SEQ ID NO: 166581 - protein, 9 aa, Homo Sapiens
SSDPIALGV

SEQ ID NO: 166582 - protein, 9 aa, Homo Sapiens
SSDPKVLTL

SEQ ID NO: 166583 - protein, 9 aa, Homo Sapiens
SSEPFGHLV

SEQ ID NO: 166584 - protein, 9 aa, Homo Sapiens
SSFFKSLVI

SEQ ID NO: 166585 - protein, 9 aa, Homo Sapiens
SSFPGVTVI

SEQ ID NO: 166586 - protein, 9 aa, Homo Sapiens
SSFPRFYFV

SEQ ID NO: 166587 - protein, 9 aa, Homo Sapiens
SSFQKVLEL

SEQ ID NO: 166588 - protein, 9 aa, Homo Sapiens
SSFSRFIMV

SEQ ID NO: 166589 - protein, 9 aa, Homo Sapiens
SSGRVQLVV

SEQ ID NO: 166590 - protein, 9 aa, Homo Sapiens
SSGSHLVFV

SEQ ID NO: 166591 - protein, 9 aa, Homo Sapiens
SSHGRVLSL

SEQ ID NO: 166592 - protein, 9 aa, Homo Sapiens
SSHPIILYL

SEQ ID NO: 166593 - protein, 9 aa, Homo Sapiens
SSHYMTLVV

SEQ ID NO: 166594 - protein, 9 aa, Homo Sapiens
SSIEHLTTL

SEQ ID NO: 166595 - protein, 9 aa, Homo Sapiens
SSIEKIVEI

SEQ ID NO: 166596 - protein, 9 aa, Homo Sapiens
SSIGIPIAV

SEQ ID NO: 166597 - protein, 9 aa, Homo Sapiens
SSIPWFLRV

SEQ ID NO: 166598 - protein, 9 aa, Homo Sapiens
SSISKSPLL

SEQ ID NO: 166599 - protein, 9 aa, Homo Sapiens
SSISVILHI

SEQ ID NO: 166600 - protein, 9 aa, Homo Sapiens
SSITSLKKL

SEQ ID NO: 166601 - protein, 9 aa, Homo Sapiens
SSLARLPSL

SEQ ID NO: 166602 - protein, 9 aa, Homo Sapiens
SSLEKSYEL

SEQ ID NO: 166603 - protein, 9 aa, Homo Sapiens
SSLELPLAV

SEQ ID NO: 166604 - protein, 9 aa, Homo Sapiens
SSLQKLLEV

SEQ ID NO: 166605 - protein, 9 aa, Homo Sapiens
SSLQRILEI

SEQ ID NO: 166606 - protein, 9 aa, Homo Sapiens
SSLRRWLEL

SEQ ID NO: 166607 - protein, 9 aa, Homo Sapiens
SSLSHAMVI

SEQ ID NO: 166608 - protein, 9 aa, Homo Sapiens
SSLSKMSYL

SEQ ID NO: 166609 - protein, 9 aa, Homo Sapiens
SSLSRFLMV

SEQ ID NO: 166610 - protein, 9 aa, Homo Sapiens
SSLYHHLHV

SEQ ID NO: 166611 - protein, 9 aa, Homo Sapiens
SSMAEFLKV

SEQ ID NO: 166612 - protein, 9 aa, Homo Sapiens
SSMPRPVKV

SEQ ID NO: 166613 - protein, 9 aa, Homo Sapiens
SSMTRPQEL

SEQ ID NO: 166614 - protein, 9 aa, Homo Sapiens
SSNAIDLVV

SEQ ID NO: 166615 - protein, 9 aa, Homo Sapiens
SSNAVPLKV

SEQ ID NO: 166616 - protein, 9 aa, Homo Sapiens
SSNDMLLFI

SEQ ID NO: 166617 - protein, 9 aa, Homo Sapiens
SSNDRVLAI

SEQ ID NO: 166618 - protein, 9 aa, Homo Sapiens
SSNKALLEM

SEQ ID NO: 166619 - protein, 9 aa, Homo Sapiens
SSNLRNLEI

SEQ ID NO: 166620 - protein, 9 aa, Homo Sapiens
SSNMVIMLI

SEQ ID NO: 166621 - protein, 9 aa, Homo Sapiens
SSNPIIVSC

SEQ ID NO: 166622 - protein, 9 aa, Homo Sapiens
SSNPVPLYA

SEQ ID NO: 166623 - protein, 9 aa, Homo Sapiens
SSNQFLIYV

SEQ ID NO: 166624 - protein, 9 aa, Homo Sapiens
SSNTWSPKL

SEQ ID NO: 166625 - protein, 9 aa, Homo Sapiens
SSNVIQLII

SEQ ID NO: 166626 - protein, 9 aa, Homo Sapiens
SSNVIVLLL

SEQ ID NO: 166627 - protein, 9 aa, Homo Sapiens
SSNVVQLIM

SEQ ID NO: 166628 - protein, 9 aa, Homo Sapiens
SSQELFRLL

SEQ ID NO: 166629 - protein, 9 aa, Homo Sapiens
SSQGTVRFF

SEQ ID NO: 166630 - protein, 9 aa, Homo Sapiens
SSQTQPLKV

SEQ ID NO: 166631 - protein, 9 aa, Homo Sapiens
SSQVHPLAV

SEQ ID NO: 166632 - protein, 9 aa, Homo Sapiens
SSSAVFLII

SEQ ID NO: 166633 - protein, 9 aa, Homo Sapiens
SSSHLNLKV

SEQ ID NO: 166634 - protein, 9 aa, Homo Sapiens
SSSIKDLVL

SEQ ID NO: 166635 - protein, 9 aa, Homo Sapiens
SSSKLTLHV

SEQ ID NO: 166636 - protein, 9 aa, Homo Sapiens
SSSPAVLAL

SEQ ID NO: 166637 - protein, 9 aa, Homo Sapiens
SSSPFIIKV

SEQ ID NO: 166638 - protein, 9 aa, Homo Sapiens
SSSPNIMLL

SEQ ID NO: 166639 - protein, 9 aa, Homo Sapiens
SSSPRPVAL

SEQ ID NO: 166640 - protein, 9 aa, Homo Sapiens
SSSPSPLSI

SEQ ID NO: 166641 - protein, 9 aa, Homo Sapiens
SSSQWALVV

SEQ ID NO: 166642 - protein, 9 aa, Homo Sapiens
SSSSRFLEV

SEQ ID NO: 166643 - protein, 9 aa, Homo Sapiens
SSSTLNLVV

SEQ ID NO: 166644 - protein, 9 aa, Homo Sapiens
SSTDFVLKL

SEQ ID NO: 166645 - protein, 9 aa, Homo Sapiens
SSTRSLLSV

SEQ ID NO: 166646 - protein, 9 aa, Homo Sapiens
SSTSHVPEV

SEQ ID NO: 166647 - protein, 9 aa, Homo Sapiens
SSVDQPLKI

SEQ ID NO: 166648 - protein, 9 aa, Homo Sapiens
SSVGKVSVL

SEQ ID NO: 166649 - protein, 9 aa, Homo Sapiens
SSVHVIMYL

SEQ ID NO: 166650 - protein, 9 aa, Homo Sapiens
SSVPGVRLL

SEQ ID NO: 166651 - protein, 9 aa, Homo Sapiens
SSVPVVLRV

SEQ ID NO: 166652 - protein, 9 aa, Homo Sapiens
SSVTKVLLL

SEQ ID NO: 166653 - protein, 9 aa, Homo Sapiens
SSYAKFNFV

SEQ ID NO: 166654 - protein, 9 aa, Homo Sapiens
SSYAYILMV

SEQ ID NO: 166655 - protein, 9 aa, Homo Sapiens
SSYENELML

SEQ ID NO: 166656 - protein, 9 aa, Homo Sapiens
SSYFHSRIV

SEQ ID NO: 166657 - protein, 9 aa, Homo Sapiens
SSYFRAMFM

SEQ ID NO: 166658 - protein, 9 aa, Homo Sapiens
SSYGKLLLI

SEQ ID NO: 166659 - protein, 9 aa, Homo Sapiens
SSYGNIRAV

SEQ ID NO: 166660 - protein, 9 aa, Homo Sapiens
SSYMPARVV

SEQ ID NO: 166661 - protein, 9 aa, Homo Sapiens
SSYSRALEM

SEQ ID NO: 166662 - protein, 9 aa, Homo Sapiens
SSYYFDLQL

SEQ ID NO: 166663 - protein, 9 aa, Homo Sapiens
SSYYGVVRL

SEQ ID NO: 166664 - protein, 9 aa, Homo Sapiens
STAYYALVV

SEQ ID NO: 166665 - protein, 9 aa, Homo Sapiens
STFGEVLMV

SEQ ID NO: 166666 - protein, 9 aa, Homo Sapiens
STFSGFGFI

SEQ ID NO: 166667 - protein, 9 aa, Homo Sapiens
STHKWMVYV

SEQ ID NO: 166668 - protein, 9 aa, Homo Sapiens
STHSKVLYV

SEQ ID NO: 166669 - protein, 9 aa, Homo Sapiens
STIALALGV

SEQ ID NO: 166670 - protein, 9 aa, Homo Sapiens
STIDHFLEI

SEQ ID NO: 166671 - protein, 9 aa, Homo Sapiens
STIDKVSVL

SEQ ID NO: 166672 - protein, 9 aa, Homo Sapiens
STINTVLKM

SEQ ID NO: 166673 - protein, 9 aa, Homo Sapiens
STIRLLTSL

SEQ ID NO: 166674 - protein, 9 aa, Homo Sapiens
STIVQVLEV

SEQ ID NO: 166675 - protein, 9 aa, Homo Sapiens
STLHLVLRL

SEQ ID NO: 166676 - protein, 9 aa, Homo Sapiens
STLPAGVTV

SEQ ID NO: 166677 - protein, 9 aa, Homo Sapiens
STLRNIRTV

SEQ ID NO: 166678 - protein, 9 aa, Homo Sapiens
STNADALYV

SEQ ID NO: 166679 - protein, 9 aa, Homo Sapiens
STNIHELRV

SEQ ID NO: 166680 - protein, 9 aa, Homo Sapiens
STNKYQLSI

SEQ ID NO: 166681 - protein, 9 aa, Homo Sapiens
STNPITVTV

SEQ ID NO: 166682 - protein, 9 aa, Homo Sapiens
STNQHIIRL

SEQ ID NO: 166683 - protein, 9 aa, Homo Sapiens
STNRFVRTV

SEQ ID NO: 166684 - protein, 9 aa, Homo Sapiens
STNSVKLEM

SEQ ID NO: 166685 - protein, 9 aa, Homo Sapiens
STNSVRLML

SEQ ID NO: 166686 - protein, 9 aa, Homo Sapiens
STNTRVLYF

SEQ ID NO: 166687 - protein, 9 aa, Homo Sapiens
STSLSYITL

SEQ ID NO: 166688 - protein, 9 aa, Homo Sapiens
STSPWIPQL

SEQ ID NO: 166689 - protein, 9 aa, Homo Sapiens
STSSVFRLV

SEQ ID NO: 166690 - protein, 9 aa, Homo Sapiens
STTELPLTV

SEQ ID NO: 166691 - protein, 9 aa, Homo Sapiens
STVFGTLHV

SEQ ID NO: 166692 - protein, 9 aa, Homo Sapiens
STWEKPQEL

SEQ ID NO: 166693 - protein, 9 aa, Homo Sapiens
STYAGIRKV

SEQ ID NO: 166694 - protein, 9 aa, Homo Sapiens
STYLKLRFL

SEQ ID NO: 166695 - protein, 9 aa, Homo Sapiens
STYLRPLLV

SEQ ID NO: 166696 - protein, 9 aa, Homo Sapiens
STYPAPFYV

SEQ ID NO: 166697 - protein, 9 aa, Homo Sapiens
SVANNRLFV

SEQ ID NO: 166698 - protein, 9 aa, Homo Sapiens
SVFKLLPQL

SEQ ID NO: 166699 - protein, 9 aa, Homo Sapiens
SVHKGFAFV

SEQ ID NO: 166700 - protein, 9 aa, Homo Sapiens
SVIEQLFFV

SEQ ID NO: 166701 - protein, 9 aa, Homo Sapiens
SVIPQIQKV

SEQ ID NO: 166702 - protein, 9 aa, Homo Sapiens
SVISHLLRV

SEQ ID NO: 166703 - protein, 9 aa, Homo Sapiens
SVISVVSYL

SEQ ID NO: 166704 - protein, 9 aa, Homo Sapiens
SVLAKALEV

SEQ ID NO: 166705 - protein, 9 aa, Homo Sapiens
SVNATPLTI

SEQ ID NO: 166706 - protein, 9 aa, Homo Sapiens
SVNFVDLYV

SEQ ID NO: 166707 - protein, 9 aa, Homo Sapiens
SVNIQELLL

SEQ ID NO: 166708 - protein, 9 aa, Homo Sapiens
SVNPHDITV

SEQ ID NO: 166709 - protein, 9 aa, Homo Sapiens
SVNPYIVKL

SEQ ID NO: 166710 - protein, 9 aa, Homo Sapiens
SVNRYILQL

SEQ ID NO: 166711 - protein, 9 aa, Homo Sapiens
SVNTLPVVV

SEQ ID NO: 166712 - protein, 9 aa, Homo Sapiens
SVSGDRLIV

SEQ ID NO: 166713 - protein, 9 aa, Homo Sapiens
SVTQIYHAV

SEQ ID NO: 166714 - protein, 9 aa, Homo Sapiens
SVVFHSTVI

SEQ ID NO: 166715 - protein, 9 aa, Homo Sapiens
SVVSFLLRV

SEQ ID NO: 166716 - protein, 9 aa, Homo Sapiens
SVVSQFITV

SEQ ID NO: 166717 - protein, 9 aa, Homo Sapiens
SVYDGKLLI

SEQ ID NO: 166718 - protein, 9 aa, Homo Sapiens
SVYEFFKYL

SEQ ID NO: 166719 - protein, 9 aa, Homo Sapiens
SVYGKLRKV

SEQ ID NO: 166720 - protein, 9 aa, Homo Sapiens
SVYPNGHFV

SEQ ID NO: 166721 - protein, 9 aa, Homo Sapiens
SVYSRVIQV

SEQ ID NO: 166722 - protein, 9 aa, Homo Sapiens
TAAIKDLQV

SEQ ID NO: 166723 - protein, 9 aa, Homo Sapiens
TAAVHIILV

SEQ ID NO: 166724 - protein, 9 aa, Homo Sapiens
TADIPALFL

SEQ ID NO: 166725 - protein, 9 aa, Homo Sapiens
TAFAHLREV

SEQ ID NO: 166726 - protein, 9 aa, Homo Sapiens
TAHPSPLSV

SEQ ID NO: 166727 - protein, 9 aa, Homo Sapiens
TAISLFYEL

SEQ ID NO: 166728 - protein, 9 aa, Homo Sapiens
TALNRFLQV

SEQ ID NO: 166729 - protein, 9 aa, Homo Sapiens
TAMTVQILL

SEQ ID NO: 166730 - protein, 9 aa, Homo Sapiens
TANGYILFF

SEQ ID NO: 166731 - protein, 9 aa, Homo Sapiens
TANRHVLRI

SEQ ID NO: 166732 - protein, 9 aa, Homo Sapiens
TANSKIVVV

SEQ ID NO: 166733 - protein, 9 aa, Homo Sapiens
TASDKILIV

SEQ ID NO: 166734 - protein, 9 aa, Homo Sapiens
TASKVIVAV

SEQ ID NO: 166735 - protein, 9 aa, Homo Sapiens
TASRQHLYV

SEQ ID NO: 166736 - protein, 9 aa, Homo Sapiens
TATMHILVV

SEQ ID NO: 166737 - protein, 9 aa, Homo Sapiens
TATRWPLAV

SEQ ID NO: 166738 - protein, 9 aa, Homo Sapiens
TAYDNFVEL

SEQ ID NO: 166739 - protein, 9 aa, Homo Sapiens
TAYLFSRFV

SEQ ID NO: 166740 - protein, 9 aa, Homo Sapiens
TGFPHMLFM

SEQ ID NO: 166741 - protein, 9 aa, Homo Sapiens
TGVAVFLGV

SEQ ID NO: 166742 - protein, 9 aa, Homo Sapiens
TILPKTGTV

SEQ ID NO: 166743 - protein, 9 aa, Homo Sapiens
TILPKVMQV

SEQ ID NO: 166744 - protein, 9 aa, Homo Sapiens
TIMDKMMVA

SEQ ID NO: 166745 - protein, 9 aa, Homo Sapiens
TINAEELLL

SEQ ID NO: 166746 - protein, 9 aa, Homo Sapiens
TINDIVHVV

SEQ ID NO: 166747 - protein, 9 aa, Homo Sapiens
TIQSIMAIV

SEQ ID NO: 166748 - protein, 9 aa, Homo Sapiens
TIRDKFARL

SEQ ID NO: 166749 - protein, 9 aa, Homo Sapiens
TIRLFWNEV

SEQ ID NO: 166750 - protein, 9 aa, Homo Sapiens
TIRPGWLTV

SEQ ID NO: 166751 - protein, 9 aa, Homo Sapiens
TISPIILYF

SEQ ID NO: 166752 - protein, 9 aa, Homo Sapiens
TIYDRFVHL

SEQ ID NO: 166753 - protein, 9 aa, Homo Sapiens
TIYERFVLV

SEQ ID NO: 166754 - protein, 9 aa, Homo Sapiens
TLKHKFKTL

SEQ ID NO: 166755 - protein, 9 aa, Homo Sapiens
TLMGHMLYL

SEQ ID NO: 166756 - protein, 9 aa, Homo Sapiens
TLNRYLLLM

SEQ ID NO: 166757 - protein, 9 aa, Homo Sapiens
TLNSKLLKV

SEQ ID NO: 166758 - protein, 9 aa, Homo Sapiens
TNIPHVQMV

SEQ ID NO: 166759 - protein, 9 aa, Homo Sapiens
TNMEYAVKV

SEQ ID NO: 166760 - protein, 9 aa, Homo Sapiens
TNQDWMLRV

SEQ ID NO: 166761 - protein, 9 aa, Homo Sapiens
TNSSWLLRL

SEQ ID NO: 166762 - protein, 9 aa, Homo Sapiens
TNVDKPLRI

SEQ ID NO: 166763 - protein, 9 aa, Homo Sapiens
TQNYLKLLL

SEQ ID NO: 166764 - protein, 9 aa, Homo Sapiens
TSAAIYHVL

SEQ ID NO: 166765 - protein, 9 aa, Homo Sapiens
TSAVPNLFV

SEQ ID NO: 166766 - protein, 9 aa, Homo Sapiens
TSDFHQLIL

SEQ ID NO: 166767 - protein, 9 aa, Homo Sapiens
TSDPAEVLV

SEQ ID NO: 166768 - protein, 9 aa, Homo Sapiens
TSDPLELFL

SEQ ID NO: 166769 - protein, 9 aa, Homo Sapiens
TSEIKSLFV

SEQ ID NO: 166770 - protein, 9 aa, Homo Sapiens
TSGINPLLV

SEQ ID NO: 166771 - protein, 9 aa, Homo Sapiens
TSHPVLLTV

SEQ ID NO: 166772 - protein, 9 aa, Homo Sapiens
TSIANLPKL

SEQ ID NO: 166773 - protein, 9 aa, Homo Sapiens
TSIAQLKVV

SEQ ID NO: 166774 - protein, 9 aa, Homo Sapiens
TSIGHVVQL

SEQ ID NO: 166775 - protein, 9 aa, Homo Sapiens
TSIQRIQRL

SEQ ID NO: 166776 - protein, 9 aa, Homo Sapiens
TSISHYVIV

SEQ ID NO: 166777 - protein, 9 aa, Homo Sapiens
TSISLLPAL

SEQ ID NO: 166778 - protein, 9 aa, Homo Sapiens
TSKIPALAV

SEQ ID NO: 166779 - protein, 9 aa, Homo Sapiens
TSMDWLPQL

SEQ ID NO: 166780 - protein, 9 aa, Homo Sapiens
TSMSKILKC

SEQ ID NO: 166781 - protein, 9 aa, Homo Sapiens
TSMTRVIEV

SEQ ID NO: 166782 - protein, 9 aa, Homo Sapiens
TSMVTALQL

SEQ ID NO: 166783 - protein, 9 aa, Homo Sapiens
TSNFQAIRV

SEQ ID NO: 166784 - protein, 9 aa, Homo Sapiens
TSNTVKLLL

SEQ ID NO: 166785 - protein, 9 aa, Homo Sapiens
TSNTYVMVV

SEQ ID NO: 166786 - protein, 9 aa, Homo Sapiens
TSNVLPLLL

SEQ ID NO: 166787 - protein, 9 aa, Homo Sapiens
TSQEYAVKI

SEQ ID NO: 166788 - protein, 9 aa, Homo Sapiens
TSQIQRLIV

SEQ ID NO: 166789 - protein, 9 aa, Homo Sapiens
TSQSRVMNV

SEQ ID NO: 166790 - protein, 9 aa, Homo Sapiens
TSQVKVVEV

SEQ ID NO: 166791 - protein, 9 aa, Homo Sapiens
TSREIFNFV

SEQ ID NO: 166792 - protein, 9 aa, Homo Sapiens
TSSGVVWEV

SEQ ID NO: 166793 - protein, 9 aa, Homo Sapiens
TSSPINIVV

SEQ ID NO: 166794 - protein, 9 aa, Homo Sapiens
TSSPSILTL

SEQ ID NO: 166795 - protein, 9 aa, Homo Sapiens
TSSQKALML

SEQ ID NO: 166796 - protein, 9 aa, Homo Sapiens
TSSVVTLEV

SEQ ID NO: 166797 - protein, 9 aa, Homo Sapiens
TSSWVNLVL

SEQ ID NO: 166798 - protein, 9 aa, Homo Sapiens
TSTGKNLLV

SEQ ID NO: 166799 - protein, 9 aa, Homo Sapiens
TSTPNVHMV

SEQ ID NO: 166800 - protein, 9 aa, Homo Sapiens
TSTSDILKV

SEQ ID NO: 166801 - protein, 9 aa, Homo Sapiens
TSVPKPLKF

SEQ ID NO: 166802 - protein, 9 aa, Homo Sapiens
TSYPDPILL

SEQ ID NO: 166803 - protein, 9 aa, Homo Sapiens
TTFPRPVTV

SEQ ID NO: 166804 - protein, 9 aa, Homo Sapiens
TTISKVSQV

SEQ ID NO: 166805 - protein, 9 aa, Homo Sapiens
TTNGGILTV

SEQ ID NO: 166806 - protein, 9 aa, Homo Sapiens
TTNIQELNV

SEQ ID NO: 166807 - protein, 9 aa, Homo Sapiens
TTNPQELML

SEQ ID NO: 166808 - protein, 9 aa, Homo Sapiens
TTNPYVLMV

SEQ ID NO: 166809 - protein, 9 aa, Homo Sapiens
TTTLHMLTL

SEQ ID NO: 166810 - protein, 9 aa, Homo Sapiens
TVLPFVSTV

SEQ ID NO: 166811 - protein, 9 aa, Homo Sapiens
TVNEIVLKV

SEQ ID NO: 166812 - protein, 9 aa, Homo Sapiens
TVNEVELLV

SEQ ID NO: 166813 - protein, 9 aa, Homo Sapiens
TVNFRKLLL

SEQ ID NO: 166814 - protein, 9 aa, Homo Sapiens
TVNLHLLML

SEQ ID NO: 166815 - protein, 9 aa, Homo Sapiens
TVNSKALEI

SEQ ID NO: 166816 - protein, 9 aa, Homo Sapiens
TVSGRILVV

SEQ ID NO: 166817 - protein, 9 aa, Homo Sapiens
TVTDRYIFV

SEQ ID NO: 166818 - protein, 9 aa, Homo Sapiens
TVYPMERLV

SEQ ID NO: 166819 - protein, 9 aa, Homo Sapiens
VADLVGFLL

SEQ ID NO: 166820 - protein, 9 aa, Homo Sapiens
VAFHIPFEV

SEQ ID NO: 166821 - protein, 9 aa, Homo Sapiens
VAIAGLMEV

SEQ ID NO: 166822 - protein, 9 aa, Homo Sapiens
VAIKAGTTL

SEQ ID NO: 166823 - protein, 9 aa, Homo Sapiens
VAIQAGRLL

SEQ ID NO: 166824 - protein, 9 aa, Homo Sapiens
VALAHIRHV

SEQ ID NO: 166825 - protein, 9 aa, Homo Sapiens
VALEHFVLV

SEQ ID NO: 166826 - protein, 9 aa, Homo Sapiens
VALGHRLDI

SEQ ID NO: 166827 - protein, 9 aa, Homo Sapiens
VALPVFLVI

SEQ ID NO: 166828 - protein, 9 aa, Homo Sapiens
VALPVYLLI

SEQ ID NO: 166829 - protein, 9 aa, Homo Sapiens
VAMGRVVKV

SEQ ID NO: 166830 - protein, 9 aa, Homo Sapiens
VASTQDLRV

SEQ ID NO: 166831 - protein, 9 aa, Homo Sapiens
VASVPHSII

SEQ ID NO: 166832 - protein, 9 aa, Homo Sapiens
VAVAGLLTV

SEQ ID NO: 166833 - protein, 9 aa, Homo Sapiens
VAVPKSMRV

SEQ ID NO: 166834 - protein, 9 aa, Homo Sapiens
VGDIHILEV

SEQ ID NO: 166835 - protein, 9 aa, Homo Sapiens
VGDPVRLEV

SEQ ID NO: 166836 - protein, 9 aa, Homo Sapiens
VGNFKFIYV

SEQ ID NO: 166837 - protein, 9 aa, Homo Sapiens
VGNRHGLLV

SEQ ID NO: 166838 - protein, 9 aa, Homo Sapiens
VGQTRVLML

SEQ ID NO: 166839 - protein, 9 aa, Homo Sapiens
VGSEVHLEI

SEQ ID NO: 166840 - protein, 9 aa, Homo Sapiens
VGTIIYHEV

SEQ ID NO: 166841 - protein, 9 aa, Homo Sapiens
VGTSIHYKV

SEQ ID NO: 166842 - protein, 9 aa, Homo Sapiens
VIAPVLLVV

SEQ ID NO: 166843 - protein, 9 aa, Homo Sapiens
VIATNILLV

SEQ ID NO: 166844 - protein, 9 aa, Homo Sapiens
VIFDRFRGV

SEQ ID NO: 166845 - protein, 9 aa, Homo Sapiens
VIFTKFDEV

SEQ ID NO: 166846 - protein, 9 aa, Homo Sapiens
VIIEKTYSL

SEQ ID NO: 166847 - protein, 9 aa, Homo Sapiens
VIIERLLLL

SEQ ID NO: 166848 - protein, 9 aa, Homo Sapiens
VIIPLLHTV

SEQ ID NO: 166849 - protein, 9 aa, Homo Sapiens
VILDLPLVI

SEQ ID NO: 166850 - protein, 9 aa, Homo Sapiens
VIMSQYLEL

SEQ ID NO: 166851 - protein, 9 aa, Homo Sapiens
VINDWFKVL

SEQ ID NO: 166852 - protein, 9 aa, Homo Sapiens
VINEEALSV

SEQ ID NO: 166853 - protein, 9 aa, Homo Sapiens
VINGHTLCL

SEQ ID NO: 166854 - protein, 9 aa, Homo Sapiens
VINGNIKTV

SEQ ID NO: 166855 - protein, 9 aa, Homo Sapiens
VINGNPITI

SEQ ID NO: 166856 - protein, 9 aa, Homo Sapiens
VINKKQLQL

SEQ ID NO: 166857 - protein, 9 aa, Homo Sapiens
VINKVKLEV

SEQ ID NO: 166858 - protein, 9 aa, Homo Sapiens
VINPEPITL

SEQ ID NO: 166859 - protein, 9 aa, Homo Sapiens
VINPKDLRI

SEQ ID NO: 166860 - protein, 9 aa, Homo Sapiens
VINPTAITV

SEQ ID NO: 166861 - protein, 9 aa, Homo Sapiens
VIQIHLLLI

SEQ ID NO: 166862 - protein, 9 aa, Homo Sapiens
VIRQITATV

SEQ ID NO: 166863 - protein, 9 aa, Homo Sapiens
VIYANFNRI

SEQ ID NO: 166864 - protein, 9 aa, Homo Sapiens
VIYDKDQFV

SEQ ID NO: 166865 - protein, 9 aa, Homo Sapiens
VLNGKLLLV

SEQ ID NO: 166866 - protein, 9 aa, Homo Sapiens
VLYDRPLKI

SEQ ID NO: 166867 - protein, 9 aa, Homo Sapiens
VMDTHLLFL

SEQ ID NO: 166868 - protein, 9 aa, Homo Sapiens
VMNKLRLLV

SEQ ID NO: 166869 - protein, 9 aa, Homo Sapiens
VMRWFQAML

SEQ ID NO: 166870 - protein, 9 aa, Homo Sapiens
VNINRIMSV

SEQ ID NO: 166871 - protein, 9 aa, Homo Sapiens
VNNPHFLIM

SEQ ID NO: 166872 - protein, 9 aa, Homo Sapiens
VNNPKSLSL

SEQ ID NO: 166873 - protein, 9 aa, Homo Sapiens
VQNDTLLQV

SEQ ID NO: 166874 - protein, 9 aa, Homo Sapiens
VQNHEFLLV

SEQ ID NO: 166875 - protein, 9 aa, Homo Sapiens
VQNPALRLV

SEQ ID NO: 166876 - protein, 9 aa, Homo Sapiens
VQYALPLQL

SEQ ID NO: 166877 - protein, 9 aa, Homo Sapiens
VQYAYFKKV

SEQ ID NO: 166878 - protein, 9 aa, Homo Sapiens
VQYNEPLKV

SEQ ID NO: 166879 - protein, 9 aa, Homo Sapiens
VQYPYQLYI

SEQ ID NO: 166880 - protein, 9 aa, Homo Sapiens
VSAAFAVKL

SEQ ID NO: 166881 - protein, 9 aa, Homo Sapiens
VSAENILTV

SEQ ID NO: 166882 - protein, 9 aa, Homo Sapiens
VSAPPMPSV

SEQ ID NO: 166883 - protein, 9 aa, Homo Sapiens
VSARNIMLL

SEQ ID NO: 166884 - protein, 9 aa, Homo Sapiens
VSDTEILKV

SEQ ID NO: 166885 - protein, 9 aa, Homo Sapiens
VSEIRILLV

SEQ ID NO: 166886 - protein, 9 aa, Homo Sapiens
VSFGDFVQV

SEQ ID NO: 166887 - protein, 9 aa, Homo Sapiens
VSFKRSMVL

SEQ ID NO: 166888 - protein, 9 aa, Homo Sapiens
VSFPYVIAL

SEQ ID NO: 166889 - protein, 9 aa, Homo Sapiens
VSFSRPLLV

SEQ ID NO: 166890 - protein, 9 aa, Homo Sapiens
VSFYHWAMV

SEQ ID NO: 166891 - protein, 9 aa, Homo Sapiens
VSGPRLFLL

SEQ ID NO: 166892 - protein, 9 aa, Homo Sapiens
VSHPRYLEL

SEQ ID NO: 166893 - protein, 9 aa, Homo Sapiens
VSIDTVTVL

SEQ ID NO: 166894 - protein, 9 aa, Homo Sapiens
VSIGKGVTV

SEQ ID NO: 166895 - protein, 9 aa, Homo Sapiens
VSIGQSLKV

SEQ ID NO: 166896 - protein, 9 aa, Homo Sapiens
VSILSPKEV

SEQ ID NO: 166897 - protein, 9 aa, Homo Sapiens
VSITFIKQI

SEQ ID NO: 166898 - protein, 9 aa, Homo Sapiens
VSLAEALEV

SEQ ID NO: 166899 - protein, 9 aa, Homo Sapiens
VSLARALFM

SEQ ID NO: 166900 - protein, 9 aa, Homo Sapiens
VSLGHISML

SEQ ID NO: 166901 - protein, 9 aa, Homo Sapiens
VSLGQALEV

SEQ ID NO: 166902 - protein, 9 aa, Homo Sapiens
VSLNRIFTV

SEQ ID NO: 166903 - protein, 9 aa, Homo Sapiens
VSMFRWLEV

SEQ ID NO: 166904 - protein, 9 aa, Homo Sapiens
VSMIPPLLL

SEQ ID NO: 166905 - protein, 9 aa, Homo Sapiens
VSMLRILFL

SEQ ID NO: 166906 - protein, 9 aa, Homo Sapiens
VSMPVFQSL

SEQ ID NO: 166907 - protein, 9 aa, Homo Sapiens
VSNDKALMV

SEQ ID NO: 166908 - protein, 9 aa, Homo Sapiens
VSNDLLLKI

SEQ ID NO: 166909 - protein, 9 aa, Homo Sapiens
VSNDWYATL

SEQ ID NO: 166910 - protein, 9 aa, Homo Sapiens
VSNPLEVYL

SEQ ID NO: 166911 - protein, 9 aa, Homo Sapiens
VSNPQTVGV

SEQ ID NO: 166912 - protein, 9 aa, Homo Sapiens
VSNSGITRV

SEQ ID NO: 166913 - protein, 9 aa, Homo Sapiens
VSNTRTVLL

SEQ ID NO: 166914 - protein, 9 aa, Homo Sapiens
VSNVKPLSL

SEQ ID NO: 166915 - protein, 9 aa, Homo Sapiens
VSQFIHLYL

SEQ ID NO: 166916 - protein, 9 aa, Homo Sapiens
VSQQRALAL

SEQ ID NO: 166917 - protein, 9 aa, Homo Sapiens
VSQYHELVV

SEQ ID NO: 166918 - protein, 9 aa, Homo Sapiens
VSSFVFLRF

SEQ ID NO: 166919 - protein, 9 aa, Homo Sapiens
VSSKVPYEI

SEQ ID NO: 166920 - protein, 9 aa, Homo Sapiens
VSSPNILRL

SEQ ID NO: 166921 - protein, 9 aa, Homo Sapiens
VSTAKHLLL

SEQ ID NO: 166922 - protein, 9 aa, Homo Sapiens
VSTPWLQHL

SEQ ID NO: 166923 - protein, 9 aa, Homo Sapiens
VSTSHLLIL

SEQ ID NO: 166924 - protein, 9 aa, Homo Sapiens
VSTSNISSL

SEQ ID NO: 166925 - protein, 9 aa, Homo Sapiens
VSTTRELYL

SEQ ID NO: 166926 - protein, 9 aa, Homo Sapiens
VSVAHALSL

SEQ ID NO: 166927 - protein, 9 aa, Homo Sapiens
VSVDRVKQL

SEQ ID NO: 166928 - protein, 9 aa, Homo Sapiens
VSVPYPSSL

SEQ ID NO: 166929 - protein, 9 aa, Homo Sapiens
VSYPLSLEL

SEQ ID NO: 166930 - protein, 9 aa, Homo Sapiens
VSYVRSVYL

SEQ ID NO: 166931 - protein, 9 aa, Homo Sapiens
VTATRQLLL

SEQ ID NO: 166932 - protein, 9 aa, Homo Sapiens
VTDAVALRV

SEQ ID NO: 166933 - protein, 9 aa, Homo Sapiens
VTDVGIRYV

SEQ ID NO: 166934 - protein, 9 aa, Homo Sapiens
VTEMNGRIV

SEQ ID NO: 166935 - protein, 9 aa, Homo Sapiens
VTFKSILFV

SEQ ID NO: 166936 - protein, 9 aa, Homo Sapiens
VTFYFQNTF

SEQ ID NO: 166937 - protein, 9 aa, Homo Sapiens
VTHIVPLFL

SEQ ID NO: 166938 - protein, 9 aa, Homo Sapiens
VTIARAIEL

SEQ ID NO: 166939 - protein, 9 aa, Homo Sapiens
VTIDGIRFV

SEQ ID NO: 166940 - protein, 9 aa, Homo Sapiens
VTIGHIALL

SEQ ID NO: 166941 - protein, 9 aa, Homo Sapiens
VTIGVWHTV

SEQ ID NO: 166942 - protein, 9 aa, Homo Sapiens
VTIKKALTL

SEQ ID NO: 166943 - protein, 9 aa, Homo Sapiens
VTITGIVKV

SEQ ID NO: 166944 - protein, 9 aa, Homo Sapiens
VTLEHPLFV

SEQ ID NO: 166945 - protein, 9 aa, Homo Sapiens
VTLLVALKV

SEQ ID NO: 166946 - protein, 9 aa, Homo Sapiens
VTMAHIIQI

SEQ ID NO: 166947 - protein, 9 aa, Homo Sapiens
VTMPAILKL

SEQ ID NO: 166948 - protein, 9 aa, Homo Sapiens
VTNAVLHEV

SEQ ID NO: 166949 - protein, 9 aa, Homo Sapiens
VTNEYQHML

SEQ ID NO: 166950 - protein, 9 aa, Homo Sapiens
VTNPKDVLV

SEQ ID NO: 166951 - protein, 9 aa, Homo Sapiens
VTNPNEVKV

SEQ ID NO: 166952 - protein, 9 aa, Homo Sapiens
VTNSKVKFV

SEQ ID NO: 166953 - protein, 9 aa, Homo Sapiens
VTNSQKLQL

SEQ ID NO: 166954 - protein, 9 aa, Homo Sapiens
VTNSVFHEI

SEQ ID NO: 166955 - protein, 9 aa, Homo Sapiens
VTNTTFLLM

SEQ ID NO: 166956 - protein, 9 aa, Homo Sapiens
VTRDLVSEV

SEQ ID NO: 166957 - protein, 9 aa, Homo Sapiens
VTSHIHLHV

SEQ ID NO: 166958 - protein, 9 aa, Homo Sapiens
VTSNRWLMV

SEQ ID NO: 166959 - protein, 9 aa, Homo Sapiens
VTSRWIPLI

SEQ ID NO: 166960 - protein, 9 aa, Homo Sapiens
VTSSHLPQL

SEQ ID NO: 166961 - protein, 9 aa, Homo Sapiens
VTTDIQVKV

SEQ ID NO: 166962 - protein, 9 aa, Homo Sapiens
VTVENFLRV

SEQ ID NO: 166963 - protein, 9 aa, Homo Sapiens
VTVPPGPSL

SEQ ID NO: 166964 - protein, 9 aa, Homo Sapiens
VTVQPSPYL

SEQ ID NO: 166965 - protein, 9 aa, Homo Sapiens
VTYGFPIML

SEQ ID NO: 166966 - protein, 9 aa, Homo Sapiens
VTYLFPIQV

SEQ ID NO: 166967 - protein, 9 aa, Homo Sapiens
VTYPGELLL

SEQ ID NO: 166968 - protein, 9 aa, Homo Sapiens
VTYSKPRLA

SEQ ID NO: 166969 - protein, 9 aa, Homo Sapiens
VVDGHKLEV

SEQ ID NO: 166970 - protein, 9 aa, Homo Sapiens
VVETGRRLV

SEQ ID NO: 166971 - protein, 9 aa, Homo Sapiens
VVGPHPLVV

SEQ ID NO: 166972 - protein, 9 aa, Homo Sapiens
VVIGKMLIL

SEQ ID NO: 166973 - protein, 9 aa, Homo Sapiens
VVKPPGSSL

SEQ ID NO: 166974 - protein, 9 aa, Homo Sapiens
VVLFFKTLL

SEQ ID NO: 166975 - protein, 9 aa, Homo Sapiens
VVLGQFLVL

SEQ ID NO: 166976 - protein, 9 aa, Homo Sapiens
VVLPYQMLL

SEQ ID NO: 166977 - protein, 9 aa, Homo Sapiens
VVNGRVLEL

SEQ ID NO: 166978 - protein, 9 aa, Homo Sapiens
VVNKIRLKI

SEQ ID NO: 166979 - protein, 9 aa, Homo Sapiens
VVNKTDLKV

SEQ ID NO: 166980 - protein, 9 aa, Homo Sapiens
VVNPQIFTA

SEQ ID NO: 166981 - protein, 9 aa, Homo Sapiens
VVNPYYLRV

SEQ ID NO: 166982 - protein, 9 aa, Homo Sapiens
VVNSGWLVV

SEQ ID NO: 166983 - protein, 9 aa, Homo Sapiens
VVNSVPLDL

SEQ ID NO: 166984 - protein, 9 aa, Homo Sapiens
VVNTHKLRL

SEQ ID NO: 166985 - protein, 9 aa, Homo Sapiens
VVNVWTHLL

SEQ ID NO: 166986 - protein, 9 aa, Homo Sapiens
VVQKLVLFL

SEQ ID NO: 166987 - protein, 9 aa, Homo Sapiens
VVQPQPLVV

SEQ ID NO: 166988 - protein, 9 aa, Homo Sapiens
VVTSPMLLV

SEQ ID NO: 166989 - protein, 9 aa, Homo Sapiens
VVYPWTQRF

SEQ ID NO: 166990 - protein, 9 aa, Homo Sapiens
WQNPHMLFL

SEQ ID NO: 166991 - protein, 9 aa, Homo Sapiens
WQNVRALYI

SEQ ID NO: 166992 - protein, 9 aa, Homo Sapiens
WSLPATATM

SEQ ID NO: 166993 - protein, 9 aa, Homo Sapiens
WSQSRFLYV

SEQ ID NO: 166994 - protein, 9 aa, Homo Sapiens
WSSDSNLLV

SEQ ID NO: 166995 - protein, 9 aa, Homo Sapiens
WTDGIAREV

SEQ ID NO: 166996 - protein, 9 aa, Homo Sapiens
WTSERVVSV

SEQ ID NO: 166997 - protein, 9 aa, Homo Sapiens
WTTSRVLKV

SEQ ID NO: 166998 - protein, 9 aa, Homo Sapiens
YAAQAHLKL

SEQ ID NO: 166999 - protein, 9 aa, Homo Sapiens
YAFAHILTV

SEQ ID NO: 167000 - protein, 9 aa, Homo Sapiens
YAFPKSITV

SEQ ID NO: 167001 - protein, 9 aa, Homo Sapiens
YAIGLVMRL

SEQ ID NO: 167002 - protein, 9 aa, Homo Sapiens
YAIHGVLEV

SEQ ID NO: 167003 - protein, 9 aa, Homo Sapiens
YAIKNIHGV

SEQ ID NO: 167004 - protein, 9 aa, Homo Sapiens
YALNHTLSV

SEQ ID NO: 167005 - protein, 9 aa, Homo Sapiens
YALPAGLEV

SEQ ID NO: 167006 - protein, 9 aa, Homo Sapiens
YAMRYFATV

SEQ ID NO: 167007 - protein, 9 aa, Homo Sapiens
YANAKIYKL

SEQ ID NO: 167008 - protein, 9 aa, Homo Sapiens
YANKYNIML

SEQ ID NO: 167009 - protein, 9 aa, Homo Sapiens
YASAGLLKV

SEQ ID NO: 167010 - protein, 9 aa, Homo Sapiens
YASRFVQLV

SEQ ID NO: 167011 - protein, 9 aa, Homo Sapiens
YASSKLLKI

SEQ ID NO: 167012 - protein, 9 aa, Homo Sapiens
YAYPGVLLI

SEQ ID NO: 167013 - protein, 9 aa, Homo Sapiens
YGMALVRFV

SEQ ID NO: 167014 - protein, 9 aa, Homo Sapiens
YGNKTELLV

SEQ ID NO: 167015 - protein, 9 aa, Homo Sapiens
YGNPNTLRL

SEQ ID NO: 167016 - protein, 9 aa, Homo Sapiens
YGNRQNLEL

SEQ ID NO: 167017 - protein, 9 aa, Homo Sapiens
YGNVVELRI

SEQ ID NO: 167018 - protein, 9 aa, Homo Sapiens
YGSPGILEF

SEQ ID NO: 167019 - protein, 9 aa, Homo Sapiens
YIAGFFLTV

SEQ ID NO: 167020 - protein, 9 aa, Homo Sapiens
YIHVHFLEV

SEQ ID NO: 167021 - protein, 9 aa, Homo Sapiens
YIMDWMDEM

SEQ ID NO: 167022 - protein, 9 aa, Homo Sapiens
YIQEHLLQI

SEQ ID NO: 167023 - protein, 9 aa, Homo Sapiens
YIYMHFGEV

SEQ ID NO: 167024 - protein, 9 aa, Homo Sapiens
YLLDHFLSM

SEQ ID NO: 167025 - protein, 9 aa, Homo Sapiens
YLNALVHLI

SEQ ID NO: 167026 - protein, 9 aa, Homo Sapiens
YLNDLIHSV

SEQ ID NO: 167027 - protein, 9 aa, Homo Sapiens
YLTEVFLHV

SEQ ID NO: 167028 - protein, 9 aa, Homo Sapiens
YLYFFRVLV

SEQ ID NO: 167029 - protein, 9 aa, Homo Sapiens
YNFEKPVVM

SEQ ID NO: 167030 - protein, 9 aa, Homo Sapiens
YNFPVEVEV

SEQ ID NO: 167031 - protein, 9 aa, Homo Sapiens
YNGNTALHV

SEQ ID NO: 167032 - protein, 9 aa, Homo Sapiens
YNIASLVRL

SEQ ID NO: 167033 - protein, 9 aa, Homo Sapiens
YNIDSHLLL

SEQ ID NO: 167034 - protein, 9 aa, Homo Sapiens
YNIEQEQKL

SEQ ID NO: 167035 - protein, 9 aa, Homo Sapiens
YNIEQIMYL

SEQ ID NO: 167036 - protein, 9 aa, Homo Sapiens
YNIPHGPVV

SEQ ID NO: 167037 - protein, 9 aa, Homo Sapiens
YNIPVIHAF

SEQ ID NO: 167038 - protein, 9 aa, Homo Sapiens
YNIQKESTL

SEQ ID NO: 167039 - protein, 9 aa, Homo Sapiens
YNITKSVAV

SEQ ID NO: 167040 - protein, 9 aa, Homo Sapiens
YNLPIILLV

SEQ ID NO: 167041 - protein, 9 aa, Homo Sapiens
YNMEMARKI

SEQ ID NO: 167042 - protein, 9 aa, Homo Sapiens
YNMQIFNEL

SEQ ID NO: 167043 - protein, 9 aa, Homo Sapiens
YNMQYALAV

SEQ ID NO: 167044 - protein, 9 aa, Homo Sapiens
YNNFKSMVV

SEQ ID NO: 167045 - protein, 9 aa, Homo Sapiens
YNNIMALYL

SEQ ID NO: 167046 - protein, 9 aa, Homo Sapiens
YNQGFEIVL

SEQ ID NO: 167047 - protein, 9 aa, Homo Sapiens
YNSFISLTV

SEQ ID NO: 167048 - protein, 9 aa, Homo Sapiens
YNSFVSLSV

SEQ ID NO: 167049 - protein, 9 aa, Homo Sapiens
YNTDVPLVL

SEQ ID NO: 167050 - protein, 9 aa, Homo Sapiens
YNTGAVLFV

SEQ ID NO: 167051 - protein, 9 aa, Homo Sapiens
YNVACILTL

SEQ ID NO: 167052 - protein, 9 aa, Homo Sapiens
YNVWLRAQL

SEQ ID NO: 167053 - protein, 9 aa, Homo Sapiens
YNWERALEL

SEQ ID NO: 167054 - protein, 9 aa, Homo Sapiens
YNYFGFKTL

SEQ ID NO: 167055 - protein, 9 aa, Homo Sapiens
YNYLQRAYI

SEQ ID NO: 167056 - protein, 9 aa, Homo Sapiens
YPDSHQLFV

SEQ ID NO: 167057 - protein, 9 aa, Homo Sapiens
YQNHLILKV

SEQ ID NO: 167058 - protein, 9 aa, Homo Sapiens
YQTALHLAV

SEQ ID NO: 167059 - protein, 9 aa, Homo Sapiens
YQTPLHLAV

SEQ ID NO: 167060 - protein, 9 aa, Homo Sapiens
YQVGVHYEL

SEQ ID NO: 167061 - protein, 9 aa, Homo Sapiens
YQYLRQLEV

SEQ ID NO: 167062 - protein, 9 aa, Homo Sapiens
YQYPRPLLI

SEQ ID NO: 167063 - protein, 9 aa, Homo Sapiens
YSAEPLPEL

SEQ ID NO: 167064 - protein, 9 aa, Homo Sapiens
YSAPVIHVL

SEQ ID NO: 167065 - protein, 9 aa, Homo Sapiens
YSDALEHLL

SEQ ID NO: 167066 - protein, 9 aa, Homo Sapiens
YSDDIPHAL

SEQ ID NO: 167067 - protein, 9 aa, Homo Sapiens
YSDGSLKIV

SEQ ID NO: 167068 - protein, 9 aa, Homo Sapiens
YSDSAVLKL

SEQ ID NO: 167069 - protein, 9 aa, Homo Sapiens
YSFHKFHYL

SEQ ID NO: 167070 - protein, 9 aa, Homo Sapiens
YSFQDKRNL

SEQ ID NO: 167071 - protein, 9 aa, Homo Sapiens
YSFSELLRL

SEQ ID NO: 167072 - protein, 9 aa, Homo Sapiens
YSHKKILQL

SEQ ID NO: 167073 - protein, 9 aa, Homo Sapiens
YSHSLLPVL

SEQ ID NO: 167074 - protein, 9 aa, Homo Sapiens
YSIEKPLKF

SEQ ID NO: 167075 - protein, 9 aa, Homo Sapiens
YSILHANVV

SEQ ID NO: 167076 - protein, 9 aa, Homo Sapiens
YSINWTQKL

SEQ ID NO: 167077 - protein, 9 aa, Homo Sapiens
YSISERLEM

SEQ ID NO: 167078 - protein, 9 aa, Homo Sapiens
YSISFLKQL

SEQ ID NO: 167079 - protein, 9 aa, Homo Sapiens
YSISGPHVL

SEQ ID NO: 167080 - protein, 9 aa, Homo Sapiens
YSISQERFL

SEQ ID NO: 167081 - protein, 9 aa, Homo Sapiens
YSIVAGVFV

SEQ ID NO: 167082 - protein, 9 aa, Homo Sapiens
YSLAAALTL

SEQ ID NO: 167083 - protein, 9 aa, Homo Sapiens
YSLDHISSL

SEQ ID NO: 167084 - protein, 9 aa, Homo Sapiens
YSLELIQMV

SEQ ID NO: 167085 - protein, 9 aa, Homo Sapiens
YSLKHIQEL

SEQ ID NO: 167086 - protein, 9 aa, Homo Sapiens
YSLLQAALL

SEQ ID NO: 167087 - protein, 9 aa, Homo Sapiens
YSLPIVLMV

SEQ ID NO: 167088 - protein, 9 aa, Homo Sapiens
YSLQHKLLL

SEQ ID NO: 167089 - protein, 9 aa, Homo Sapiens
YSLQKLRLV

SEQ ID NO: 167090 - protein, 9 aa, Homo Sapiens
YSLQRQSLL

SEQ ID NO: 167091 - protein, 9 aa, Homo Sapiens
YSMPSTHAM

SEQ ID NO: 167092 - protein, 9 aa, Homo Sapiens
YSMPVHAAV

SEQ ID NO: 167093 - protein, 9 aa, Homo Sapiens
YSNFHPLLV

SEQ ID NO: 167094 - protein, 9 aa, Homo Sapiens
YSNKYLTML

SEQ ID NO: 167095 - protein, 9 aa, Homo Sapiens
YSNLIKLLM

SEQ ID NO: 167096 - protein, 9 aa, Homo Sapiens
YSNNIRQLL

SEQ ID NO: 167097 - protein, 9 aa, Homo Sapiens
YSNVIFLEV

SEQ ID NO: 167098 - protein, 9 aa, Homo Sapiens
YSNVSNLKV

SEQ ID NO: 167099 - protein, 9 aa, Homo Sapiens
YSQKDPLIL

SEQ ID NO: 167100 - protein, 9 aa, Homo Sapiens
YSQVFKETV

SEQ ID NO: 167101 - protein, 9 aa, Homo Sapiens
YSSDPVIEV

SEQ ID NO: 167102 - protein, 9 aa, Homo Sapiens
YSSNHKLVF

SEQ ID NO: 167103 - protein, 9 aa, Homo Sapiens
YSSPEILRV

SEQ ID NO: 167104 - protein, 9 aa, Homo Sapiens
YSSPFDPVL

SEQ ID NO: 167105 - protein, 9 aa, Homo Sapiens
YSSSRTLLF

SEQ ID NO: 167106 - protein, 9 aa, Homo Sapiens
YSTGHVSRL

SEQ ID NO: 167107 - protein, 9 aa, Homo Sapiens
YSTPPHRTV

SEQ ID NO: 167108 - protein, 9 aa, Homo Sapiens
YSVDRLYEL

SEQ ID NO: 167109 - protein, 9 aa, Homo Sapiens
YSVETVTLL

SEQ ID NO: 167110 - protein, 9 aa, Homo Sapiens
YSVKRSLKL

SEQ ID NO: 167111 - protein, 9 aa, Homo Sapiens
YSVPEILRV

SEQ ID NO: 167112 - protein, 9 aa, Homo Sapiens
YSVRVSPQM

SEQ ID NO: 167113 - protein, 9 aa, Homo Sapiens
YSYFSPRTM

SEQ ID NO: 167114 - protein, 9 aa, Homo Sapiens
YSYKEALKL

SEQ ID NO: 167115 - protein, 9 aa, Homo Sapiens
YSYWTKNGV

SEQ ID NO: 167116 - protein, 9 aa, Homo Sapiens
YSYYGPLNL

SEQ ID NO: 167117 - protein, 9 aa, Homo Sapiens
YTDATPLRV

SEQ ID NO: 167118 - protein, 9 aa, Homo Sapiens
YTFNKVLML

SEQ ID NO: 167119 - protein, 9 aa, Homo Sapiens
YTFNVDQKL

SEQ ID NO: 167120 - protein, 9 aa, Homo Sapiens
YTFPAGVSV

SEQ ID NO: 167121 - protein, 9 aa, Homo Sapiens
YTIKGIRNL

SEQ ID NO: 167122 - protein, 9 aa, Homo Sapiens
YTIPLAIKL

SEQ ID NO: 167123 - protein, 9 aa, Homo Sapiens
YTIPPGHQV

SEQ ID NO: 167124 - protein, 9 aa, Homo Sapiens
YTLDSILFL

SEQ ID NO: 167125 - protein, 9 aa, Homo Sapiens
YTLINHRVL

SEQ ID NO: 167126 - protein, 9 aa, Homo Sapiens
YTLKLQVVL

SEQ ID NO: 167127 - protein, 9 aa, Homo Sapiens
YTNEYRLTI

SEQ ID NO: 167128 - protein, 9 aa, Homo Sapiens
YTNWKAFLV

SEQ ID NO: 167129 - protein, 9 aa, Homo Sapiens
YTSDLHFQV

SEQ ID NO: 167130 - protein, 9 aa, Homo Sapiens
YTSGTFRTV

SEQ ID NO: 167131 - protein, 9 aa, Homo Sapiens
YTSKSYLTV

SEQ ID NO: 167132 - protein, 9 aa, Homo Sapiens
YTSPDFLYI

SEQ ID NO: 167133 - protein, 9 aa, Homo Sapiens
YTSPDFLYV

SEQ ID NO: 167134 - protein, 9 aa, Homo Sapiens
YTSPVNPAV

SEQ ID NO: 167135 - protein, 9 aa, Homo Sapiens
YTSRIVVRL

SEQ ID NO: 167136 - protein, 9 aa, Homo Sapiens
YTTDFIYQL

SEQ ID NO: 167137 - protein, 9 aa, Homo Sapiens
YTTDRVMTV

SEQ ID NO: 167138 - protein, 9 aa, Homo Sapiens
YTVKAILIL

SEQ ID NO: 167139 - protein, 9 aa, Homo Sapiens
YTVPAGMTV

SEQ ID NO: 167140 - protein, 9 aa, Homo Sapiens
YTWKKIMRL

SEQ ID NO: 167141 - protein, 9 aa, Homo Sapiens
YTYIGEVLV

SEQ ID NO: 167142 - protein, 9 aa, Homo Sapiens
YTYIGPVLV

SEQ ID NO: 167143 - protein, 9 aa, Homo Sapiens
YTYKRFEGL

SEQ ID NO: 167144 - protein, 9 aa, Homo Sapiens
YTYYYPHYL

SEQ ID NO: 167145 - protein, 9 aa, Homo Sapiens
YVDDVFLRV

SEQ ID NO: 167146 - protein, 9 aa, Homo Sapiens
YVDGRVLVV

SEQ ID NO: 167147 - protein, 9 aa, Homo Sapiens
YVNDIVLAI

SEQ ID NO: 167148 - protein, 9 aa, Homo Sapiens
YVSSVALAV

SEQ ID NO: 167149 - protein, 9 aa, Homo Sapiens
YVTSVILHI

SEQ ID NO: 167150 - protein, 9 aa, Homo Sapiens
YVYSHFLQF

SEQ ID NO: 167151 - protein, 10 aa, Homo Sapiens
AAAAPHLLLL

SEQ ID NO: 167152 - protein, 10 aa, Homo Sapiens
AIIEARGVSV

SEQ ID NO: 167153 - protein, 10 aa, Homo Sapiens
ANSPWVVQLF

SEQ ID NO: 167154 - protein, 10 aa, Homo Sapiens
ANSSVLHDEF

SEQ ID NO: 167155 - protein, 10 aa, Homo Sapiens
ASFNDTFVHV

SEQ ID NO: 167156 - protein, 10 aa, Homo Sapiens
ASLDKFLANV

SEQ ID NO: 167157 - protein, 10 aa, Homo Sapiens
ASMAPGALLL

SEQ ID NO: 167158 - protein, 10 aa, Homo Sapiens
ASTILHLVVM

SEQ ID NO: 167159 - protein, 10 aa, Homo Sapiens
ASTLKTLLFF

SEQ ID NO: 167160 - protein, 10 aa, Homo Sapiens
ASYHGFLPVL

SEQ ID NO: 167161 - protein, 10 aa, Homo Sapiens
DIIHNANDTF

SEQ ID NO: 167162 - protein, 10 aa, Homo Sapiens
DINTDGAVNF

SEQ ID NO: 167163 - protein, 10 aa, Homo Sapiens
DLAGRDLTDY

SEQ ID NO: 167164 - protein, 10 aa, Homo Sapiens
DTNADKQLSF

SEQ ID NO: 167165 - protein, 10 aa, Homo Sapiens
FSFEVEKELF

SEQ ID NO: 167166 - protein, 10 aa, Homo Sapiens
FSIDRALNVA

SEQ ID NO: 167167 - protein, 10 aa, Homo Sapiens
FSIEAAMKII

SEQ ID NO: 167168 - protein, 10 aa, Homo Sapiens
FTILWSVARL

SEQ ID NO: 167169 - protein, 10 aa, Homo Sapiens
FTNDTILDVF

SEQ ID NO: 167170 - protein, 10 aa, Homo Sapiens
GGSLIPLLQL

SEQ ID NO: 167171 - protein, 10 aa, Homo Sapiens
GGTNFRVLLV

SEQ ID NO: 167172 - protein, 10 aa, Homo Sapiens
GPPPPPGKPQ

SEQ ID NO: 167173 - protein, 10 aa, Homo Sapiens
GSTAIALELL

SEQ ID NO: 167174 - protein, 10 aa, Homo Sapiens
HANPILLLVM

SEQ ID NO: 167175 - protein, 10 aa, Homo Sapiens
HNLGIPVLVV

SEQ ID NO: 167176 - protein, 10 aa, Homo Sapiens
HNVDIVLQVL

SEQ ID NO: 167177 - protein, 10 aa, Homo Sapiens
HNVTLALELL

SEQ ID NO: 167178 - protein, 10 aa, Homo Sapiens
HSGPVVAMVW

SEQ ID NO: 167179 - protein, 10 aa, Homo Sapiens
HSYFGSFSSL

SEQ ID NO: 167180 - protein, 10 aa, Homo Sapiens
IGYPHLQEVL

SEQ ID NO: 167181 - protein, 10 aa, Homo Sapiens
IIAPPERKYS

SEQ ID NO: 167182 - protein, 10 aa, Homo Sapiens
IQHVFQNLIL

SEQ ID NO: 167183 - protein, 10 aa, Homo Sapiens
IREADVDQDG

SEQ ID NO: 167184 - protein, 10 aa, Homo Sapiens
ISFVGFQPVL

SEQ ID NO: 167185 - protein, 10 aa, Homo Sapiens
ISMEVPVMVV

SEQ ID NO: 167186 - protein, 10 aa, Homo Sapiens
IVNGHTLLVA

SEQ ID NO: 167187 - protein, 10 aa, Homo Sapiens
KANEHQLITL

SEQ ID NO: 167188 - protein, 10 aa, Homo Sapiens
KANGVTDLLV

SEQ ID NO: 167189 - protein, 10 aa, Homo Sapiens
KAVSSAIAQL

SEQ ID NO: 167190 - protein, 10 aa, Homo Sapiens
KITPLEIEVL

SEQ ID NO: 167191 - protein, 10 aa, Homo Sapiens
KIYERTMAVL

SEQ ID NO: 167192 - protein, 10 aa, Homo Sapiens
KLNPQQFEVL

SEQ ID NO: 167193 - protein, 10 aa, Homo Sapiens
KNIERTLYFL

SEQ ID NO: 167194 - protein, 10 aa, Homo Sapiens
KNIPMTLELL

SEQ ID NO: 167195 - protein, 10 aa, Homo Sapiens
KSAIPHPLIM

SEQ ID NO: 167196 - protein, 10 aa, Homo Sapiens
KSFEGLFYFL

SEQ ID NO: 167197 - protein, 10 aa, Homo Sapiens
KSFNIPLLVL

SEQ ID NO: 167198 - protein, 10 aa, Homo Sapiens
KSFNLPMLML

SEQ ID NO: 167199 - protein, 10 aa, Homo Sapiens
KSFYGSTLFL

SEQ ID NO: 167200 - protein, 10 aa, Homo Sapiens
KSIDFPLTKV

SEQ ID NO: 167201 - protein, 10 aa, Homo Sapiens
KSIDWGILAV

SEQ ID NO: 167202 - protein, 10 aa, Homo Sapiens
KSINPLGGFV

SEQ ID NO: 167203 - protein, 10 aa, Homo Sapiens
KSIYAALYFF

SEQ ID NO: 167204 - protein, 10 aa, Homo Sapiens
KSLPASLSFL

SEQ ID NO: 167205 - protein, 10 aa, Homo Sapiens
KSLVSKGTLV

SEQ ID NO: 167206 - protein, 10 aa, Homo Sapiens
KSNEGKELLV

SEQ ID NO: 167207 - protein, 10 aa, Homo Sapiens
KSNNEIVLVL

SEQ ID NO: 167208 - protein, 10 aa, Homo Sapiens
KSQDKTLKIY

SEQ ID NO: 167209 - protein, 10 aa, Homo Sapiens
KSREFIGSFL

SEQ ID NO: 167210 - protein, 10 aa, Homo Sapiens
KSVDRSLLFL

SEQ ID NO: 167211 - protein, 10 aa, Homo Sapiens
KSYEAKLRLL

SEQ ID NO: 167212 - protein, 10 aa, Homo Sapiens
KSYESQIEVM

SEQ ID NO: 167213 - protein, 10 aa, Homo Sapiens
KTAAFLIPLL

SEQ ID NO: 167214 - protein, 10 aa, Homo Sapiens
KTALLHLLLL

SEQ ID NO: 167215 - protein, 10 aa, Homo Sapiens
KTAQPHPKLL

SEQ ID NO: 167216 - protein, 10 aa, Homo Sapiens
KTFNLPLLML

SEQ ID NO: 167217 - protein, 10 aa, Homo Sapiens
KTGIPLNVLP

SEQ ID NO: 167218 - protein, 10 aa, Homo Sapiens
KTIDGILLLI

SEQ ID NO: 167219 - protein, 10 aa, Homo Sapiens
KTIEDFQQKI

SEQ ID NO: 167220 - protein, 10 aa, Homo Sapiens
KTIEDTLMTV

SEQ ID NO: 167221 - protein, 10 aa, Homo Sapiens
KTIENFLVVN

SEQ ID NO: 167222 - protein, 10 aa, Homo Sapiens
KTIGWKLLSV

SEQ ID NO: 167223 - protein, 10 aa, Homo Sapiens
KTKDWWTYEF

SEQ ID NO: 167224 - protein, 10 aa, Homo Sapiens
KTLAGDVHIV

SEQ ID NO: 167225 - protein, 10 aa, Homo Sapiens
KTLDHVFLVL

SEQ ID NO: 167226 - protein, 10 aa, Homo Sapiens
KTLDVFNIIL

SEQ ID NO: 167227 - protein, 10 aa, Homo Sapiens
KTLSDIFLLF

SEQ ID NO: 167228 - protein, 10 aa, Homo Sapiens
KTMDLPFLEA

SEQ ID NO: 167229 - protein, 10 aa, Homo Sapiens
KTMEAISEVL

SEQ ID NO: 167230 - protein, 10 aa, Homo Sapiens
KTMEDTLMTV

SEQ ID NO: 167231 - protein, 10 aa, Homo Sapiens
KTNGATPLLM

SEQ ID NO: 167232 - protein, 10 aa, Homo Sapiens
KTNHVFFLLL

SEQ ID NO: 167233 - protein, 10 aa, Homo Sapiens
KTPDFESTGL

SEQ ID NO: 167234 - protein, 10 aa, Homo Sapiens
KTVEIVHIDI

SEQ ID NO: 167235 - protein, 10 aa, Homo Sapiens
KTVLPFVSTV

SEQ ID NO: 167236 - protein, 10 aa, Homo Sapiens
KTYDLLFKLL

SEQ ID NO: 167237 - protein, 10 aa, Homo Sapiens
KTYDYLFKLL

SEQ ID NO: 167238 - protein, 10 aa, Homo Sapiens
KTYEGSFNAL

SEQ ID NO: 167239 - protein, 10 aa, Homo Sapiens
KTYGVSFFLV

SEQ ID NO: 167240 - protein, 10 aa, Homo Sapiens
KVFDFAGEEV

SEQ ID NO: 167241 - protein, 10 aa, Homo Sapiens
KVFNRYLEVM

SEQ ID NO: 167242 - protein, 10 aa, Homo Sapiens
KVNDFLAEIF

SEQ ID NO: 167243 - protein, 10 aa, Homo Sapiens
KVPQLEIVPN

SEQ ID NO: 167244 - protein, 10 aa, Homo Sapiens
KVSPVSYLRV

SEQ ID NO: 167245 - protein, 10 aa, Homo Sapiens
KVYERAVEFF

SEQ ID NO: 167246 - protein, 10 aa, Homo Sapiens
LAAPGHPPVL

SEQ ID NO: 167247 - protein, 10 aa, Homo Sapiens
LDTNADKQLS

SEQ ID NO: 167248 - protein, 10 aa, Homo Sapiens
LSMPASLGRM

SEQ ID NO: 167249 - protein, 10 aa, Homo Sapiens
LSNAHIQNEL

SEQ ID NO: 167250 - protein, 10 aa, Homo Sapiens
LSNNQRYLFL

SEQ ID NO: 167251 - protein, 10 aa, Homo Sapiens
LSSLVILEVL

SEQ ID NO: 167252 - protein, 10 aa, Homo Sapiens
LTNRPIAVVI

SEQ ID NO: 167253 - protein, 10 aa, Homo Sapiens
NFPEHIFPAL

SEQ ID NO: 167254 - protein, 10 aa, Homo Sapiens
NNGIPPVQVF

SEQ ID NO: 167255 - protein, 10 aa, Homo Sapiens
QQYEIWRELF

SEQ ID NO: 167256 - protein, 10 aa, Homo Sapiens
QSIERAKELF

SEQ ID NO: 167257 - protein, 10 aa, Homo Sapiens
QSIPAEIENL

SEQ ID NO: 167258 - protein, 10 aa, Homo Sapiens
QSTDIIRYLF

SEQ ID NO: 167259 - protein, 10 aa, Homo Sapiens
QSYWNHRELM

SEQ ID NO: 167260 - protein, 10 aa, Homo Sapiens
RAASAFFTYV

SEQ ID NO: 167261 - protein, 10 aa, Homo Sapiens
RAFAFTNLLL

SEQ ID NO: 167262 - protein, 10 aa, Homo Sapiens
RAFHHGRFIM

SEQ ID NO: 167263 - protein, 10 aa, Homo Sapiens
RALDGAWLMV

SEQ ID NO: 167264 - protein, 10 aa, Homo Sapiens
RAMEGELGEL

SEQ ID NO: 167265 - protein, 10 aa, Homo Sapiens
REAAGLFRLL

SEQ ID NO: 167266 - protein, 10 aa, Homo Sapiens
RIMEFTTTLL

SEQ ID NO: 167267 - protein, 10 aa, Homo Sapiens
RIPSFGFSVV

SEQ ID NO: 167268 - protein, 10 aa, Homo Sapiens
RIVATKPLYV

SEQ ID NO: 167269 - protein, 10 aa, Homo Sapiens
RIVGSKPLYV

SEQ ID NO: 167270 - protein, 10 aa, Homo Sapiens
RIYAAFKEVL

SEQ ID NO: 167271 - protein, 10 aa, Homo Sapiens
RIYPFLLMVV

SEQ ID NO: 167272 - protein, 10 aa, Homo Sapiens
RIYPHGLVLL

SEQ ID NO: 167273 - protein, 10 aa, Homo Sapiens
RMSPFPLTSM

SEQ ID NO: 167274 - protein, 10 aa, Homo Sapiens
RNFDRAFSYI

SEQ ID NO: 167275 - protein, 10 aa, Homo Sapiens
RNHNFDGLDV

SEQ ID NO: 167276 - protein, 10 aa, Homo Sapiens
RNIDDHSRFV

SEQ ID NO: 167277 - protein, 10 aa, Homo Sapiens
RNKDPQEILL

SEQ ID NO: 167278 - protein, 10 aa, Homo Sapiens
RNLDLSWSEL

SEQ ID NO: 167279 - protein, 10 aa, Homo Sapiens
RNNEVDLLFL

SEQ ID NO: 167280 - protein, 10 aa, Homo Sapiens
RNTAVSLEVL

SEQ ID NO: 167281 - protein, 10 aa, Homo Sapiens
RNTSVVVTLL

SEQ ID NO: 167282 - protein, 10 aa, Homo Sapiens
RNYFSDIDFF

SEQ ID NO: 167283 - protein, 10 aa, Homo Sapiens
RNYVQQVTIL

SEQ ID NO: 167284 - protein, 10 aa, Homo Sapiens
RQAEITRLLL

SEQ ID NO: 167285 - protein, 10 aa, Homo Sapiens
RQKDVKIVTV

SEQ ID NO: 167286 - protein, 10 aa, Homo Sapiens
RQMDIIVSEV

SEQ ID NO: 167287 - protein, 10 aa, Homo Sapiens
RQYPWGTVQV

SEQ ID NO: 167288 - protein, 10 aa, Homo Sapiens
RQYPWGVAEV

SEQ ID NO: 167289 - protein, 10 aa, Homo Sapiens
RSAEKLALFL

SEQ ID NO: 167290 - protein, 10 aa, Homo Sapiens
RSDEHVRTEL

SEQ ID NO: 167291 - protein, 10 aa, Homo Sapiens
RSDPSVPKIV

SEQ ID NO: 167292 - protein, 10 aa, Homo Sapiens
RSFDLGRQFL

SEQ ID NO: 167293 - protein, 10 aa, Homo Sapiens
RSFEHALMLF

SEQ ID NO: 167294 - protein, 10 aa, Homo Sapiens
RSFNPFFPLL

SEQ ID NO: 167295 - protein, 10 aa, Homo Sapiens
RSFNSNFTTV

SEQ ID NO: 167296 - protein, 10 aa, Homo Sapiens
RSGYPLRILL

SEQ ID NO: 167297 - protein, 10 aa, Homo Sapiens
RSHYFEVEIV

SEQ ID NO: 167298 - protein, 10 aa, Homo Sapiens
RSIAEMGAYV

SEQ ID NO: 167299 - protein, 10 aa, Homo Sapiens
RSIEEVLRIL

SEQ ID NO: 167300 - protein, 10 aa, Homo Sapiens
RSIEHLKQIF

SEQ ID NO: 167301 - protein, 10 aa, Homo Sapiens
RSISESFLTV

SEQ ID NO: 167302 - protein, 10 aa, Homo Sapiens
RSLAAFLQQL

SEQ ID NO: 167303 - protein, 10 aa, Homo Sapiens
RSLDSVQELM

SEQ ID NO: 167304 - protein, 10 aa, Homo Sapiens
RSLDWQMVFL

SEQ ID NO: 167305 - protein, 10 aa, Homo Sapiens
RSLEAKGVTV

SEQ ID NO: 167306 - protein, 10 aa, Homo Sapiens
RSLHDAIMIV

SEQ ID NO: 167307 - protein, 10 aa, Homo Sapiens
RSLHYQFYVW

SEQ ID NO: 167308 - protein, 10 aa, Homo Sapiens
RSLLHRNLVL

SEQ ID NO: 167309 - protein, 10 aa, Homo Sapiens
RSLSVTLAGF

SEQ ID NO: 167310 - protein, 10 aa, Homo Sapiens
RSMDTIVGML

SEQ ID NO: 167311 - protein, 10 aa, Homo Sapiens
RSMEEQLLVV

SEQ ID NO: 167312 - protein, 10 aa, Homo Sapiens
RSMGFIGHYL

SEQ ID NO: 167313 - protein, 10 aa, Homo Sapiens
RSMGYFVEVL

SEQ ID NO: 167314 - protein, 10 aa, Homo Sapiens
RSNELIWLEL

SEQ ID NO: 167315 - protein, 10 aa, Homo Sapiens
RSNGYILEML

SEQ ID NO: 167316 - protein, 10 aa, Homo Sapiens
RSNPSVFVIF

SEQ ID NO: 167317 - protein, 10 aa, Homo Sapiens
RSSGSHLVFV

SEQ ID NO: 167318 - protein, 10 aa, Homo Sapiens
RSSTVTVLLL

SEQ ID NO: 167319 - protein, 10 aa, Homo Sapiens
RSTLVLHDLL

SEQ ID NO: 167320 - protein, 10 aa, Homo Sapiens
RSVDVTNTTF

SEQ ID NO: 167321 - protein, 10 aa, Homo Sapiens
RSVEGWILFV

SEQ ID NO: 167322 - protein, 10 aa, Homo Sapiens
RSVPFQMLLL

SEQ ID NO: 167323 - protein, 10 aa, Homo Sapiens
RSYDFEFMQV

SEQ ID NO: 167324 - protein, 10 aa, Homo Sapiens
RSYFAFLQTV

SEQ ID NO: 167325 - protein, 10 aa, Homo Sapiens
RSYLFLGGIL

SEQ ID NO: 167326 - protein, 10 aa, Homo Sapiens
RSYSDPPLKF

SEQ ID NO: 167327 - protein, 10 aa, Homo Sapiens
RTADWRLYLF

SEQ ID NO: 167328 - protein, 10 aa, Homo Sapiens
RTAGPHTQFV

SEQ ID NO: 167329 - protein, 10 aa, Homo Sapiens
RTGKPLSVEL

SEQ ID NO: 167330 - protein, 10 aa, Homo Sapiens
RTIDKLLAIP

SEQ ID NO: 167331 - protein, 10 aa, Homo Sapiens
RTIGFFYTLF

SEQ ID NO: 167332 - protein, 10 aa, Homo Sapiens
RTILGGIAFV

SEQ ID NO: 167333 - protein, 10 aa, Homo Sapiens
RTLDKIMILF

SEQ ID NO: 167334 - protein, 10 aa, Homo Sapiens
RTLDNQLFFF

SEQ ID NO: 167335 - protein, 10 aa, Homo Sapiens
RTLPFQLSSV

SEQ ID NO: 167336 - protein, 10 aa, Homo Sapiens
RTPDTPFSLF

SEQ ID NO: 167337 - protein, 10 aa, Homo Sapiens
RTVELFYDVL

SEQ ID NO: 167338 - protein, 10 aa, Homo Sapiens
RTYEKFFGLL

SEQ ID NO: 167339 - protein, 10 aa, Homo Sapiens
RVAPAHGLFL

SEQ ID NO: 167340 - protein, 10 aa, Homo Sapiens
RVAPEEHPVL

SEQ ID NO: 167341 - protein, 10 aa, Homo Sapiens
RVLDFDPMAV

SEQ ID NO: 167342 - protein, 10 aa, Homo Sapiens
RVMAPRTLIL

SEQ ID NO: 167343 - protein, 10 aa, Homo Sapiens
RVYDFVGLLV

SEQ ID NO: 167344 - protein, 10 aa, Homo Sapiens
RVYEWFGLVL

SEQ ID NO: 167345 - protein, 10 aa, Homo Sapiens
SMDNNRNLDL

SEQ ID NO: 167346 - protein, 10 aa, Homo Sapiens
SSFDFRTSEI

SEQ ID NO: 167347 - protein, 10 aa, Homo Sapiens
SSLSRFLMVM

SEQ ID NO: 167348 - protein, 10 aa, Homo Sapiens
SSMAYSLYLF

SEQ ID NO: 167349 - protein, 10 aa, Homo Sapiens
STSAVPNLFV

SEQ ID NO: 167350 - protein, 10 aa, Homo Sapiens
TANRHVLRIL

SEQ ID NO: 167351 - protein, 10 aa, Homo Sapiens
TTEGIPVLIV

SEQ ID NO: 167352 - protein, 10 aa, Homo Sapiens
TTTNVFHFTF

SEQ ID NO: 167353 - protein, 10 aa, Homo Sapiens
TVNEVELLVM

SEQ ID NO: 167354 - protein, 10 aa, Homo Sapiens
VAAPSWLHRF

SEQ ID NO: 167355 - protein, 10 aa, Homo Sapiens
VGGGSSTIKY

SEQ ID NO: 167356 - protein, 10 aa, Homo Sapiens
VINSQTFVVL

SEQ ID NO: 167357 - protein, 10 aa, Homo Sapiens
VKARTAQLAK

SEQ ID NO: 167358 - protein, 10 aa, Homo Sapiens
VSNDKALMVL

SEQ ID NO: 167359 - protein, 10 aa, Homo Sapiens
VSTASHLLVL

SEQ ID NO: 167360 - protein, 10 aa, Homo Sapiens
VVNGRVLELF

SEQ ID NO: 167361 - protein, 10 aa, Homo Sapiens
VVYPWTQRFF

SEQ ID NO: 167362 - protein, 10 aa, Homo Sapiens
YAANPHSFVF

SEQ ID NO: 167363 - protein, 10 aa, Homo Sapiens
YALAARDVFL

SEQ ID NO: 167364 - protein, 10 aa, Homo Sapiens
YANKYNIMLV

SEQ ID NO: 167365 - protein, 10 aa, Homo Sapiens
YGVDGKLLQL

SEQ ID NO: 167366 - protein, 10 aa, Homo Sapiens
YSFKFGFNEF

SEQ ID NO: 167367 - protein, 10 aa, Homo Sapiens
YSIGSKPLQI

SEQ ID NO: 167368 - protein, 10 aa, Homo Sapiens
YSLDHISSLF

SEQ ID NO: 167369 - protein, 10 aa, Homo Sapiens
YSSPFDPVLF

SEQ ID NO: 167370 - protein, 10 aa, Homo Sapiens
YSYLHGMEIL

SEQ ID NO: 167371 - protein, 10 aa, Homo Sapiens
YTIENPRHFV

SEQ ID NO: 167372 - protein, 10 aa, Homo Sapiens
YTNGHLFTTI

SEQ ID NO: 167373 - protein, 11 aa, Homo Sapiens
AAFHPTMPLIV

SEQ ID NO: 167374 - protein, 11 aa, Homo Sapiens
AAIDARIFHEL

SEQ ID NO: 167375 - protein, 11 aa, Homo Sapiens
ADREDDPNFFK

SEQ ID NO: 167376 - protein, 11 aa, Homo Sapiens
ADVDQDGRVNY

SEQ ID NO: 167377 - protein, 11 aa, Homo Sapiens
AEVNADRITWL

SEQ ID NO: 167378 - protein, 11 aa, Homo Sapiens
ANMPWFKGWKV

SEQ ID NO: 167379 - protein, 11 aa, Homo Sapiens
ANSPWVVQLFY

SEQ ID NO: 167380 - protein, 11 aa, Homo Sapiens
DAGAGIALNDH

SEQ ID NO: 167381 - protein, 11 aa, Homo Sapiens
DINTDGAVNFQ

SEQ ID NO: 167382 - protein, 11 aa, Homo Sapiens
DLAGRDLTDYL

SEQ ID NO: 167383 - protein, 11 aa, Homo Sapiens
DLDTNADKQLS

SEQ ID NO: 167384 - protein, 11 aa, Homo Sapiens
DPAAASHPLLL

SEQ ID NO: 167385 - protein, 11 aa, Homo Sapiens
DTNADKQLSFE

SEQ ID NO: 167386 - protein, 11 aa, Homo Sapiens
FLTAAKKARAG

SEQ ID NO: 167387 - protein, 11 aa, Homo Sapiens
FSIDRALNVAL

SEQ ID NO: 167388 - protein, 11 aa, Homo Sapiens
FSRATALDNVV

SEQ ID NO: 167389 - protein, 11 aa, Homo Sapiens
FTIKDRNGKEV

SEQ ID NO: 167390 - protein, 11 aa, Homo Sapiens
FVAPFPEVFGK

SEQ ID NO: 167391 - protein, 11 aa, Homo Sapiens
GVSVDSQFTHL

SEQ ID NO: 167392 - protein, 11 aa, Homo Sapiens
HANPILLLVMY

SEQ ID NO: 167393 - protein, 11 aa, Homo Sapiens
HAVYRDDLKKL

SEQ ID NO: 167394 - protein, 11 aa, Homo Sapiens
HISDEISIMTL

SEQ ID NO: 167395 - protein, 11 aa, Homo Sapiens
HNMPPSALSQL

SEQ ID NO: 167396 - protein, 11 aa, Homo Sapiens
HTYDFKKLAEV

SEQ ID NO: 167397 - protein, 11 aa, Homo Sapiens
ISSHIPLIIQF

SEQ ID NO: 167398 - protein, 11 aa, Homo Sapiens
ISSVLISIQSL

SEQ ID NO: 167399 - protein, 11 aa, Homo Sapiens
KAMLAKLMSEL

SEQ ID NO: 167400 - protein, 11 aa, Homo Sapiens
KAMLAQLLAEL

SEQ ID NO: 167401 - protein, 11 aa, Homo Sapiens
KAVDSQILPKI

SEQ ID NO: 167402 - protein, 11 aa, Homo Sapiens
KGFSWSSSLII

SEQ ID NO: 167403 - protein, 11 aa, Homo Sapiens
KLNPQQFEVLF

SEQ ID NO: 167404 - protein, 11 aa, Homo Sapiens
KMDQGSIERIL

SEQ ID NO: 167405 - protein, 11 aa, Homo Sapiens
KNFISEPARTV

SEQ ID NO: 167406 - protein, 11 aa, Homo Sapiens
KQSIIRLQSLC

SEQ ID NO: 167407 - protein, 11 aa, Homo Sapiens
KSFEQVSGVTV

SEQ ID NO: 167408 - protein, 11 aa, Homo Sapiens
KSFFDNISSEL

SEQ ID NO: 167409 - protein, 11 aa, Homo Sapiens
KSIPASDLPQV

SEQ ID NO: 167410 - protein, 11 aa, Homo Sapiens
KSKSPAIFGVL

SEQ ID NO: 167411 - protein, 11 aa, Homo Sapiens
KSLDAIVASVM

SEQ ID NO: 167412 - protein, 11 aa, Homo Sapiens
KSLPASLSFLV

SEQ ID NO: 167413 - protein, 11 aa, Homo Sapiens
KSYEPLEDPGV

SEQ ID NO: 167414 - protein, 11 aa, Homo Sapiens
KTIDIAQEEVL

SEQ ID NO: 167415 - protein, 11 aa, Homo Sapiens
KTIVPATLPQL

SEQ ID NO: 167416 - protein, 11 aa, Homo Sapiens
KTNDQMVVVYL

SEQ ID NO: 167417 - protein, 11 aa, Homo Sapiens
KTNHVFFLLLL

SEQ ID NO: 167418 - protein, 11 aa, Homo Sapiens
KTNTKLGKLYL

SEQ ID NO: 167419 - protein, 11 aa, Homo Sapiens
KTYDTSFLDFL

SEQ ID NO: 167420 - protein, 11 aa, Homo Sapiens
KTYDYLFKLLL

SEQ ID NO: 167421 - protein, 11 aa, Homo Sapiens
KVLEPSETLVV

SEQ ID NO: 167422 - protein, 11 aa, Homo Sapiens
KVNTALTALYL

SEQ ID NO: 167423 - protein, 11 aa, Homo Sapiens
LDTNADKQLSF

SEQ ID NO: 167424 - protein, 11 aa, Homo Sapiens
LRVAPEEHPVL

SEQ ID NO: 167425 - protein, 11 aa, Homo Sapiens
LSNAKHLEILF

SEQ ID NO: 167426 - protein, 11 aa, Homo Sapiens
LSPSMGHPLEV

SEQ ID NO: 167427 - protein, 11 aa, Homo Sapiens
LSRYEDTWAAL

SEQ ID NO: 167428 - protein, 11 aa, Homo Sapiens
LTAAKKARAGL

SEQ ID NO: 167429 - protein, 11 aa, Homo Sapiens
LTAPPEALLMV

SEQ ID NO: 167430 - protein, 11 aa, Homo Sapiens
PIYPGHGMMFV

SEQ ID NO: 167431 - protein, 11 aa, Homo Sapiens
PKFEVIEKPQA

SEQ ID NO: 167432 - protein, 11 aa, Homo Sapiens
QEFLTAAKKAR

SEQ ID NO: 167433 - protein, 11 aa, Homo Sapiens
QSIPYQDLPHL

SEQ ID NO: 167434 - protein, 11 aa, Homo Sapiens
QSIYPLHDVFV

SEQ ID NO: 167435 - protein, 11 aa, Homo Sapiens
RAIEALHGHEL

SEQ ID NO: 167436 - protein, 11 aa, Homo Sapiens
RARDARVVGLL

SEQ ID NO: 167437 - protein, 11 aa, Homo Sapiens
RASEALSFNEV

SEQ ID NO: 167438 - protein, 11 aa, Homo Sapiens
RELEELNVPGE

SEQ ID NO: 167439 - protein, 11 aa, Homo Sapiens
RIAEALSKMKL

SEQ ID NO: 167440 - protein, 11 aa, Homo Sapiens
RIIEPRKGTVV

SEQ ID NO: 167441 - protein, 11 aa, Homo Sapiens
RNFFSNMFSSV

SEQ ID NO: 167442 - protein, 11 aa, Homo Sapiens
RNINPDVLFEV

SEQ ID NO: 167443 - protein, 11 aa, Homo Sapiens
RNSAELTVIKV

SEQ ID NO: 167444 - protein, 11 aa, Homo Sapiens
RSFDKGPFATF

SEQ ID NO: 167445 - protein, 11 aa, Homo Sapiens
RSFDSNAFTLL

SEQ ID NO: 167446 - protein, 11 aa, Homo Sapiens
RSFFSEIISSI

SEQ ID NO: 167447 - protein, 11 aa, Homo Sapiens
RSLPAELGNMV

SEQ ID NO: 167448 - protein, 11 aa, Homo Sapiens
RSNDGAYSLVL

SEQ ID NO: 167449 - protein, 11 aa, Homo Sapiens
RSNLEISKMEV

SEQ ID NO: 167450 - protein, 11 aa, Homo Sapiens
RSNPKLKDLYI

SEQ ID NO: 167451 - protein, 11 aa, Homo Sapiens
RSRNTDEMVEL

SEQ ID NO: 167452 - protein, 11 aa, Homo Sapiens
RSSEAVIWEVL

SEQ ID NO: 167453 - protein, 11 aa, Homo Sapiens
RSSRSHAVLLV

SEQ ID NO: 167454 - protein, 11 aa, Homo Sapiens
RSVDVTNTTFL

SEQ ID NO: 167455 - protein, 11 aa, Homo Sapiens
RSYLFLGGILM

SEQ ID NO: 167456 - protein, 11 aa, Homo Sapiens
RSYNRFQIATV

SEQ ID NO: 167457 - protein, 11 aa, Homo Sapiens
RTNASISVLEV

SEQ ID NO: 167458 - protein, 11 aa, Homo Sapiens
RTNPQVLDTGL

SEQ ID NO: 167459 - protein, 11 aa, Homo Sapiens
RTQFEETWATL

SEQ ID NO: 167460 - protein, 11 aa, Homo Sapiens
RTSDDVAKEFV

SEQ ID NO: 167461 - protein, 11 aa, Homo Sapiens
RTSVKISYIGL

SEQ ID NO: 167462 - protein, 11 aa, Homo Sapiens
RVFEQGGARVV

SEQ ID NO: 167463 - protein, 11 aa, Homo Sapiens
RVLHEVEPRYV

SEQ ID NO: 167464 - protein, 11 aa, Homo Sapiens
RVMAPRTLILL

SEQ ID NO: 167465 - protein, 11 aa, Homo Sapiens
RVYQPVRYYYV

SEQ ID NO: 167466 - protein, 11 aa, Homo Sapiens
TSFYDRVWAAI

SEQ ID NO: 167467 - protein, 11 aa, Homo Sapiens
VSCPYSADMYV

SEQ ID NO: 167468 - protein, 11 aa, Homo Sapiens
VSFPFGKIGTV

SEQ ID NO: 167469 - protein, 11 aa, Homo Sapiens
VSYFPDKVALL

SEQ ID NO: 167470 - protein, 11 aa, Homo Sapiens
VTALLGRLAEL

SEQ ID NO: 167471 - protein, 11 aa, Homo Sapiens
YGAEALERMFL

SEQ ID NO: 167472 - protein, 11 aa, Homo Sapiens
YSLSSADLSSL

SEQ ID NO: 167473 - protein, 11 aa, Homo Sapiens
YSMLAIGIGTL

SEQ ID NO: 167474 - protein, 11 aa, Homo Sapiens
YSSLPASKQML

SEQ ID NO: 167475 - protein, 11 aa, Homo Sapiens
YTTDRVMTVSF

SEQ ID NO: 167476 - protein, 8 aa, Homo Sapiens
AAAAPRLW

SEQ ID NO: 167477 - protein, 8 aa, Homo Sapiens
AAAAQIRY

SEQ ID NO: 167478 - protein, 8 aa, Homo Sapiens
AAAERMIL

SEQ ID NO: 167479 - protein, 8 aa, Homo Sapiens
AAALHYAL

SEQ ID NO: 167480 - protein, 8 aa, Homo Sapiens
AAALRQAL

SEQ ID NO: 167481 - protein, 8 aa, Homo Sapiens
AAALRVEL

SEQ ID NO: 167482 - protein, 8 aa, Homo Sapiens
AAAPPLTL

SEQ ID NO: 167483 - protein, 8 aa, Homo Sapiens
AAAQLPSL

SEQ ID NO: 167484 - protein, 8 aa, Homo Sapiens
AAATHLEV

SEQ ID NO: 167485 - protein, 8 aa, Homo Sapiens
AAAVGLEL

SEQ ID NO: 167486 - protein, 8 aa, Homo Sapiens
AAAVLFRM

SEQ ID NO: 167487 - protein, 8 aa, Homo Sapiens
AAAVRHVL

SEQ ID NO: 167488 - protein, 8 aa, Homo Sapiens
AAAVRITL

SEQ ID NO: 167489 - protein, 8 aa, Homo Sapiens
AAAWPLLL

SEQ ID NO: 167490 - protein, 8 aa, Homo Sapiens
AAAYRVTL

SEQ ID NO: 167491 - protein, 8 aa, Homo Sapiens
AAFNIIEV

SEQ ID NO: 167492 - protein, 8 aa, Homo Sapiens
AALVGFLY

SEQ ID NO: 167493 - protein, 8 aa, Homo Sapiens
AAMILNEL

SEQ ID NO: 167494 - protein, 8 aa, Homo Sapiens
AANIQPIF

SEQ ID NO: 167495 - protein, 8 aa, Homo Sapiens
AANLRETF

SEQ ID NO: 167496 - protein, 8 aa, Homo Sapiens
AANVIPVL

SEQ ID NO: 167497 - protein, 8 aa, Homo Sapiens
AANVRELM

SEQ ID NO: 167498 - protein, 8 aa, Homo Sapiens
AARQPIEL

SEQ ID NO: 167499 - protein, 8 aa, Homo Sapiens
AASALPAL

SEQ ID NO: 167500 - protein, 8 aa, Homo Sapiens
AASFRPGL

SEQ ID NO: 167501 - protein, 8 aa, Homo Sapiens
AASLLPVL

SEQ ID NO: 167502 - protein, 8 aa, Homo Sapiens
AASLRLTL

SEQ ID NO: 167503 - protein, 8 aa, Homo Sapiens
AASLRQEL

SEQ ID NO: 167504 - protein, 8 aa, Homo Sapiens
AASVRPVL

SEQ ID NO: 167505 - protein, 8 aa, Homo Sapiens
AATIRLIF

SEQ ID NO: 167506 - protein, 8 aa, Homo Sapiens
AFKNRMEV

SEQ ID NO: 167507 - protein, 8 aa, Homo Sapiens
AFNLRISF

SEQ ID NO: 167508 - protein, 8 aa, Homo Sapiens
AFVTGYDI

SEQ ID NO: 167509 - protein, 8 aa, Homo Sapiens
AISHGRVF

SEQ ID NO: 167510 - protein, 8 aa, Homo Sapiens
AQSFRPAM

SEQ ID NO: 167511 - protein, 8 aa, Homo Sapiens
ASFNRMVM

SEQ ID NO: 167512 - protein, 8 aa, Homo Sapiens
ASGLIHRV

SEQ ID NO: 167513 - protein, 8 aa, Homo Sapiens
ASLRKVSM

SEQ ID NO: 167514 - protein, 8 aa, Homo Sapiens
ASLVHLSL

SEQ ID NO: 167515 - protein, 8 aa, Homo Sapiens
ASNTRLQL

SEQ ID NO: 167516 - protein, 8 aa, Homo Sapiens
ASRVIREL

SEQ ID NO: 167517 - protein, 8 aa, Homo Sapiens
ASTTRISL

SEQ ID NO: 167518 - protein, 8 aa, Homo Sapiens
ATKLERVF

SEQ ID NO: 167519 - protein, 8 aa, Homo Sapiens
ATRWAKKI

SEQ ID NO: 167520 - protein, 8 aa, Homo Sapiens
CAALRMLL

SEQ ID NO: 167521 - protein, 8 aa, Homo Sapiens
CAQVLPYL

SEQ ID NO: 167522 - protein, 8 aa, Homo Sapiens
CASINRIY

SEQ ID NO: 167523 - protein, 8 aa, Homo Sapiens
CCTLKIEY

SEQ ID NO: 167524 - protein, 8 aa, Homo Sapiens
CSAIRESY

SEQ ID NO: 167525 - protein, 8 aa, Homo Sapiens
DELRDEGK

SEQ ID NO: 167526 - protein, 8 aa, Homo Sapiens
DLMNLSEK

SEQ ID NO: 167527 - protein, 8 aa, Homo Sapiens
DVSSALDK

SEQ ID NO: 167528 - protein, 8 aa, Homo Sapiens
ELGFRPEY

SEQ ID NO: 167529 - protein, 8 aa, Homo Sapiens
FAAEAIAL

SEQ ID NO: 167530 - protein, 8 aa, Homo Sapiens
FAAEAIAM

SEQ ID NO: 167531 - protein, 8 aa, Homo Sapiens
FAAEHTIF

SEQ ID NO: 167532 - protein, 8 aa, Homo Sapiens
FAAKQREL

SEQ ID NO: 167533 - protein, 8 aa, Homo Sapiens
FAALQLEY

SEQ ID NO: 167534 - protein, 8 aa, Homo Sapiens
FAASGLEF

SEQ ID NO: 167535 - protein, 8 aa, Homo Sapiens
FAAVIQAL

SEQ ID NO: 167536 - protein, 8 aa, Homo Sapiens
FAAVKLFL

SEQ ID NO: 167537 - protein, 8 aa, Homo Sapiens
FAAYGNVF

SEQ ID NO: 167538 - protein, 8 aa, Homo Sapiens
FAFSHEQL

SEQ ID NO: 167539 - protein, 8 aa, Homo Sapiens
FAFSRQAL

SEQ ID NO: 167540 - protein, 8 aa, Homo Sapiens
FAFVEFEL

SEQ ID NO: 167541 - protein, 8 aa, Homo Sapiens
FAFVEYEV

SEQ ID NO: 167542 - protein, 8 aa, Homo Sapiens
FAFVHISF

SEQ ID NO: 167543 - protein, 8 aa, Homo Sapiens
FAGLVPRL

SEQ ID NO: 167544 - protein, 8 aa, Homo Sapiens
FAGQGIVY

SEQ ID NO: 167545 - protein, 8 aa, Homo Sapiens
FAGQMAAL

SEQ ID NO: 167546 - protein, 8 aa, Homo Sapiens
FAGSILAV

SEQ ID NO: 167547 - protein, 8 aa, Homo Sapiens
FAGWGRAL

SEQ ID NO: 167548 - protein, 8 aa, Homo Sapiens
FAHIQAVF

SEQ ID NO: 167549 - protein, 8 aa, Homo Sapiens
FAHWGQEL

SEQ ID NO: 167550 - protein, 8 aa, Homo Sapiens
FAIYKMSF

SEQ ID NO: 167551 - protein, 8 aa, Homo Sapiens
FALEHLEM

SEQ ID NO: 167552 - protein, 8 aa, Homo Sapiens
FALNHPEL

SEQ ID NO: 167553 - protein, 8 aa, Homo Sapiens
FALVMQQL

SEQ ID NO: 167554 - protein, 8 aa, Homo Sapiens
FALVSQAY

SEQ ID NO: 167555 - protein, 8 aa, Homo Sapiens
FALYRQAY

SEQ ID NO: 167556 - protein, 8 aa, Homo Sapiens
FAMIIDKL

SEQ ID NO: 167557 - protein, 8 aa, Homo Sapiens
FAMNGKSF

SEQ ID NO: 167558 - protein, 8 aa, Homo Sapiens
FAMVHVAY

SEQ ID NO: 167559 - protein, 8 aa, Homo Sapiens
FAMVKGYF

SEQ ID NO: 167560 - protein, 8 aa, Homo Sapiens
FANYIDKV

SEQ ID NO: 167561 - protein, 8 aa, Homo Sapiens
FAQFGHVR

SEQ ID NO: 167562 - protein, 8 aa, Homo Sapiens
FAQIALQL

SEQ ID NO: 167563 - protein, 8 aa, Homo Sapiens
FAQPAFML

SEQ ID NO: 167564 - protein, 8 aa, Homo Sapiens
FARIAIEV

SEQ ID NO: 167565 - protein, 8 aa, Homo Sapiens
FARLPLVV

SEQ ID NO: 167566 - protein, 8 aa, Homo Sapiens
FASFSDYY

SEQ ID NO: 167567 - protein, 8 aa, Homo Sapiens
FASLQPSL

SEQ ID NO: 167568 - protein, 8 aa, Homo Sapiens
FASNHIQL

SEQ ID NO: 167569 - protein, 8 aa, Homo Sapiens
FASNLPTL

SEQ ID NO: 167570 - protein, 8 aa, Homo Sapiens
FASPGRLF

SEQ ID NO: 167571 - protein, 8 aa, Homo Sapiens
FASTHLIL

SEQ ID NO: 167572 - protein, 8 aa, Homo Sapiens
FATFKMQY

SEQ ID NO: 167573 - protein, 8 aa, Homo Sapiens
FATILVEY

SEQ ID NO: 167574 - protein, 8 aa, Homo Sapiens
FATLQNEL

SEQ ID NO: 167575 - protein, 8 aa, Homo Sapiens
FATNGFTY

SEQ ID NO: 167576 - protein, 8 aa, Homo Sapiens
FATVRETL

SEQ ID NO: 167577 - protein, 8 aa, Homo Sapiens
FAVALPQL

SEQ ID NO: 167578 - protein, 8 aa, Homo Sapiens
FAVDPRFL

SEQ ID NO: 167579 - protein, 8 aa, Homo Sapiens
FAVIKEAF

SEQ ID NO: 167580 - protein, 8 aa, Homo Sapiens
FAVLPRLL

SEQ ID NO: 167581 - protein, 8 aa, Homo Sapiens
FAVTGYDL

SEQ ID NO: 167582 - protein, 8 aa, Homo Sapiens
FAWGHDEL

SEQ ID NO: 167583 - protein, 8 aa, Homo Sapiens
FAYLGRLA

SEQ ID NO: 167584 - protein, 8 aa, Homo Sapiens
FAYLRDLL

SEQ ID NO: 167585 - protein, 8 aa, Homo Sapiens
FCSLPRKY

SEQ ID NO: 167586 - protein, 8 aa, Homo Sapiens
FFAERLYY

SEQ ID NO: 167587 - protein, 8 aa, Homo Sapiens
FFENHPYF

SEQ ID NO: 167588 - protein, 8 aa, Homo Sapiens
FFFSHVGW

SEQ ID NO: 167589 - protein, 8 aa, Homo Sapiens
FFFSRLEY

SEQ ID NO: 167590 - protein, 8 aa, Homo Sapiens
FFKDRHWL

SEQ ID NO: 167591 - protein, 8 aa, Homo Sapiens
FFKDRNWL

SEQ ID NO: 167592 - protein, 8 aa, Homo Sapiens
FFLLRIHF

SEQ ID NO: 167593 - protein, 8 aa, Homo Sapiens
FFQIRDDY

SEQ ID NO: 167594 - protein, 8 aa, Homo Sapiens
FGADARAL

SEQ ID NO: 167595 - protein, 8 aa, Homo Sapiens
FGGKRLSL

SEQ ID NO: 167596 - protein, 8 aa, Homo Sapiens
FGGQRLTL

SEQ ID NO: 167597 - protein, 8 aa, Homo Sapiens
FGNLRPVL

SEQ ID NO: 167598 - protein, 8 aa, Homo Sapiens
FGNYRPFL

SEQ ID NO: 167599 - protein, 8 aa, Homo Sapiens
FGTIRDSL

SEQ ID NO: 167600 - protein, 8 aa, Homo Sapiens
FIRDPLTL

SEQ ID NO: 167601 - protein, 8 aa, Homo Sapiens
FITEIPEL

SEQ ID NO: 167602 - protein, 8 aa, Homo Sapiens
FITNPRTL

SEQ ID NO: 167603 - protein, 8 aa, Homo Sapiens
FNFVGKIL

SEQ ID NO: 167604 - protein, 8 aa, Homo Sapiens
FNSVRSVF

SEQ ID NO: 167605 - protein, 8 aa, Homo Sapiens
FSAHRIVL

SEQ ID NO: 167606 - protein, 8 aa, Homo Sapiens
FSANPKEL

SEQ ID NO: 167607 - protein, 8 aa, Homo Sapiens
FSASHRLY

SEQ ID NO: 167608 - protein, 8 aa, Homo Sapiens
FSATPRYM

SEQ ID NO: 167609 - protein, 8 aa, Homo Sapiens
FSAVREDF

SEQ ID NO: 167610 - protein, 8 aa, Homo Sapiens
FSCVKNEL

SEQ ID NO: 167611 - protein, 8 aa, Homo Sapiens
FSDVLPVL

SEQ ID NO: 167612 - protein, 8 aa, Homo Sapiens
FSFQRPLL

SEQ ID NO: 167613 - protein, 8 aa, Homo Sapiens
FSFVMPSL

SEQ ID NO: 167614 - protein, 8 aa, Homo Sapiens
FSHLQPTL

SEQ ID NO: 167615 - protein, 8 aa, Homo Sapiens
FSHWTYEY

SEQ ID NO: 167616 - protein, 8 aa, Homo Sapiens
FSINGHFY

SEQ ID NO: 167617 - protein, 8 aa, Homo Sapiens
FSIVMNEL

SEQ ID NO: 167618 - protein, 8 aa, Homo Sapiens
FSMEALEL

SEQ ID NO: 167619 - protein, 8 aa, Homo Sapiens
FSMVGLYY

SEQ ID NO: 167620 - protein, 8 aa, Homo Sapiens
FSNIREEL

SEQ ID NO: 167621 - protein, 8 aa, Homo Sapiens
FSPTGEIL

SEQ ID NO: 167622 - protein, 8 aa, Homo Sapiens
FSPVGSVL

SEQ ID NO: 167623 - protein, 8 aa, Homo Sapiens
FSQIQPKL

SEQ ID NO: 167624 - protein, 8 aa, Homo Sapiens
FSSERIDW

SEQ ID NO: 167625 - protein, 8 aa, Homo Sapiens
FSSLHTVF

SEQ ID NO: 167626 - protein, 8 aa, Homo Sapiens
FSSNPISL

SEQ ID NO: 167627 - protein, 8 aa, Homo Sapiens
FSSTKEEF

SEQ ID NO: 167628 - protein, 8 aa, Homo Sapiens
FSSVGEEF

SEQ ID NO: 167629 - protein, 8 aa, Homo Sapiens
FSTTKPLF

SEQ ID NO: 167630 - protein, 8 aa, Homo Sapiens
FSTVHEKF

SEQ ID NO: 167631 - protein, 8 aa, Homo Sapiens
FSTVRKEM

SEQ ID NO: 167632 - protein, 8 aa, Homo Sapiens
FSVLQHVL

SEQ ID NO: 167633 - protein, 8 aa, Homo Sapiens
FSVTGRVL

SEQ ID NO: 167634 - protein, 8 aa, Homo Sapiens
FSWIRNTL

SEQ ID NO: 167635 - protein, 8 aa, Homo Sapiens
FSYAGFEM

SEQ ID NO: 167636 - protein, 8 aa, Homo Sapiens
FTADPLSL

SEQ ID NO: 167637 - protein, 8 aa, Homo Sapiens
FTAFKEEY

SEQ ID NO: 167638 - protein, 8 aa, Homo Sapiens
FTATQPEV

SEQ ID NO: 167639 - protein, 8 aa, Homo Sapiens
FTFTRVEL

SEQ ID NO: 167640 - protein, 8 aa, Homo Sapiens
FTIIREEF

SEQ ID NO: 167641 - protein, 8 aa, Homo Sapiens
FTMVGKTF

SEQ ID NO: 167642 - protein, 8 aa, Homo Sapiens
FTSEPRLI

SEQ ID NO: 167643 - protein, 8 aa, Homo Sapiens
FTSSRLFF

SEQ ID NO: 167644 - protein, 8 aa, Homo Sapiens
FTTLKPEL

SEQ ID NO: 167645 - protein, 8 aa, Homo Sapiens
FVEVGRLG

SEQ ID NO: 167646 - protein, 8 aa, Homo Sapiens
FVGFQPVL

SEQ ID NO: 167647 - protein, 8 aa, Homo Sapiens
FVGLRLEL

SEQ ID NO: 167648 - protein, 8 aa, Homo Sapiens
FWFFREAF

SEQ ID NO: 167649 - protein, 8 aa, Homo Sapiens
FWKEHPEI

SEQ ID NO: 167650 - protein, 8 aa, Homo Sapiens
FWMTRQEY

SEQ ID NO: 167651 - protein, 8 aa, Homo Sapiens
FYVEHPEV

SEQ ID NO: 167652 - protein, 8 aa, Homo Sapiens
GGYAEVGR

SEQ ID NO: 167653 - protein, 8 aa, Homo Sapiens
GKEAFAPL

SEQ ID NO: 167654 - protein, 8 aa, Homo Sapiens
HFGIHEEM

SEQ ID NO: 167655 - protein, 8 aa, Homo Sapiens
HFNTRLSF

SEQ ID NO: 167656 - protein, 8 aa, Homo Sapiens
HGPGLIYR

SEQ ID NO: 167657 - protein, 8 aa, Homo Sapiens
HGWLRPEM

SEQ ID NO: 167658 - protein, 8 aa, Homo Sapiens
HSAERLAL

SEQ ID NO: 167659 - protein, 8 aa, Homo Sapiens
HSFFKISY

SEQ ID NO: 167660 - protein, 8 aa, Homo Sapiens
HWLVGMVY

SEQ ID NO: 167661 - protein, 8 aa, Homo Sapiens
IAAIPRLI

SEQ ID NO: 167662 - protein, 8 aa, Homo Sapiens
IAHLRQIL

SEQ ID NO: 167663 - protein, 8 aa, Homo Sapiens
IAHVLPAL

SEQ ID NO: 167664 - protein, 8 aa, Homo Sapiens
IALEHPML

SEQ ID NO: 167665 - protein, 8 aa, Homo Sapiens
IALLLPQL

SEQ ID NO: 167666 - protein, 8 aa, Homo Sapiens
IALTRAEM

SEQ ID NO: 167667 - protein, 8 aa, Homo Sapiens
IAMQLPVL

SEQ ID NO: 167668 - protein, 8 aa, Homo Sapiens
IANYRPTL

SEQ ID NO: 167669 - protein, 8 aa, Homo Sapiens
IASQGREL

SEQ ID NO: 167670 - protein, 8 aa, Homo Sapiens
IFKERESF

SEQ ID NO: 167671 - protein, 8 aa, Homo Sapiens
IFSQKPEF

SEQ ID NO: 167672 - protein, 8 aa, Homo Sapiens
IGIVQPEL

SEQ ID NO: 167673 - protein, 8 aa, Homo Sapiens
IMMNTPVI

SEQ ID NO: 167674 - protein, 8 aa, Homo Sapiens
IMTFRPTM

SEQ ID NO: 167675 - protein, 8 aa, Homo Sapiens
IQSIRMGM

SEQ ID NO: 167676 - protein, 8 aa, Homo Sapiens
ISAVRPVI

SEQ ID NO: 167677 - protein, 8 aa, Homo Sapiens
ISLEGKPL

SEQ ID NO: 167678 - protein, 8 aa, Homo Sapiens
ISLVGFVL

SEQ ID NO: 167679 - protein, 8 aa, Homo Sapiens
ISMEVPVM

SEQ ID NO: 167680 - protein, 8 aa, Homo Sapiens
ISQIQPEV

SEQ ID NO: 167681 - protein, 8 aa, Homo Sapiens
ISQVGRVY

SEQ ID NO: 167682 - protein, 8 aa, Homo Sapiens
ISTLKTEF

SEQ ID NO: 167683 - protein, 8 aa, Homo Sapiens
ISTWKPEM

SEQ ID NO: 167684 - protein, 8 aa, Homo Sapiens
ISVEGREF

SEQ ID NO: 167685 - protein, 8 aa, Homo Sapiens
ISVKGRIY

SEQ ID NO: 167686 - protein, 8 aa, Homo Sapiens
ITNIRPSF

SEQ ID NO: 167687 - protein, 8 aa, Homo Sapiens
ITTLRQVL

SEQ ID NO: 167688 - protein, 8 aa, Homo Sapiens
KAFIHHEL

SEQ ID NO: 167689 - protein, 8 aa, Homo Sapiens
KALDGFVM

SEQ ID NO: 167690 - protein, 8 aa, Homo Sapiens
KALTHLEM

SEQ ID NO: 167691 - protein, 8 aa, Homo Sapiens
KARLPLRL

SEQ ID NO: 167692 - protein, 8 aa, Homo Sapiens
KFHLRPEL

SEQ ID NO: 167693 - protein, 8 aa, Homo Sapiens
KLVTDLTK

SEQ ID NO: 167694 - protein, 8 aa, Homo Sapiens
KNSIRLTL

SEQ ID NO: 167695 - protein, 8 aa, Homo Sapiens
KSTIKFQM

SEQ ID NO: 167696 - protein, 8 aa, Homo Sapiens
LAAEPRLL

SEQ ID NO: 167697 - protein, 8 aa, Homo Sapiens
LAAHRELL

SEQ ID NO: 167698 - protein, 8 aa, Homo Sapiens
LAAIKNAM

SEQ ID NO: 167699 - protein, 8 aa, Homo Sapiens
LAAVRLWL

SEQ ID NO: 167700 - protein, 8 aa, Homo Sapiens
LAGKVLAL

SEQ ID NO: 167701 - protein, 8 aa, Homo Sapiens
LAGPALEL

SEQ ID NO: 167702 - protein, 8 aa, Homo Sapiens
LAKVGIAL

SEQ ID NO: 167703 - protein, 8 aa, Homo Sapiens
LAMVSLEM

SEQ ID NO: 167704 - protein, 8 aa, Homo Sapiens
LANLRPLL

SEQ ID NO: 167705 - protein, 8 aa, Homo Sapiens
LAQLQQEF

SEQ ID NO: 167706 - protein, 8 aa, Homo Sapiens
LASFIPAV

SEQ ID NO: 167707 - protein, 8 aa, Homo Sapiens
LASWGHEY

SEQ ID NO: 167708 - protein, 8 aa, Homo Sapiens
LFQSRISL

SEQ ID NO: 167709 - protein, 8 aa, Homo Sapiens
LFQTRQEM

SEQ ID NO: 167710 - protein, 8 aa, Homo Sapiens
LFTFRPAL

SEQ ID NO: 167711 - protein, 8 aa, Homo Sapiens
LFVQRPEF

SEQ ID NO: 167712 - protein, 8 aa, Homo Sapiens
LGGHLDAK

SEQ ID NO: 167713 - protein, 8 aa, Homo Sapiens
LGNVRPLL

SEQ ID NO: 167714 - protein, 8 aa, Homo Sapiens
LIVTQTMK

SEQ ID NO: 167715 - protein, 8 aa, Homo Sapiens
LQAQRLVM

SEQ ID NO: 167716 - protein, 8 aa, Homo Sapiens
LQQPRPLM

SEQ ID NO: 167717 - protein, 8 aa, Homo Sapiens
LSAIQSEV

SEQ ID NO: 167718 - protein, 8 aa, Homo Sapiens
LSAPARLY

SEQ ID NO: 167719 - protein, 8 aa, Homo Sapiens
LSLERPTM

SEQ ID NO: 167720 - protein, 8 aa, Homo Sapiens
LSLLGHVY

SEQ ID NO: 167721 - protein, 8 aa, Homo Sapiens
LSMEILEV

SEQ ID NO: 167722 - protein, 8 aa, Homo Sapiens
LSSIRHMI

SEQ ID NO: 167723 - protein, 8 aa, Homo Sapiens
LSSLRFVF

SEQ ID NO: 167724 - protein, 8 aa, Homo Sapiens
LSSLRPSL

SEQ ID NO: 167725 - protein, 8 aa, Homo Sapiens
LSSMRLPL

SEQ ID NO: 167726 - protein, 8 aa, Homo Sapiens
LSSVKLEY

SEQ ID NO: 167727 - protein, 8 aa, Homo Sapiens
LSTIRSFL

SEQ ID NO: 167728 - protein, 8 aa, Homo Sapiens
LSYSRISL

SEQ ID NO: 167729 - protein, 8 aa, Homo Sapiens
LTAFVVTL

SEQ ID NO: 167730 - protein, 8 aa, Homo Sapiens
LTAQPRLM

SEQ ID NO: 167731 - protein, 8 aa, Homo Sapiens
LTVLGQPK

SEQ ID NO: 167732 - protein, 8 aa, Homo Sapiens
LTVLSQPK

SEQ ID NO: 167733 - protein, 8 aa, Homo Sapiens
LVNEVTEF

SEQ ID NO: 167734 - protein, 8 aa, Homo Sapiens
LVTEVTKK

SEQ ID NO: 167735 - protein, 8 aa, Homo Sapiens
MAAYQLEL

SEQ ID NO: 167736 - protein, 8 aa, Homo Sapiens
MALLHLWV

SEQ ID NO: 167737 - protein, 8 aa, Homo Sapiens
MAMRIPVL

SEQ ID NO: 167738 - protein, 8 aa, Homo Sapiens
MASLLPQL

SEQ ID NO: 167739 - protein, 8 aa, Homo Sapiens
MATRVLSM

SEQ ID NO: 167740 - protein, 8 aa, Homo Sapiens
MFHNRHLF

SEQ ID NO: 167741 - protein, 8 aa, Homo Sapiens
MFHTRNSL

SEQ ID NO: 167742 - protein, 8 aa, Homo Sapiens
MFLTRSEY

SEQ ID NO: 167743 - protein, 8 aa, Homo Sapiens
MSMTGVSF

SEQ ID NO: 167744 - protein, 8 aa, Homo Sapiens
MSMVGYII

SEQ ID NO: 167745 - protein, 8 aa, Homo Sapiens
MSTCRLIL

SEQ ID NO: 167746 - protein, 8 aa, Homo Sapiens
MTAVRPAL

SEQ ID NO: 167747 - protein, 8 aa, Homo Sapiens
MTSFRLAL

SEQ ID NO: 167748 - protein, 8 aa, Homo Sapiens
MYSIITPN

SEQ ID NO: 167749 - protein, 8 aa, Homo Sapiens
NANNRLLL

SEQ ID NO: 167750 - protein, 8 aa, Homo Sapiens
NATIRNVL

SEQ ID NO: 167751 - protein, 8 aa, Homo Sapiens
NFAYRLEL

SEQ ID NO: 167752 - protein, 8 aa, Homo Sapiens
NFNTRFVM

SEQ ID NO: 167753 - protein, 8 aa, Homo Sapiens
NFYNRPIL

SEQ ID NO: 167754 - protein, 8 aa, Homo Sapiens
NIPVVSGK

SEQ ID NO: 167755 - protein, 8 aa, Homo Sapiens
NSAVLPEM

SEQ ID NO: 167756 - protein, 8 aa, Homo Sapiens
NSSIRPIF

SEQ ID NO: 167757 - protein, 8 aa, Homo Sapiens
NSSQRVEL

SEQ ID NO: 167758 - protein, 8 aa, Homo Sapiens
NSTNRVFF

SEQ ID NO: 167759 - protein, 8 aa, Homo Sapiens
PINGNGKQ

SEQ ID NO: 167760 - protein, 8 aa, Homo Sapiens
QATISFPK

SEQ ID NO: 167761 - protein, 8 aa, Homo Sapiens
QEAFDISK

SEQ ID NO: 167762 - protein, 8 aa, Homo Sapiens
QMAFQILL

SEQ ID NO: 167763 - protein, 8 aa, Homo Sapiens
QSWFRMVL

SEQ ID NO: 167764 - protein, 8 aa, Homo Sapiens
RAFVGFEY

SEQ ID NO: 167765 - protein, 8 aa, Homo Sapiens
RAFVHWYV

SEQ ID NO: 167766 - protein, 8 aa, Homo Sapiens
RAFVSMVY

SEQ ID NO: 167767 - protein, 8 aa, Homo Sapiens
RANERLEL

SEQ ID NO: 167768 - protein, 8 aa, Homo Sapiens
RANLRLTL

SEQ ID NO: 167769 - protein, 8 aa, Homo Sapiens
RARFALGL

SEQ ID NO: 167770 - protein, 8 aa, Homo Sapiens
RATIGRYF

SEQ ID NO: 167771 - protein, 8 aa, Homo Sapiens
RNMERLTL

SEQ ID NO: 167772 - protein, 8 aa, Homo Sapiens
RTALPRIF

SEQ ID NO: 167773 - protein, 8 aa, Homo Sapiens
RVTERFVM

SEQ ID NO: 167774 - protein, 8 aa, Homo Sapiens
SAACRLQL

SEQ ID NO: 167775 - protein, 8 aa, Homo Sapiens
SAALPRIL

SEQ ID NO: 167776 - protein, 8 aa, Homo Sapiens
SAALRAVY

SEQ ID NO: 167777 - protein, 8 aa, Homo Sapiens
SAFVFPQL

SEQ ID NO: 167778 - protein, 8 aa, Homo Sapiens
SAGEPRVL

SEQ ID NO: 167779 - protein, 8 aa, Homo Sapiens
SALEEYTK

SEQ ID NO: 167780 - protein, 8 aa, Homo Sapiens
SAMLQPLL

SEQ ID NO: 167781 - protein, 8 aa, Homo Sapiens
SAMVMFEL

SEQ ID NO: 167782 - protein, 8 aa, Homo Sapiens
SAQEIPVV

SEQ ID NO: 167783 - protein, 8 aa, Homo Sapiens
SAQLLPVL

SEQ ID NO: 167784 - protein, 8 aa, Homo Sapiens
SARRPLLL

SEQ ID NO: 167785 - protein, 8 aa, Homo Sapiens
SASFREEY

SEQ ID NO: 167786 - protein, 8 aa, Homo Sapiens
SASVLPEL

SEQ ID NO: 167787 - protein, 8 aa, Homo Sapiens
SASYKPVF

SEQ ID NO: 167788 - protein, 8 aa, Homo Sapiens
SATIRFVM

SEQ ID NO: 167789 - protein, 8 aa, Homo Sapiens
SATWPKEV

SEQ ID NO: 167790 - protein, 8 aa, Homo Sapiens
SFFTRSFF

SEQ ID NO: 167791 - protein, 8 aa, Homo Sapiens
SFMTHPEF

SEQ ID NO: 167792 - protein, 8 aa, Homo Sapiens
SGFVNPVL

SEQ ID NO: 167793 - protein, 8 aa, Homo Sapiens
SISERLEM

SEQ ID NO: 167794 - protein, 8 aa, Homo Sapiens
SIVHPSYN

SEQ ID NO: 167795 - protein, 8 aa, Homo Sapiens
SMAARVPI

SEQ ID NO: 167796 - protein, 8 aa, Homo Sapiens
SSGFRDFL

SEQ ID NO: 167797 - protein, 8 aa, Homo Sapiens
SSGLRFVL

SEQ ID NO: 167798 - protein, 8 aa, Homo Sapiens
SSHVERVF

SEQ ID NO: 167799 - protein, 8 aa, Homo Sapiens
SSLVHPEL

SEQ ID NO: 167800 - protein, 8 aa, Homo Sapiens
SSYVGLVY

SEQ ID NO: 167801 - protein, 8 aa, Homo Sapiens
TAAFPRML

SEQ ID NO: 167802 - protein, 8 aa, Homo Sapiens
TAAMGRVL

SEQ ID NO: 167803 - protein, 8 aa, Homo Sapiens
TAGLRPIL

SEQ ID NO: 167804 - protein, 8 aa, Homo Sapiens
TASLPREL

SEQ ID NO: 167805 - protein, 8 aa, Homo Sapiens
TATLRPYL

SEQ ID NO: 167806 - protein, 8 aa, Homo Sapiens
TFLNHPAL

SEQ ID NO: 167807 - protein, 8 aa, Homo Sapiens
TFLTRQAF

SEQ ID NO: 167808 - protein, 8 aa, Homo Sapiens
TFMNRVEV

SEQ ID NO: 167809 - protein, 8 aa, Homo Sapiens
TFTNHMVF

SEQ ID NO: 167810 - protein, 8 aa, Homo Sapiens
TGGFVLLY

SEQ ID NO: 167811 - protein, 8 aa, Homo Sapiens
TNFIKAEY

SEQ ID NO: 167812 - protein, 8 aa, Homo Sapiens
TNSVKLEM

SEQ ID NO: 167813 - protein, 8 aa, Homo Sapiens
TSLVHPVM

SEQ ID NO: 167814 - protein, 8 aa, Homo Sapiens
TSQLIPEM

SEQ ID NO: 167815 - protein, 8 aa, Homo Sapiens
TSTTRPVL

SEQ ID NO: 167816 - protein, 8 aa, Homo Sapiens
TTTFRPEL

SEQ ID NO: 167817 - protein, 8 aa, Homo Sapiens
TTWTRPIM

SEQ ID NO: 167818 - protein, 8 aa, Homo Sapiens
VAAEILEI

SEQ ID NO: 167819 - protein, 8 aa, Homo Sapiens
VAAIPRLL

SEQ ID NO: 167820 - protein, 8 aa, Homo Sapiens
VAAMARLL

SEQ ID NO: 167821 - protein, 8 aa, Homo Sapiens
VAAMQPRM

SEQ ID NO: 167822 - protein, 8 aa, Homo Sapiens
VAAVKWVM

SEQ ID NO: 167823 - protein, 8 aa, Homo Sapiens
VAFIRAEY

SEQ ID NO: 167824 - protein, 8 aa, Homo Sapiens
VAGFNPAL

SEQ ID NO: 167825 - protein, 8 aa, Homo Sapiens
VAGLQPVL

SEQ ID NO: 167826 - protein, 8 aa, Homo Sapiens
VALEHFVL

SEQ ID NO: 167827 - protein, 8 aa, Homo Sapiens
VALLQPFL

SEQ ID NO: 167828 - protein, 8 aa, Homo Sapiens
VALTHLTL

SEQ ID NO: 167829 - protein, 8 aa, Homo Sapiens
VALVHPDL

SEQ ID NO: 167830 - protein, 8 aa, Homo Sapiens
VAMVHPLL

SEQ ID NO: 167831 - protein, 8 aa, Homo Sapiens
VAQIRMAF

SEQ ID NO: 167832 - protein, 8 aa, Homo Sapiens
VAQLQFQL

SEQ ID NO: 167833 - protein, 8 aa, Homo Sapiens
VASEHFYF

SEQ ID NO: 167834 - protein, 8 aa, Homo Sapiens
VASFPRTV

SEQ ID NO: 167835 - protein, 8 aa, Homo Sapiens
VASIKTGF

SEQ ID NO: 167836 - protein, 8 aa, Homo Sapiens
VASMRLAY

SEQ ID NO: 167837 - protein, 8 aa, Homo Sapiens
VATEQPEL

SEQ ID NO: 167838 - protein, 8 aa, Homo Sapiens
VATFRLML

SEQ ID NO: 167839 - protein, 8 aa, Homo Sapiens
VATWMLEV

SEQ ID NO: 167840 - protein, 8 aa, Homo Sapiens
VAYHQPTL

SEQ ID NO: 167841 - protein, 8 aa, Homo Sapiens
VFFVHEGY

SEQ ID NO: 167842 - protein, 8 aa, Homo Sapiens
VFHPRQEL

SEQ ID NO: 167843 - protein, 8 aa, Homo Sapiens
VFKERIGY

SEQ ID NO: 167844 - protein, 8 aa, Homo Sapiens
VFMTHLEF

SEQ ID NO: 167845 - protein, 8 aa, Homo Sapiens
VGSFRQEY

SEQ ID NO: 167846 - protein, 8 aa, Homo Sapiens
VITNQPEI

SEQ ID NO: 167847 - protein, 8 aa, Homo Sapiens
VLAPTREL

SEQ ID NO: 167848 - protein, 8 aa, Homo Sapiens
VQSIRPPY

SEQ ID NO: 167849 - protein, 8 aa, Homo Sapiens
VSALEQRL

SEQ ID NO: 167850 - protein, 8 aa, Homo Sapiens
VSAYPRQL

SEQ ID NO: 167851 - protein, 8 aa, Homo Sapiens
VSHLQPLM

SEQ ID NO: 167852 - protein, 8 aa, Homo Sapiens
VSHLRLLP

SEQ ID NO: 167853 - protein, 8 aa, Homo Sapiens
VSHLRPLL

SEQ ID NO: 167854 - protein, 8 aa, Homo Sapiens
VSHTHLAF

SEQ ID NO: 167855 - protein, 8 aa, Homo Sapiens
VSLVQLTL

SEQ ID NO: 167856 - protein, 8 aa, Homo Sapiens
VSMLKQDY

SEQ ID NO: 167857 - protein, 8 aa, Homo Sapiens
VSNIRQVF

SEQ ID NO: 167858 - protein, 8 aa, Homo Sapiens
VSQVGKEL

SEQ ID NO: 167859 - protein, 8 aa, Homo Sapiens
VSSLRLAY

SEQ ID NO: 167860 - protein, 8 aa, Homo Sapiens
VSSLRMML

SEQ ID NO: 167861 - protein, 8 aa, Homo Sapiens
VTHIGRVY

SEQ ID NO: 167862 - protein, 8 aa, Homo Sapiens
VTQLRPIM

SEQ ID NO: 167863 - protein, 8 aa, Homo Sapiens
VTSILPVL

SEQ ID NO: 167864 - protein, 8 aa, Homo Sapiens
VTTVILEV

SEQ ID NO: 167865 - protein, 8 aa, Homo Sapiens
VVALSRTY

SEQ ID NO: 167866 - protein, 8 aa, Homo Sapiens
VVTFPRAY

SEQ ID NO: 167867 - protein, 8 aa, Homo Sapiens
WFNVRNGY

SEQ ID NO: 167868 - protein, 8 aa, Homo Sapiens
YAAIPREM

SEQ ID NO: 167869 - protein, 8 aa, Homo Sapiens
YAAIRDNY

SEQ ID NO: 167870 - protein, 8 aa, Homo Sapiens
YAALHGEF

SEQ ID NO: 167871 - protein, 8 aa, Homo Sapiens
YAALRELI

SEQ ID NO: 167872 - protein, 8 aa, Homo Sapiens
YAAQLPAL

SEQ ID NO: 167873 - protein, 8 aa, Homo Sapiens
YAAVTPEL

SEQ ID NO: 167874 - protein, 8 aa, Homo Sapiens
YAEGVRVL

SEQ ID NO: 167875 - protein, 8 aa, Homo Sapiens
YAFLHRTL

SEQ ID NO: 167876 - protein, 8 aa, Homo Sapiens
YAFLREAL

SEQ ID NO: 167877 - protein, 8 aa, Homo Sapiens
YAFSKLTY

SEQ ID NO: 167878 - protein, 8 aa, Homo Sapiens
YAGAILEV

SEQ ID NO: 167879 - protein, 8 aa, Homo Sapiens
YAGLQPYL

SEQ ID NO: 167880 - protein, 8 aa, Homo Sapiens
YAGTPRFF

SEQ ID NO: 167881 - protein, 8 aa, Homo Sapiens
YAIIKEEL

SEQ ID NO: 167882 - protein, 8 aa, Homo Sapiens
YAIIKFPL

SEQ ID NO: 167883 - protein, 8 aa, Homo Sapiens
YAIPQPDL

SEQ ID NO: 167884 - protein, 8 aa, Homo Sapiens
YAITRKAL

SEQ ID NO: 167885 - protein, 8 aa, Homo Sapiens
YAKLHPEM

SEQ ID NO: 167886 - protein, 8 aa, Homo Sapiens
YALETLTM

SEQ ID NO: 167887 - protein, 8 aa, Homo Sapiens
YALLGRTL

SEQ ID NO: 167888 - protein, 8 aa, Homo Sapiens
YALPHAIL

SEQ ID NO: 167889 - protein, 8 aa, Homo Sapiens
YALTVLEM

SEQ ID NO: 167890 - protein, 8 aa, Homo Sapiens
YAQFLREM

SEQ ID NO: 167891 - protein, 8 aa, Homo Sapiens
YASTGREF

SEQ ID NO: 167892 - protein, 8 aa, Homo Sapiens
YATYPREL

SEQ ID NO: 167893 - protein, 8 aa, Homo Sapiens
YAYLRDSL

SEQ ID NO: 167894 - protein, 8 aa, Homo Sapiens
YFDEHYEY

SEQ ID NO: 167895 - protein, 8 aa, Homo Sapiens
YFLEHLAF

SEQ ID NO: 167896 - protein, 8 aa, Homo Sapiens
YFLQRHEL

SEQ ID NO: 167897 - protein, 8 aa, Homo Sapiens
YFNPHLVF

SEQ ID NO: 167898 - protein, 8 aa, Homo Sapiens
YFSSRPAL

SEQ ID NO: 167899 - protein, 8 aa, Homo Sapiens
YFVTREVM

SEQ ID NO: 167900 - protein, 8 aa, Homo Sapiens
YGAEALER

SEQ ID NO: 167901 - protein, 8 aa, Homo Sapiens
YGLEHLAY

SEQ ID NO: 167902 - protein, 8 aa, Homo Sapiens
YGMPRQIL

SEQ ID NO: 167903 - protein, 8 aa, Homo Sapiens
YIATPRVW

SEQ ID NO: 167904 - protein, 8 aa, Homo Sapiens
YMQFIRLL

SEQ ID NO: 167905 - protein, 8 aa, Homo Sapiens
YNAVGFTY

SEQ ID NO: 167906 - protein, 8 aa, Homo Sapiens
YNFVRDVL

SEQ ID NO: 167907 - protein, 8 aa, Homo Sapiens
YSATRAAL

SEQ ID NO: 167908 - protein, 8 aa, Homo Sapiens
YSNIRFQF

SEQ ID NO: 167909 - protein, 8 aa, Homo Sapiens
YSSIRGFL

SEQ ID NO: 167910 - protein, 8 aa, Homo Sapiens
YSTIRPYL

SEQ ID NO: 167911 - protein, 8 aa, Homo Sapiens
YSYVTEEL

SEQ ID NO: 167912 - protein, 8 aa, Homo Sapiens
YTGKRIAL

SEQ ID NO: 167913 - protein, 8 aa, Homo Sapiens
YTLLGHEF

SEQ ID NO: 167914 - protein, 8 aa, Homo Sapiens
YVTILPEL

SEQ ID NO: 167915 - protein, 8 aa, Homo Sapiens
YWQNHPEL

SEQ ID NO: 167916 - protein, 9 aa, Homo Sapiens
AAAAAALLY

SEQ ID NO: 167917 - protein, 9 aa, Homo Sapiens
AAAAGRIAI

SEQ ID NO: 167918 - protein, 9 aa, Homo Sapiens
AAAALHPAL

SEQ ID NO: 167919 - protein, 9 aa, Homo Sapiens
AAAARIEAM

SEQ ID NO: 167920 - protein, 9 aa, Homo Sapiens
AAAAVARLW

SEQ ID NO: 167921 - protein, 9 aa, Homo Sapiens
AAADIFKHY

SEQ ID NO: 167922 - protein, 9 aa, Homo Sapiens
AAADLERFF

SEQ ID NO: 167923 - protein, 9 aa, Homo Sapiens
AAADPKVAF

SEQ ID NO: 167924 - protein, 9 aa, Homo Sapiens
AAADSIKIW

SEQ ID NO: 167925 - protein, 9 aa, Homo Sapiens
AAAEVRISF

SEQ ID NO: 167926 - protein, 9 aa, Homo Sapiens
AAAFARRVL

SEQ ID NO: 167927 - protein, 9 aa, Homo Sapiens
AAAFEKQVL

SEQ ID NO: 167928 - protein, 9 aa, Homo Sapiens
AAAFGRIAF

SEQ ID NO: 167929 - protein, 9 aa, Homo Sapiens
AAAFHPEEY

SEQ ID NO: 167930 - protein, 9 aa, Homo Sapiens
AAAFQPLII

SEQ ID NO: 167931 - protein, 9 aa, Homo Sapiens
AAAHFYFEL

SEQ ID NO: 167932 - protein, 9 aa, Homo Sapiens
AAAIKALEL

SEQ ID NO: 167933 - protein, 9 aa, Homo Sapiens
AAAKAALIY

SEQ ID NO: 167934 - protein, 9 aa, Homo Sapiens
AAAKNIRVW

SEQ ID NO: 167935 - protein, 9 aa, Homo Sapiens
AAALPPPAY

SEQ ID NO: 167936 - protein, 9 aa, Homo Sapiens
AAALRDLSF

SEQ ID NO: 167937 - protein, 9 aa, Homo Sapiens
AAALRIQNM

SEQ ID NO: 167938 - protein, 9 aa, Homo Sapiens
AAALWRTFF

SEQ ID NO: 167939 - protein, 9 aa, Homo Sapiens
AAAMNWRLF

SEQ ID NO: 167940 - protein, 9 aa, Homo Sapiens
AAAMTLRTV

SEQ ID NO: 167941 - protein, 9 aa, Homo Sapiens
AAANAIRVY

SEQ ID NO: 167942 - protein, 9 aa, Homo Sapiens
AAANPTLAF

SEQ ID NO: 167943 - protein, 9 aa, Homo Sapiens
AAAPALPFY

SEQ ID NO: 167944 - protein, 9 aa, Homo Sapiens
AAAPERVVL

SEQ ID NO: 167945 - protein, 9 aa, Homo Sapiens
AAAPHLLLL

SEQ ID NO: 167946 - protein, 9 aa, Homo Sapiens
AAAPLLPMI

SEQ ID NO: 167947 - protein, 9 aa, Homo Sapiens
AAAPLRPGM

SEQ ID NO: 167948 - protein, 9 aa, Homo Sapiens
AAAPQLLIV

SEQ ID NO: 167949 - protein, 9 aa, Homo Sapiens
AAAPSLLIL

SEQ ID NO: 167950 - protein, 9 aa, Homo Sapiens
AAAPVIKAY

SEQ ID NO: 167951 - protein, 9 aa, Homo Sapiens
AAARPKSAF

SEQ ID NO: 167952 - protein, 9 aa, Homo Sapiens
AAARRFYQY

SEQ ID NO: 167953 - protein, 9 aa, Homo Sapiens
AAASAKLAF

SEQ ID NO: 167954 - protein, 9 aa, Homo Sapiens
AAASHFFNL

SEQ ID NO: 167955 - protein, 9 aa, Homo Sapiens
AAASLIRLV

SEQ ID NO: 167956 - protein, 9 aa, Homo Sapiens
AAATRTTSF

SEQ ID NO: 167957 - protein, 9 aa, Homo Sapiens
AAAVDIRTW

SEQ ID NO: 167958 - protein, 9 aa, Homo Sapiens
AAAVPRAAF

SEQ ID NO: 167959 - protein, 9 aa, Homo Sapiens
AAAVPTRSY

SEQ ID NO: 167960 - protein, 9 aa, Homo Sapiens
AADWHNLIL

SEQ ID NO: 167961 - protein, 9 aa, Homo Sapiens
AAFAHNYDL

SEQ ID NO: 167962 - protein, 9 aa, Homo Sapiens
AAFAYTVKY

SEQ ID NO: 167963 - protein, 9 aa, Homo Sapiens
AAFDGGFTV

SEQ ID NO: 167964 - protein, 9 aa, Homo Sapiens
AAFDQWREW

SEQ ID NO: 167965 - protein, 9 aa, Homo Sapiens
AAFLILPEL

SEQ ID NO: 167966 - protein, 9 aa, Homo Sapiens
AAFLKAIGY

SEQ ID NO: 167967 - protein, 9 aa, Homo Sapiens
AAFLRHWKL

SEQ ID NO: 167968 - protein, 9 aa, Homo Sapiens
AAFTRALEY

SEQ ID NO: 167969 - protein, 9 aa, Homo Sapiens
AAFVKAVGF

SEQ ID NO: 167970 - protein, 9 aa, Homo Sapiens
AAFVKKLVY

SEQ ID NO: 167971 - protein, 9 aa, Homo Sapiens
AAGIKLIFF

SEQ ID NO: 167972 - protein, 9 aa, Homo Sapiens
AAGLRVLAV

SEQ ID NO: 167973 - protein, 9 aa, Homo Sapiens
AAGTRMYEY

SEQ ID NO: 167974 - protein, 9 aa, Homo Sapiens
AAIEWIIEH

SEQ ID NO: 167975 - protein, 9 aa, Homo Sapiens
AAIFHYLII

SEQ ID NO: 167976 - protein, 9 aa, Homo Sapiens
AAIGLVIYY

SEQ ID NO: 167977 - protein, 9 aa, Homo Sapiens
AAIKAFIAV

SEQ ID NO: 167978 - protein, 9 aa, Homo Sapiens
AAIKAIKFY

SEQ ID NO: 167979 - protein, 9 aa, Homo Sapiens
AAIKAIKLY

SEQ ID NO: 167980 - protein, 9 aa, Homo Sapiens
AAIKIIRQL

SEQ ID NO: 167981 - protein, 9 aa, Homo Sapiens
AAISHGRVF

SEQ ID NO: 167982 - protein, 9 aa, Homo Sapiens
AAKAALAAF

SEQ ID NO: 167983 - protein, 9 aa, Homo Sapiens
AAKEYPFIL

SEQ ID NO: 167984 - protein, 9 aa, Homo Sapiens
AAKFYSFLV

SEQ ID NO: 167985 - protein, 9 aa, Homo Sapiens
AAKIGNLEM

SEQ ID NO: 167986 - protein, 9 aa, Homo Sapiens
AAKPFFCEL

SEQ ID NO: 167987 - protein, 9 aa, Homo Sapiens
AAKQVLLYL

SEQ ID NO: 167988 - protein, 9 aa, Homo Sapiens
AAKSYIQSL

SEQ ID NO: 167989 - protein, 9 aa, Homo Sapiens
AAKTLILCL

SEQ ID NO: 167990 - protein, 9 aa, Homo Sapiens
AALARLLAA

SEQ ID NO: 167991 - protein, 9 aa, Homo Sapiens
AALFKAWAL

SEQ ID NO: 167992 - protein, 9 aa, Homo Sapiens
AALGFAQML

SEQ ID NO: 167993 - protein, 9 aa, Homo Sapiens
AALLRTFSF

SEQ ID NO: 167994 - protein, 9 aa, Homo Sapiens
AALNQALEM

SEQ ID NO: 167995 - protein, 9 aa, Homo Sapiens
AALPNVYEV

SEQ ID NO: 167996 - protein, 9 aa, Homo Sapiens
AALPVYQEL

SEQ ID NO: 167997 - protein, 9 aa, Homo Sapiens
AALWRFAEL

SEQ ID NO: 167998 - protein, 9 aa, Homo Sapiens
AALYHGMAL

SEQ ID NO: 167999 - protein, 9 aa, Homo Sapiens
AAMDEIPVL

SEQ ID NO: 168000 - protein, 9 aa, Homo Sapiens
AAMDYHWVF

SEQ ID NO: 168001 - protein, 9 aa, Homo Sapiens
AAMEFLQEL

SEQ ID NO: 168002 - protein, 9 aa, Homo Sapiens
AAMELAQMV

SEQ ID NO: 168003 - protein, 9 aa, Homo Sapiens
AAMMAVRVL

SEQ ID NO: 168004 - protein, 9 aa, Homo Sapiens
AAMPRIYEL

SEQ ID NO: 168005 - protein, 9 aa, Homo Sapiens
AAMPRPVSY

SEQ ID NO: 168006 - protein, 9 aa, Homo Sapiens
AAMSHLLEM

SEQ ID NO: 168007 - protein, 9 aa, Homo Sapiens
AAMYKSLEL

SEQ ID NO: 168008 - protein, 9 aa, Homo Sapiens
AANIYPLSL

SEQ ID NO: 168009 - protein, 9 aa, Homo Sapiens
AANLFAQTY

SEQ ID NO: 168010 - protein, 9 aa, Homo Sapiens
AANLKSIDF

SEQ ID NO: 168011 - protein, 9 aa, Homo Sapiens
AANLLIPAV

SEQ ID NO: 168012 - protein, 9 aa, Homo Sapiens
AANLRMHIF

SEQ ID NO: 168013 - protein, 9 aa, Homo Sapiens
AANPFFKLL

SEQ ID NO: 168014 - protein, 9 aa, Homo Sapiens
AANPHSFVF

SEQ ID NO: 168015 - protein, 9 aa, Homo Sapiens
AAQDRVLSL

SEQ ID NO: 168016 - protein, 9 aa, Homo Sapiens
AAQEAVKLY

SEQ ID NO: 168017 - protein, 9 aa, Homo Sapiens
AAQEGHLEL

SEQ ID NO: 168018 - protein, 9 aa, Homo Sapiens
AAQFIPKFF

SEQ ID NO: 168019 - protein, 9 aa, Homo Sapiens
AAQLRAQAL

SEQ ID NO: 168020 - protein, 9 aa, Homo Sapiens
AAQLRELQL

SEQ ID NO: 168021 - protein, 9 aa, Homo Sapiens
AAQLRPISL

SEQ ID NO: 168022 - protein, 9 aa, Homo Sapiens
AARDAILRI

SEQ ID NO: 168023 - protein, 9 aa, Homo Sapiens
AARDFVNYL

SEQ ID NO: 168024 - protein, 9 aa, Homo Sapiens
AARDVFLML

SEQ ID NO: 168025 - protein, 9 aa, Homo Sapiens
AAREFILKM

SEQ ID NO: 168026 - protein, 9 aa, Homo Sapiens
AAREFSHML

SEQ ID NO: 168027 - protein, 9 aa, Homo Sapiens
AAREVILVL

SEQ ID NO: 168028 - protein, 9 aa, Homo Sapiens
AARLRAVDF

SEQ ID NO: 168029 - protein, 9 aa, Homo Sapiens
AARPFTQTL

SEQ ID NO: 168030 - protein, 9 aa, Homo Sapiens
AARPVLLQV

SEQ ID NO: 168031 - protein, 9 aa, Homo Sapiens
AARSFYYKL

SEQ ID NO: 168032 - protein, 9 aa, Homo Sapiens
AARSGPLAM

SEQ ID NO: 168033 - protein, 9 aa, Homo Sapiens
AARSSIRVV

SEQ ID NO: 168034 - protein, 9 aa, Homo Sapiens
AARSVFLHL

SEQ ID NO: 168035 - protein, 9 aa, Homo Sapiens
AARTQQLLL

SEQ ID NO: 168036 - protein, 9 aa, Homo Sapiens
AARVFYLLL

SEQ ID NO: 168037 - protein, 9 aa, Homo Sapiens
AASAIYRLF

SEQ ID NO: 168038 - protein, 9 aa, Homo Sapiens
AASALIRTL

SEQ ID NO: 168039 - protein, 9 aa, Homo Sapiens
AASALNRLL

SEQ ID NO: 168040 - protein, 9 aa, Homo Sapiens
AASEVLKHL

SEQ ID NO: 168041 - protein, 9 aa, Homo Sapiens
AASFHSLSL

SEQ ID NO: 168042 - protein, 9 aa, Homo Sapiens
AASFINLLY

SEQ ID NO: 168043 - protein, 9 aa, Homo Sapiens
AASFVGYSY

SEQ ID NO: 168044 - protein, 9 aa, Homo Sapiens
AASFYQRAL

SEQ ID NO: 168045 - protein, 9 aa, Homo Sapiens
AASGHFICV

SEQ ID NO: 168046 - protein, 9 aa, Homo Sapiens
AASGLPLMV

SEQ ID NO: 168047 - protein, 9 aa, Homo Sapiens
AASLQVLEM

SEQ ID NO: 168048 - protein, 9 aa, Homo Sapiens
AASLRKVSM

SEQ ID NO: 168049 - protein, 9 aa, Homo Sapiens
AASLSYRVL

SEQ ID NO: 168050 - protein, 9 aa, Homo Sapiens
AASMRALVL

SEQ ID NO: 168051 - protein, 9 aa, Homo Sapiens
AASNYFRAM

SEQ ID NO: 168052 - protein, 9 aa, Homo Sapiens
AASPFYRGY

SEQ ID NO: 168053 - protein, 9 aa, Homo Sapiens
AASPKSFTL

SEQ ID NO: 168054 - protein, 9 aa, Homo Sapiens
AASPPRPLL

SEQ ID NO: 168055 - protein, 9 aa, Homo Sapiens
AASPYFRAM

SEQ ID NO: 168056 - protein, 9 aa, Homo Sapiens
AASQINRAY

SEQ ID NO: 168057 - protein, 9 aa, Homo Sapiens
AASSIQRVL

SEQ ID NO: 168058 - protein, 9 aa, Homo Sapiens
AASTAIYVY

SEQ ID NO: 168059 - protein, 9 aa, Homo Sapiens
AASTARHLY

SEQ ID NO: 168060 - protein, 9 aa, Homo Sapiens
AASTLVHKF

SEQ ID NO: 168061 - protein, 9 aa, Homo Sapiens
AASVSLHLL

SEQ ID NO: 168062 - protein, 9 aa, Homo Sapiens
AASWTSRQV

SEQ ID NO: 168063 - protein, 9 aa, Homo Sapiens
AASYVRKVI

SEQ ID NO: 168064 - protein, 9 aa, Homo Sapiens
AATAVTNLY

SEQ ID NO: 168065 - protein, 9 aa, Homo Sapiens
AATAVWHAY

SEQ ID NO: 168066 - protein, 9 aa, Homo Sapiens
AATDIARQV

SEQ ID NO: 168067 - protein, 9 aa, Homo Sapiens
AATDVRRVW

SEQ ID NO: 168068 - protein, 9 aa, Homo Sapiens
AATEKLLEY

SEQ ID NO: 168069 - protein, 9 aa, Homo Sapiens
AATFQRASY

SEQ ID NO: 168070 - protein, 9 aa, Homo Sapiens
AATFRGIGM

SEQ ID NO: 168071 - protein, 9 aa, Homo Sapiens
AATGFLKLL

SEQ ID NO: 168072 - protein, 9 aa, Homo Sapiens
AATLAGRLY

SEQ ID NO: 168073 - protein, 9 aa, Homo Sapiens
AATLATHEL

SEQ ID NO: 168074 - protein, 9 aa, Homo Sapiens
AATLFPRKM

SEQ ID NO: 168075 - protein, 9 aa, Homo Sapiens
AATLLHLEL

SEQ ID NO: 168076 - protein, 9 aa, Homo Sapiens
AATLTSKLY

SEQ ID NO: 168077 - protein, 9 aa, Homo Sapiens
AATPAVRTV

SEQ ID NO: 168078 - protein, 9 aa, Homo Sapiens
AATRWAKKI

SEQ ID NO: 168079 - protein, 9 aa, Homo Sapiens
AATSRIAEL

SEQ ID NO: 168080 - protein, 9 aa, Homo Sapiens
AATSRTYLY

SEQ ID NO: 168081 - protein, 9 aa, Homo Sapiens
AATTVLQEL

SEQ ID NO: 168082 - protein, 9 aa, Homo Sapiens
AATTVLRQL

SEQ ID NO: 168083 - protein, 9 aa, Homo Sapiens
AATVRPVTL

SEQ ID NO: 168084 - protein, 9 aa, Homo Sapiens
AAVAAHRFF

SEQ ID NO: 168085 - protein, 9 aa, Homo Sapiens
AAVAELPVL

SEQ ID NO: 168086 - protein, 9 aa, Homo Sapiens
AAVDLKPTL

SEQ ID NO: 168087 - protein, 9 aa, Homo Sapiens
AAVLRHISV

SEQ ID NO: 168088 - protein, 9 aa, Homo Sapiens
AAVLRNIKF

SEQ ID NO: 168089 - protein, 9 aa, Homo Sapiens
AAVLVLREL

SEQ ID NO: 168090 - protein, 9 aa, Homo Sapiens
AAVNRIHSF

SEQ ID NO: 168091 - protein, 9 aa, Homo Sapiens
AAVPLVRLF

SEQ ID NO: 168092 - protein, 9 aa, Homo Sapiens
AAVPLYRLY

SEQ ID NO: 168093 - protein, 9 aa, Homo Sapiens
AAVWKGHVM

SEQ ID NO: 168094 - protein, 9 aa, Homo Sapiens
AAVWPYRRL

SEQ ID NO: 168095 - protein, 9 aa, Homo Sapiens
AAWLQVLPV

SEQ ID NO: 168096 - protein, 9 aa, Homo Sapiens
AAYAGGLVL

SEQ ID NO: 168097 - protein, 9 aa, Homo Sapiens
AAYLRALSL

SEQ ID NO: 168098 - protein, 9 aa, Homo Sapiens
AAYLRIHAV

SEQ ID NO: 168099 - protein, 9 aa, Homo Sapiens
AAYPQVRCY

SEQ ID NO: 168100 - protein, 9 aa, Homo Sapiens
AFAEFLRTY

SEQ ID NO: 168101 - protein, 9 aa, Homo Sapiens
AFFSRVETF

SEQ ID NO: 168102 - protein, 9 aa, Homo Sapiens
AFFVREALF

SEQ ID NO: 168103 - protein, 9 aa, Homo Sapiens
AFQERLNSY

SEQ ID NO: 168104 - protein, 9 aa, Homo Sapiens
AFVYLRQPY

SEQ ID NO: 168105 - protein, 9 aa, Homo Sapiens
AFYDPTHAW

SEQ ID NO: 168106 - protein, 9 aa, Homo Sapiens
AGKEVFLVM

SEQ ID NO: 168107 - protein, 9 aa, Homo Sapiens
AGSALPRLY

SEQ ID NO: 168108 - protein, 9 aa, Homo Sapiens
AGSPFHPAM

SEQ ID NO: 168109 - protein, 9 aa, Homo Sapiens
AGYYRKYFY

SEQ ID NO: 168110 - protein, 9 aa, Homo Sapiens
AIADAKLSF

SEQ ID NO: 168111 - protein, 9 aa, Homo Sapiens
AISENYRIM

SEQ ID NO: 168112 - protein, 9 aa, Homo Sapiens
AISGFAYEY

SEQ ID NO: 168113 - protein, 9 aa, Homo Sapiens
ALALRFLAL

SEQ ID NO: 168114 - protein, 9 aa, Homo Sapiens
ALFFRFVDF

SEQ ID NO: 168115 - protein, 9 aa, Homo Sapiens
ALGVRDLSY

SEQ ID NO: 168116 - protein, 9 aa, Homo Sapiens
ALLLIRLPY

SEQ ID NO: 168117 - protein, 9 aa, Homo Sapiens
ALRPPLPPL

SEQ ID NO: 168118 - protein, 9 aa, Homo Sapiens
ALSFVQRTF

SEQ ID NO: 168119 - protein, 9 aa, Homo Sapiens
ALSPNHRIY

SEQ ID NO: 168120 - protein, 9 aa, Homo Sapiens
ALSVRPNDY

SEQ ID NO: 168121 - protein, 9 aa, Homo Sapiens
ALTEWLRFY

SEQ ID NO: 168122 - protein, 9 aa, Homo Sapiens
AMALRNKSF

SEQ ID NO: 168123 - protein, 9 aa, Homo Sapiens
AMAVRIQAY

SEQ ID NO: 168124 - protein, 9 aa, Homo Sapiens
AMMANRLSF

SEQ ID NO: 168125 - protein, 9 aa, Homo Sapiens
AMYSRKAMY

SEQ ID NO: 168126 - protein, 9 aa, Homo Sapiens
ANMFRFYAL

SEQ ID NO: 168127 - protein, 9 aa, Homo Sapiens
ANVVRNISY

SEQ ID NO: 168128 - protein, 9 aa, Homo Sapiens
AQHPLRPEF

SEQ ID NO: 168129 - protein, 9 aa, Homo Sapiens
AQSDIEHLF

SEQ ID NO: 168130 - protein, 9 aa, Homo Sapiens
AQTLRHYGY

SEQ ID NO: 168131 - protein, 9 aa, Homo Sapiens
ASAVTVRFY

SEQ ID NO: 168132 - protein, 9 aa, Homo Sapiens
ASFHRVQAL

SEQ ID NO: 168133 - protein, 9 aa, Homo Sapiens
ASFHRVWSF

SEQ ID NO: 168134 - protein, 9 aa, Homo Sapiens
ASLLRVEPF

SEQ ID NO: 168135 - protein, 9 aa, Homo Sapiens
ASNIMIVTL

SEQ ID NO: 168136 - protein, 9 aa, Homo Sapiens
ASSLAIREW

SEQ ID NO: 168137 - protein, 9 aa, Homo Sapiens
ASSLRLYLY

SEQ ID NO: 168138 - protein, 9 aa, Homo Sapiens
ASSPGHPAF

SEQ ID NO: 168139 - protein, 9 aa, Homo Sapiens
ASSPHGLVM

SEQ ID NO: 168140 - protein, 9 aa, Homo Sapiens
ASSPVLRQM

SEQ ID NO: 168141 - protein, 9 aa, Homo Sapiens
ASSSAFRLM

SEQ ID NO: 168142 - protein, 9 aa, Homo Sapiens
ASTLRVVVF

SEQ ID NO: 168143 - protein, 9 aa, Homo Sapiens
ASTPVAREL

SEQ ID NO: 168144 - protein, 9 aa, Homo Sapiens
ASTVRILEV

SEQ ID NO: 168145 - protein, 9 aa, Homo Sapiens
ASTVVTYVY

SEQ ID NO: 168146 - protein, 9 aa, Homo Sapiens
ASVLRSISL

SEQ ID NO: 168147 - protein, 9 aa, Homo Sapiens
ASYERLDVF

SEQ ID NO: 168148 - protein, 9 aa, Homo Sapiens
ASYLRLWAL

SEQ ID NO: 168149 - protein, 9 aa, Homo Sapiens
ATFVKEITY

SEQ ID NO: 168150 - protein, 9 aa, Homo Sapiens
ATMFPRREF

SEQ ID NO: 168151 - protein, 9 aa, Homo Sapiens
ATTDWIAIY

SEQ ID NO: 168152 - protein, 9 aa, Homo Sapiens
ATTLLHKVF

SEQ ID NO: 168153 - protein, 9 aa, Homo Sapiens
ATTLRLSAY

SEQ ID NO: 168154 - protein, 9 aa, Homo Sapiens
AVAERLWEY

SEQ ID NO: 168155 - protein, 9 aa, Homo Sapiens
AVLLRFWAF

SEQ ID NO: 168156 - protein, 9 aa, Homo Sapiens
AVSAVVHEY

SEQ ID NO: 168157 - protein, 9 aa, Homo Sapiens
AVSNVFKIL

SEQ ID NO: 168158 - protein, 9 aa, Homo Sapiens
AVSPIAKYY

SEQ ID NO: 168159 - protein, 9 aa, Homo Sapiens
AVSSWFRQL

SEQ ID NO: 168160 - protein, 9 aa, Homo Sapiens
AVSYRQVAF

SEQ ID NO: 168161 - protein, 9 aa, Homo Sapiens
AVTASIHVY

SEQ ID NO: 168162 - protein, 9 aa, Homo Sapiens
AVTHIGRVY

SEQ ID NO: 168163 - protein, 9 aa, Homo Sapiens
AWMDNIREW

SEQ ID NO: 168164 - protein, 9 aa, Homo Sapiens
CAADFPWEL

SEQ ID NO: 168165 - protein, 9 aa, Homo Sapiens
CAFDRGLEM

SEQ ID NO: 168166 - protein, 9 aa, Homo Sapiens
CAHSFFDEL

SEQ ID NO: 168167 - protein, 9 aa, Homo Sapiens
CAIAQAESL

SEQ ID NO: 168168 - protein, 9 aa, Homo Sapiens
CAIPDLGPA

SEQ ID NO: 168169 - protein, 9 aa, Homo Sapiens
CAKQDWLIL

SEQ ID NO: 168170 - protein, 9 aa, Homo Sapiens
CALDFFRQI

SEQ ID NO: 168171 - protein, 9 aa, Homo Sapiens
CAQDAFFQV

SEQ ID NO: 168172 - protein, 9 aa, Homo Sapiens
CASDKILEF

SEQ ID NO: 168173 - protein, 9 aa, Homo Sapiens
CASLFLRLL

SEQ ID NO: 168174 - protein, 9 aa, Homo Sapiens
CATKLFKKY

SEQ ID NO: 168175 - protein, 9 aa, Homo Sapiens
CATPEWRHF

SEQ ID NO: 168176 - protein, 9 aa, Homo Sapiens
CGALKNISF

SEQ ID NO: 168177 - protein, 9 aa, Homo Sapiens
CGTISLRVY

SEQ ID NO: 168178 - protein, 9 aa, Homo Sapiens
CLADIFRIY

SEQ ID NO: 168179 - protein, 9 aa, Homo Sapiens
CSNIRDSSF

SEQ ID NO: 168180 - protein, 9 aa, Homo Sapiens
CSSDFIRIL

SEQ ID NO: 168181 - protein, 9 aa, Homo Sapiens
CSSPHALVL

SEQ ID NO: 168182 - protein, 9 aa, Homo Sapiens
CTAIREVSL

SEQ ID NO: 168183 - protein, 9 aa, Homo Sapiens
CTTPHLHSI

SEQ ID NO: 168184 - protein, 9 aa, Homo Sapiens
DAFERIDSF

SEQ ID NO: 168185 - protein, 9 aa, Homo Sapiens
DAKIRIFDL

SEQ ID NO: 168186 - protein, 9 aa, Homo Sapiens
DFSIRTYTY

SEQ ID NO: 168187 - protein, 9 aa, Homo Sapiens
DWFERPDSF

SEQ ID NO: 168188 - protein, 9 aa, Homo Sapiens
DYSVVLLLR

SEQ ID NO: 168189 - protein, 9 aa, Homo Sapiens
EASWRFTFY

SEQ ID NO: 168190 - protein, 9 aa, Homo Sapiens
EATDYLRNL

SEQ ID NO: 168191 - protein, 9 aa, Homo Sapiens
EATSFIKQI

SEQ ID NO: 168192 - protein, 9 aa, Homo Sapiens
ELALRLTEY

SEQ ID NO: 168193 - protein, 9 aa, Homo Sapiens
ELYQRIYAF

SEQ ID NO: 168194 - protein, 9 aa, Homo Sapiens
EMMELREAF

SEQ ID NO: 168195 - protein, 9 aa, Homo Sapiens
ESQLRSYSF

SEQ ID NO: 168196 - protein, 9 aa, Homo Sapiens
ESTVRTIAM

SEQ ID NO: 168197 - protein, 9 aa, Homo Sapiens
ESYLRRVVY

SEQ ID NO: 168198 - protein, 9 aa, Homo Sapiens
ETFQRPYQY

SEQ ID NO: 168199 - protein, 9 aa, Homo Sapiens
FAAAKLLAL

SEQ ID NO: 168200 - protein, 9 aa, Homo Sapiens
FAAASREVL

SEQ ID NO: 168201 - protein, 9 aa, Homo Sapiens
FAADIISVL

SEQ ID NO: 168202 - protein, 9 aa, Homo Sapiens
FAADIPRIL

SEQ ID NO: 168203 - protein, 9 aa, Homo Sapiens
FAADVRLMF

SEQ ID NO: 168204 - protein, 9 aa, Homo Sapiens
FAAFFSHIL

SEQ ID NO: 168205 - protein, 9 aa, Homo Sapiens
FAAFFTRAF

SEQ ID NO: 168206 - protein, 9 aa, Homo Sapiens
FAAHLRCTY

SEQ ID NO: 168207 - protein, 9 aa, Homo Sapiens
FAALEKTYY

SEQ ID NO: 168208 - protein, 9 aa, Homo Sapiens
FAALHGPAL

SEQ ID NO: 168209 - protein, 9 aa, Homo Sapiens
FAALIARTA

SEQ ID NO: 168210 - protein, 9 aa, Homo Sapiens
FAALQLEYF

SEQ ID NO: 168211 - protein, 9 aa, Homo Sapiens
FAAQRGLAV

SEQ ID NO: 168212 - protein, 9 aa, Homo Sapiens
FAASFAHLL

SEQ ID NO: 168213 - protein, 9 aa, Homo Sapiens
FAASGGFLH

SEQ ID NO: 168214 - protein, 9 aa, Homo Sapiens
FAASVAHLY

SEQ ID NO: 168215 - protein, 9 aa, Homo Sapiens
FAATHSLEF

SEQ ID NO: 168216 - protein, 9 aa, Homo Sapiens
FAAVAAAAY

SEQ ID NO: 168217 - protein, 9 aa, Homo Sapiens
FAAYWKPVL

SEQ ID NO: 168218 - protein, 9 aa, Homo Sapiens
FADGFVLVY

SEQ ID NO: 168219 - protein, 9 aa, Homo Sapiens
FADGHVLEL

SEQ ID NO: 168220 - protein, 9 aa, Homo Sapiens
FADPFAFIH

SEQ ID NO: 168221 - protein, 9 aa, Homo Sapiens
FADPHGKVF

SEQ ID NO: 168222 - protein, 9 aa, Homo Sapiens
FAEDSLRVI

SEQ ID NO: 168223 - protein, 9 aa, Homo Sapiens
FAEPGRVPF

SEQ ID NO: 168224 - protein, 9 aa, Homo Sapiens
FAFCYPFSY

SEQ ID NO: 168225 - protein, 9 aa, Homo Sapiens
FAFDPSVNY

SEQ ID NO: 168226 - protein, 9 aa, Homo Sapiens
FAFDSPHHY

SEQ ID NO: 168227 - protein, 9 aa, Homo Sapiens
FAFEHSEEY

SEQ ID NO: 168228 - protein, 9 aa, Homo Sapiens
FAFFDPVMY

SEQ ID NO: 168229 - protein, 9 aa, Homo Sapiens
FAFLRFVVY

SEQ ID NO: 168230 - protein, 9 aa, Homo Sapiens
FAFTPSRIY

SEQ ID NO: 168231 - protein, 9 aa, Homo Sapiens
FAFVTDNTY

SEQ ID NO: 168232 - protein, 9 aa, Homo Sapiens
FAGFLPRII

SEQ ID NO: 168233 - protein, 9 aa, Homo Sapiens
FAGFQRKAV

SEQ ID NO: 168234 - protein, 9 aa, Homo Sapiens
FAGLVPRLL

SEQ ID NO: 168235 - protein, 9 aa, Homo Sapiens
FAGNFERTV

SEQ ID NO: 168236 - protein, 9 aa, Homo Sapiens
FAHDSTRVI

SEQ ID NO: 168237 - protein, 9 aa, Homo Sapiens
FAHLRLEVL

SEQ ID NO: 168238 - protein, 9 aa, Homo Sapiens
FAHPPLLVL

SEQ ID NO: 168239 - protein, 9 aa, Homo Sapiens
FAHPYQYEL

SEQ ID NO: 168240 - protein, 9 aa, Homo Sapiens
FAIDPHLLL

SEQ ID NO: 168241 - protein, 9 aa, Homo Sapiens
FAIEREFFF

SEQ ID NO: 168242 - protein, 9 aa, Homo Sapiens
FAIFKVTAY

SEQ ID NO: 168243 - protein, 9 aa, Homo Sapiens
FAIKSLRKL

SEQ ID NO: 168244 - protein, 9 aa, Homo Sapiens
FAILRQAEL

SEQ ID NO: 168245 - protein, 9 aa, Homo Sapiens
FAIPLIEKL

SEQ ID NO: 168246 - protein, 9 aa, Homo Sapiens
FAIPMIHAV

SEQ ID NO: 168247 - protein, 9 aa, Homo Sapiens
FAIQKGLQA

SEQ ID NO: 168248 - protein, 9 aa, Homo Sapiens
FAISILQQI

SEQ ID NO: 168249 - protein, 9 aa, Homo Sapiens
FAKATFDAI

SEQ ID NO: 168250 - protein, 9 aa, Homo Sapiens
FAKDFMTYL

SEQ ID NO: 168251 - protein, 9 aa, Homo Sapiens
FAKEHQEFL

SEQ ID NO: 168252 - protein, 9 aa, Homo Sapiens
FAKFHPNLV

SEQ ID NO: 168253 - protein, 9 aa, Homo Sapiens
FAKMVVDAV

SEQ ID NO: 168254 - protein, 9 aa, Homo Sapiens
FAKPENIDL

SEQ ID NO: 168255 - protein, 9 aa, Homo Sapiens
FAKPFLASL

SEQ ID NO: 168256 - protein, 9 aa, Homo Sapiens
FAKVHILYV

SEQ ID NO: 168257 - protein, 9 aa, Homo Sapiens
FAKYWHIIL

SEQ ID NO: 168258 - protein, 9 aa, Homo Sapiens
FALAMKDTL

SEQ ID NO: 168259 - protein, 9 aa, Homo Sapiens
FALDMKYAL

SEQ ID NO: 168260 - protein, 9 aa, Homo Sapiens
FALDSGLEI

SEQ ID NO: 168261 - protein, 9 aa, Homo Sapiens
FALGSPIAM

SEQ ID NO: 168262 - protein, 9 aa, Homo Sapiens
FALGVYRTL

SEQ ID NO: 168263 - protein, 9 aa, Homo Sapiens
FALHKTLEF

SEQ ID NO: 168264 - protein, 9 aa, Homo Sapiens
FALLPRLEY

SEQ ID NO: 168265 - protein, 9 aa, Homo Sapiens
FALLTTPEM

SEQ ID NO: 168266 - protein, 9 aa, Homo Sapiens
FALPFGRTA

SEQ ID NO: 168267 - protein, 9 aa, Homo Sapiens
FALPSPQHI

SEQ ID NO: 168268 - protein, 9 aa, Homo Sapiens
FALPVGLIV

SEQ ID NO: 168269 - protein, 9 aa, Homo Sapiens
FALPYIRDV

SEQ ID NO: 168270 - protein, 9 aa, Homo Sapiens
FALPYVIVL

SEQ ID NO: 168271 - protein, 9 aa, Homo Sapiens
FALSQPRAM

SEQ ID NO: 168272 - protein, 9 aa, Homo Sapiens
FALTKVQQY

SEQ ID NO: 168273 - protein, 9 aa, Homo Sapiens
FALVRTIRY

SEQ ID NO: 168274 - protein, 9 aa, Homo Sapiens
FAMAGHENL

SEQ ID NO: 168275 - protein, 9 aa, Homo Sapiens
FAMDVYKNL

SEQ ID NO: 168276 - protein, 9 aa, Homo Sapiens
FAMEFVKYY

SEQ ID NO: 168277 - protein, 9 aa, Homo Sapiens
FAMEIDPSL

SEQ ID NO: 168278 - protein, 9 aa, Homo Sapiens
FAMPPPHGM

SEQ ID NO: 168279 - protein, 9 aa, Homo Sapiens
FAMPSSTPL

SEQ ID NO: 168280 - protein, 9 aa, Homo Sapiens
FAMPYFIQV

SEQ ID NO: 168281 - protein, 9 aa, Homo Sapiens
FAMQLVKIL

SEQ ID NO: 168282 - protein, 9 aa, Homo Sapiens
FAMSYVKLM

SEQ ID NO: 168283 - protein, 9 aa, Homo Sapiens
FAMVKGYFF

SEQ ID NO: 168284 - protein, 9 aa, Homo Sapiens
FAMYPPSMI

SEQ ID NO: 168285 - protein, 9 aa, Homo Sapiens
FANDATFEI

SEQ ID NO: 168286 - protein, 9 aa, Homo Sapiens
FANERCLQL

SEQ ID NO: 168287 - protein, 9 aa, Homo Sapiens
FANFANFSK

SEQ ID NO: 168288 - protein, 9 aa, Homo Sapiens
FANLKYVSL

SEQ ID NO: 168289 - protein, 9 aa, Homo Sapiens
FANLPNQVY

SEQ ID NO: 168290 - protein, 9 aa, Homo Sapiens
FANNVQLSL

SEQ ID NO: 168291 - protein, 9 aa, Homo Sapiens
FANSRDTSF

SEQ ID NO: 168292 - protein, 9 aa, Homo Sapiens
FANTRIENF

SEQ ID NO: 168293 - protein, 9 aa, Homo Sapiens
FANTRLQSV

SEQ ID NO: 168294 - protein, 9 aa, Homo Sapiens
FAPEKLQEL

SEQ ID NO: 168295 - protein, 9 aa, Homo Sapiens
FAPIQPLAM

SEQ ID NO: 168296 - protein, 9 aa, Homo Sapiens
FAQAPQLSV

SEQ ID NO: 168297 - protein, 9 aa, Homo Sapiens
FAQDVGRMF

SEQ ID NO: 168298 - protein, 9 aa, Homo Sapiens
FAQEAISVL

SEQ ID NO: 168299 - protein, 9 aa, Homo Sapiens
FAQEALTVL

SEQ ID NO: 168300 - protein, 9 aa, Homo Sapiens
FAQERRWKV

SEQ ID NO: 168301 - protein, 9 aa, Homo Sapiens
FAQIVLPAL

SEQ ID NO: 168302 - protein, 9 aa, Homo Sapiens
FAQKISRTV

SEQ ID NO: 168303 - protein, 9 aa, Homo Sapiens
FAQMYQKTL

SEQ ID NO: 168304 - protein, 9 aa, Homo Sapiens
FAQNKPTGF

SEQ ID NO: 168305 - protein, 9 aa, Homo Sapiens
FAQPGSFEY

SEQ ID NO: 168306 - protein, 9 aa, Homo Sapiens
FAQPGTFEF

SEQ ID NO: 168307 - protein, 9 aa, Homo Sapiens
FAQTLHPSL

SEQ ID NO: 168308 - protein, 9 aa, Homo Sapiens
FAQVFHLIL

SEQ ID NO: 168309 - protein, 9 aa, Homo Sapiens
FAQYLISEL

SEQ ID NO: 168310 - protein, 9 aa, Homo Sapiens
FAREALRAL

SEQ ID NO: 168311 - protein, 9 aa, Homo Sapiens
FARELANQL

SEQ ID NO: 168312 - protein, 9 aa, Homo Sapiens
FARFLNYQL

SEQ ID NO: 168313 - protein, 9 aa, Homo Sapiens
FARMCSLML

SEQ ID NO: 168314 - protein, 9 aa, Homo Sapiens
FARMKPRKI

SEQ ID NO: 168315 - protein, 9 aa, Homo Sapiens
FARPASPSL

SEQ ID NO: 168316 - protein, 9 aa, Homo Sapiens
FARQYYEML

SEQ ID NO: 168317 - protein, 9 aa, Homo Sapiens
FARSFHPML

SEQ ID NO: 168318 - protein, 9 aa, Homo Sapiens
FARSFTLML

SEQ ID NO: 168319 - protein, 9 aa, Homo Sapiens
FARSSYLVM

SEQ ID NO: 168320 - protein, 9 aa, Homo Sapiens
FARVGGRLF

SEQ ID NO: 168321 - protein, 9 aa, Homo Sapiens
FARWLFIGL

SEQ ID NO: 168322 - protein, 9 aa, Homo Sapiens
FASDVQFVL

SEQ ID NO: 168323 - protein, 9 aa, Homo Sapiens
FASEKKWAF

SEQ ID NO: 168324 - protein, 9 aa, Homo Sapiens
FASELSRSL

SEQ ID NO: 168325 - protein, 9 aa, Homo Sapiens
FASEVSNVL

SEQ ID NO: 168326 - protein, 9 aa, Homo Sapiens
FASEYPLIL

SEQ ID NO: 168327 - protein, 9 aa, Homo Sapiens
FASFIVQYY

SEQ ID NO: 168328 - protein, 9 aa, Homo Sapiens
FASFKPTYL

SEQ ID NO: 168329 - protein, 9 aa, Homo Sapiens
FASFPHMVL

SEQ ID NO: 168330 - protein, 9 aa, Homo Sapiens
FASFSDYYY

SEQ ID NO: 168331 - protein, 9 aa, Homo Sapiens
FASGANFEY

SEQ ID NO: 168332 - protein, 9 aa, Homo Sapiens
FASGLIHRV

SEQ ID NO: 168333 - protein, 9 aa, Homo Sapiens
FASHVSPEV

SEQ ID NO: 168334 - protein, 9 aa, Homo Sapiens
FASIAPSIY

SEQ ID NO: 168335 - protein, 9 aa, Homo Sapiens
FASIPGLEF

SEQ ID NO: 168336 - protein, 9 aa, Homo Sapiens
FASLPQVER

SEQ ID NO: 168337 - protein, 9 aa, Homo Sapiens
FASLVSQDY

SEQ ID NO: 168338 - protein, 9 aa, Homo Sapiens
FASSPLRVL

SEQ ID NO: 168339 - protein, 9 aa, Homo Sapiens
FASTILHLV

SEQ ID NO: 168340 - protein, 9 aa, Homo Sapiens
FASTMVHAL

SEQ ID NO: 168341 - protein, 9 aa, Homo Sapiens
FASTYLLLL

SEQ ID NO: 168342 - protein, 9 aa, Homo Sapiens
FASVFEKYF

SEQ ID NO: 168343 - protein, 9 aa, Homo Sapiens
FASVHSVSA

SEQ ID NO: 168344 - protein, 9 aa, Homo Sapiens
FASVLIRRI

SEQ ID NO: 168345 - protein, 9 aa, Homo Sapiens
FATDAILAT

SEQ ID NO: 168346 - protein, 9 aa, Homo Sapiens
FATDSGLEF

SEQ ID NO: 168347 - protein, 9 aa, Homo Sapiens
FATEGLRTL

SEQ ID NO: 168348 - protein, 9 aa, Homo Sapiens
FATESSHFY

SEQ ID NO: 168349 - protein, 9 aa, Homo Sapiens
FATEVFKAM

SEQ ID NO: 168350 - protein, 9 aa, Homo Sapiens
FATFLSHVL

SEQ ID NO: 168351 - protein, 9 aa, Homo Sapiens
FATGVWHQM

SEQ ID NO: 168352 - protein, 9 aa, Homo Sapiens
FATIKSASL

SEQ ID NO: 168353 - protein, 9 aa, Homo Sapiens
FATIKTVNY

SEQ ID NO: 168354 - protein, 9 aa, Homo Sapiens
FATIRFHDL

SEQ ID NO: 168355 - protein, 9 aa, Homo Sapiens
FATIRTASL

SEQ ID NO: 168356 - protein, 9 aa, Homo Sapiens
FATKVVHLL

SEQ ID NO: 168357 - protein, 9 aa, Homo Sapiens
FATLRWIDY

SEQ ID NO: 168358 - protein, 9 aa, Homo Sapiens
FATPFLVVR

SEQ ID NO: 168359 - protein, 9 aa, Homo Sapiens
FATPQYRGV

SEQ ID NO: 168360 - protein, 9 aa, Homo Sapiens
FATPVFITK

SEQ ID NO: 168361 - protein, 9 aa, Homo Sapiens
FATPYGYAM

SEQ ID NO: 168362 - protein, 9 aa, Homo Sapiens
FATRFDQVM

SEQ ID NO: 168363 - protein, 9 aa, Homo Sapiens
FATRRWIEY

SEQ ID NO: 168364 - protein, 9 aa, Homo Sapiens
FATSALRSL

SEQ ID NO: 168365 - protein, 9 aa, Homo Sapiens
FATSVLRWI

SEQ ID NO: 168366 - protein, 9 aa, Homo Sapiens
FATVRWIDY

SEQ ID NO: 168367 - protein, 9 aa, Homo Sapiens
FAVAMHLVY

SEQ ID NO: 168368 - protein, 9 aa, Homo Sapiens
FAVDFEKIY

SEQ ID NO: 168369 - protein, 9 aa, Homo Sapiens
FAVDSLRQL

SEQ ID NO: 168370 - protein, 9 aa, Homo Sapiens
FAVGSFHTL

SEQ ID NO: 168371 - protein, 9 aa, Homo Sapiens
FAVGSSRFW

SEQ ID NO: 168372 - protein, 9 aa, Homo Sapiens
FAVIAHVGM

SEQ ID NO: 168373 - protein, 9 aa, Homo Sapiens
FAVISRHSL

SEQ ID NO: 168374 - protein, 9 aa, Homo Sapiens
FAVNKKIEF

SEQ ID NO: 168375 - protein, 9 aa, Homo Sapiens
FAVNMFRTL

SEQ ID NO: 168376 - protein, 9 aa, Homo Sapiens
FAYEGPMYL

SEQ ID NO: 168377 - protein, 9 aa, Homo Sapiens
FAYHMIETY

SEQ ID NO: 168378 - protein, 9 aa, Homo Sapiens
FAYHYPYTY

SEQ ID NO: 168379 - protein, 9 aa, Homo Sapiens
FAYLGRLAH

SEQ ID NO: 168380 - protein, 9 aa, Homo Sapiens
FAYLRDLLI

SEQ ID NO: 168381 - protein, 9 aa, Homo Sapiens
FAYPAIRYL

SEQ ID NO: 168382 - protein, 9 aa, Homo Sapiens
FAYPAPLEV

SEQ ID NO: 168383 - protein, 9 aa, Homo Sapiens
FAYTARISV

SEQ ID NO: 168384 - protein, 9 aa, Homo Sapiens
FAYTSRHEI

SEQ ID NO: 168385 - protein, 9 aa, Homo Sapiens
FAYVEGESL

SEQ ID NO: 168386 - protein, 9 aa, Homo Sapiens
FAYYRDLVF

SEQ ID NO: 168387 - protein, 9 aa, Homo Sapiens
FAYYRVGEY

SEQ ID NO: 168388 - protein, 9 aa, Homo Sapiens
FCGLRGNEF

SEQ ID NO: 168389 - protein, 9 aa, Homo Sapiens
FCIQVGRTM

SEQ ID NO: 168390 - protein, 9 aa, Homo Sapiens
FCYVNDIVI

SEQ ID NO: 168391 - protein, 9 aa, Homo Sapiens
FFAERYESW

SEQ ID NO: 168392 - protein, 9 aa, Homo Sapiens
FFAPSRDMY

SEQ ID NO: 168393 - protein, 9 aa, Homo Sapiens
FFGIRDSSF

SEQ ID NO: 168394 - protein, 9 aa, Homo Sapiens
FFGTHETAF

SEQ ID NO: 168395 - protein, 9 aa, Homo Sapiens
FFIAGRYEF

SEQ ID NO: 168396 - protein, 9 aa, Homo Sapiens
FFKDRHWLF

SEQ ID NO: 168397 - protein, 9 aa, Homo Sapiens
FFKERVMEI

SEQ ID NO: 168398 - protein, 9 aa, Homo Sapiens
FFLARPTTF

SEQ ID NO: 168399 - protein, 9 aa, Homo Sapiens
FFMEKRAKY

SEQ ID NO: 168400 - protein, 9 aa, Homo Sapiens
FFMERSWSV

SEQ ID NO: 168401 - protein, 9 aa, Homo Sapiens
FFMLRSLSL

SEQ ID NO: 168402 - protein, 9 aa, Homo Sapiens
FFNGLRTEL

SEQ ID NO: 168403 - protein, 9 aa, Homo Sapiens
FFNNRIIAI

SEQ ID NO: 168404 - protein, 9 aa, Homo Sapiens
FFQDKARFY

SEQ ID NO: 168405 - protein, 9 aa, Homo Sapiens
FFQETNIPY

SEQ ID NO: 168406 - protein, 9 aa, Homo Sapiens
FFSEREASF

SEQ ID NO: 168407 - protein, 9 aa, Homo Sapiens
FFVNRPDSY

SEQ ID NO: 168408 - protein, 9 aa, Homo Sapiens
FFYQRLVEF

SEQ ID NO: 168409 - protein, 9 aa, Homo Sapiens
FGAVQVTPL

SEQ ID NO: 168410 - protein, 9 aa, Homo Sapiens
FGEVRPYFY

SEQ ID NO: 168411 - protein, 9 aa, Homo Sapiens
FGFHKPKMY

SEQ ID NO: 168412 - protein, 9 aa, Homo Sapiens
FGFVRFTEY

SEQ ID NO: 168413 - protein, 9 aa, Homo Sapiens
FGIYRFLPF

SEQ ID NO: 168414 - protein, 9 aa, Homo Sapiens
FGKDYLLEM

SEQ ID NO: 168415 - protein, 9 aa, Homo Sapiens
FGKGYFLEI

SEQ ID NO: 168416 - protein, 9 aa, Homo Sapiens
FGKPYFIKL

SEQ ID NO: 168417 - protein, 9 aa, Homo Sapiens
FGLARAFSL

SEQ ID NO: 168418 - protein, 9 aa, Homo Sapiens
FGLARIYSF

SEQ ID NO: 168419 - protein, 9 aa, Homo Sapiens
FGLARIYSY

SEQ ID NO: 168420 - protein, 9 aa, Homo Sapiens
FGMDDREIM

SEQ ID NO: 168421 - protein, 9 aa, Homo Sapiens
FGNNKLTTF

SEQ ID NO: 168422 - protein, 9 aa, Homo Sapiens
FGQLRDFYF

SEQ ID NO: 168423 - protein, 9 aa, Homo Sapiens
FGSEVIKVY

SEQ ID NO: 168424 - protein, 9 aa, Homo Sapiens
FGSLPKVAL

SEQ ID NO: 168425 - protein, 9 aa, Homo Sapiens
FGSNIAHMY

SEQ ID NO: 168426 - protein, 9 aa, Homo Sapiens
FGTEHVLRI

SEQ ID NO: 168427 - protein, 9 aa, Homo Sapiens
FGTGFPHML

SEQ ID NO: 168428 - protein, 9 aa, Homo Sapiens
FGTIRTIDY

SEQ ID NO: 168429 - protein, 9 aa, Homo Sapiens
FGTSHPRYY

SEQ ID NO: 168430 - protein, 9 aa, Homo Sapiens
FIAPNKYEY

SEQ ID NO: 168431 - protein, 9 aa, Homo Sapiens
FIFLRLNVL

SEQ ID NO: 168432 - protein, 9 aa, Homo Sapiens
FIISRTQAL

SEQ ID NO: 168433 - protein, 9 aa, Homo Sapiens
FIKEIPPEL

SEQ ID NO: 168434 - protein, 9 aa, Homo Sapiens
FIMDRAQAL

SEQ ID NO: 168435 - protein, 9 aa, Homo Sapiens
FIMGKTIEF

SEQ ID NO: 168436 - protein, 9 aa, Homo Sapiens
FIMINPLEY

SEQ ID NO: 168437 - protein, 9 aa, Homo Sapiens
FINQNLRTY

SEQ ID NO: 168438 - protein, 9 aa, Homo Sapiens
FIQTRGGTF

SEQ ID NO: 168439 - protein, 9 aa, Homo Sapiens
FIRKVFLVL

SEQ ID NO: 168440 - protein, 9 aa, Homo Sapiens
FIRPFMLLL

SEQ ID NO: 168441 - protein, 9 aa, Homo Sapiens
FISIPKMEV

SEQ ID NO: 168442 - protein, 9 aa, Homo Sapiens
FISSTFRDM

SEQ ID NO: 168443 - protein, 9 aa, Homo Sapiens
FITGLIRIM

SEQ ID NO: 168444 - protein, 9 aa, Homo Sapiens
FITPIVKVS

SEQ ID NO: 168445 - protein, 9 aa, Homo Sapiens
FITYVEHVL

SEQ ID NO: 168446 - protein, 9 aa, Homo Sapiens
FIVDARPAM

SEQ ID NO: 168447 - protein, 9 aa, Homo Sapiens
FIVEETLPL

SEQ ID NO: 168448 - protein, 9 aa, Homo Sapiens
FIYHLPQEF

SEQ ID NO: 168449 - protein, 9 aa, Homo Sapiens
FLAKSRPEL

SEQ ID NO: 168450 - protein, 9 aa, Homo Sapiens
FLANVRKAF

SEQ ID NO: 168451 - protein, 9 aa, Homo Sapiens
FLCPFHLSV

SEQ ID NO: 168452 - protein, 9 aa, Homo Sapiens
FLGERVFPF

SEQ ID NO: 168453 - protein, 9 aa, Homo Sapiens
FLGIRFAEY

SEQ ID NO: 168454 - protein, 9 aa, Homo Sapiens
FLGPLHPSF

SEQ ID NO: 168455 - protein, 9 aa, Homo Sapiens
FLIEPFVPH

SEQ ID NO: 168456 - protein, 9 aa, Homo Sapiens
FLPEAPAEL

SEQ ID NO: 168457 - protein, 9 aa, Homo Sapiens
FLQQPRPLM

SEQ ID NO: 168458 - protein, 9 aa, Homo Sapiens
FLREWVESM

SEQ ID NO: 168459 - protein, 9 aa, Homo Sapiens
FLSIGARYY

SEQ ID NO: 168460 - protein, 9 aa, Homo Sapiens
FLSPLFRFY

SEQ ID NO: 168461 - protein, 9 aa, Homo Sapiens
FLTELTRLF

SEQ ID NO: 168462 - protein, 9 aa, Homo Sapiens
FLTVTRLYF

SEQ ID NO: 168463 - protein, 9 aa, Homo Sapiens
FLVLRQQQF

SEQ ID NO: 168464 - protein, 9 aa, Homo Sapiens
FLYGRLYEF

SEQ ID NO: 168465 - protein, 9 aa, Homo Sapiens
FLYPFFGVL

SEQ ID NO: 168466 - protein, 9 aa, Homo Sapiens
FLYPFPLAL

SEQ ID NO: 168467 - protein, 9 aa, Homo Sapiens
FMMMRAENF

SEQ ID NO: 168468 - protein, 9 aa, Homo Sapiens
FNFLRNVSL

SEQ ID NO: 168469 - protein, 9 aa, Homo Sapiens
FNHILPYFY

SEQ ID NO: 168470 - protein, 9 aa, Homo Sapiens
FNITRIVTF

SEQ ID NO: 168471 - protein, 9 aa, Homo Sapiens
FNSVRLWDF

SEQ ID NO: 168472 - protein, 9 aa, Homo Sapiens
FNYQKRVSF

SEQ ID NO: 168473 - protein, 9 aa, Homo Sapiens
FQAFLRTEF

SEQ ID NO: 168474 - protein, 9 aa, Homo Sapiens
FQAPTAKEM

SEQ ID NO: 168475 - protein, 9 aa, Homo Sapiens
FQGFRLVPF

SEQ ID NO: 168476 - protein, 9 aa, Homo Sapiens
FQNDFLRLL

SEQ ID NO: 168477 - protein, 9 aa, Homo Sapiens
FQNPFRSEL

SEQ ID NO: 168478 - protein, 9 aa, Homo Sapiens
FQRDYYDRM

SEQ ID NO: 168479 - protein, 9 aa, Homo Sapiens
FQREFALRL

SEQ ID NO: 168480 - protein, 9 aa, Homo Sapiens
FQRPNALAV

SEQ ID NO: 168481 - protein, 9 aa, Homo Sapiens
FQRQFVLTL

SEQ ID NO: 168482 - protein, 9 aa, Homo Sapiens
FQSQFERLV

SEQ ID NO: 168483 - protein, 9 aa, Homo Sapiens
FQTIARNAL

SEQ ID NO: 168484 - protein, 9 aa, Homo Sapiens
FQTSRYKLH

SEQ ID NO: 168485 - protein, 9 aa, Homo Sapiens
FQTVTDYGK

SEQ ID NO: 168486 - protein, 9 aa, Homo Sapiens
FSAEFLKVF

SEQ ID NO: 168487 - protein, 9 aa, Homo Sapiens
FSAFLEKEY

SEQ ID NO: 168488 - protein, 9 aa, Homo Sapiens
FSAGEPRVL

SEQ ID NO: 168489 - protein, 9 aa, Homo Sapiens
FSALITRIF

SEQ ID NO: 168490 - protein, 9 aa, Homo Sapiens
FSAMFEHEM

SEQ ID NO: 168491 - protein, 9 aa, Homo Sapiens
FSAPRHGSL

SEQ ID NO: 168492 - protein, 9 aa, Homo Sapiens
FSATFPKEI

SEQ ID NO: 168493 - protein, 9 aa, Homo Sapiens
FSATFPRAM

SEQ ID NO: 168494 - protein, 9 aa, Homo Sapiens
FSAVMVRLM

SEQ ID NO: 168495 - protein, 9 aa, Homo Sapiens
FSAYNYRTY

SEQ ID NO: 168496 - protein, 9 aa, Homo Sapiens
FSEPFHLIV

SEQ ID NO: 168497 - protein, 9 aa, Homo Sapiens
FSEPHARFY

SEQ ID NO: 168498 - protein, 9 aa, Homo Sapiens
FSESHLVII

SEQ ID NO: 168499 - protein, 9 aa, Homo Sapiens
FSFHHVLSL

SEQ ID NO: 168500 - protein, 9 aa, Homo Sapiens
FSFVRITAL

SEQ ID NO: 168501 - protein, 9 aa, Homo Sapiens
FSFVRVISL

SEQ ID NO: 168502 - protein, 9 aa, Homo Sapiens
FSFYFHEAL

SEQ ID NO: 168503 - protein, 9 aa, Homo Sapiens
FSGIRNISF

SEQ ID NO: 168504 - protein, 9 aa, Homo Sapiens
FSHAQTVVL

SEQ ID NO: 168505 - protein, 9 aa, Homo Sapiens
FSHFYIISV

SEQ ID NO: 168506 - protein, 9 aa, Homo Sapiens
FSIEKRFAY

SEQ ID NO: 168507 - protein, 9 aa, Homo Sapiens
FSIEPWLKV

SEQ ID NO: 168508 - protein, 9 aa, Homo Sapiens
FSIPDSLLI

SEQ ID NO: 168509 - protein, 9 aa, Homo Sapiens
FSKDWSFYL

SEQ ID NO: 168510 - protein, 9 aa, Homo Sapiens
FSKPPNPAL

SEQ ID NO: 168511 - protein, 9 aa, Homo Sapiens
FSLAPYRDY

SEQ ID NO: 168512 - protein, 9 aa, Homo Sapiens
FSLVNQIYY

SEQ ID NO: 168513 - protein, 9 aa, Homo Sapiens
FSMYKPITY

SEQ ID NO: 168514 - protein, 9 aa, Homo Sapiens
FSNDALKTY

SEQ ID NO: 168515 - protein, 9 aa, Homo Sapiens
FSNDIPHVV

SEQ ID NO: 168516 - protein, 9 aa, Homo Sapiens
FSNFWYHSY

SEQ ID NO: 168517 - protein, 9 aa, Homo Sapiens
FSNGHIKVL

SEQ ID NO: 168518 - protein, 9 aa, Homo Sapiens
FSNITGIDY

SEQ ID NO: 168519 - protein, 9 aa, Homo Sapiens
FSNPFFVNY

SEQ ID NO: 168520 - protein, 9 aa, Homo Sapiens
FSNPNIQKI

SEQ ID NO: 168521 - protein, 9 aa, Homo Sapiens
FSNPRALYL

SEQ ID NO: 168522 - protein, 9 aa, Homo Sapiens
FSNPYSIEY

SEQ ID NO: 168523 - protein, 9 aa, Homo Sapiens
FSNWGHPEY

SEQ ID NO: 168524 - protein, 9 aa, Homo Sapiens
FSPFHASVL

SEQ ID NO: 168525 - protein, 9 aa, Homo Sapiens
FSQINLREY

SEQ ID NO: 168526 - protein, 9 aa, Homo Sapiens
FSQIRKDAL

SEQ ID NO: 168527 - protein, 9 aa, Homo Sapiens
FSQVIPVSL

SEQ ID NO: 168528 - protein, 9 aa, Homo Sapiens
FSRLYLNVL

SEQ ID NO: 168529 - protein, 9 aa, Homo Sapiens
FSRSDHLAL

SEQ ID NO: 168530 - protein, 9 aa, Homo Sapiens
FSSDLQKTF

SEQ ID NO: 168531 - protein, 9 aa, Homo Sapiens
FSSDNRQIV

SEQ ID NO: 168532 - protein, 9 aa, Homo Sapiens
FSSDVTHEM

SEQ ID NO: 168533 - protein, 9 aa, Homo Sapiens
FSSENVKVF

SEQ ID NO: 168534 - protein, 9 aa, Homo Sapiens
FSSERLFSW

SEQ ID NO: 168535 - protein, 9 aa, Homo Sapiens
FSSGAIQVV

SEQ ID NO: 168536 - protein, 9 aa, Homo Sapiens
FSSLKLNVY

SEQ ID NO: 168537 - protein, 9 aa, Homo Sapiens
FSSPAVYVL

SEQ ID NO: 168538 - protein, 9 aa, Homo Sapiens
FSSPHLQML

SEQ ID NO: 168539 - protein, 9 aa, Homo Sapiens
FSSPVCMAF

SEQ ID NO: 168540 - protein, 9 aa, Homo Sapiens
FSSWVQLEV

SEQ ID NO: 168541 - protein, 9 aa, Homo Sapiens
FSTDSPRLL

SEQ ID NO: 168542 - protein, 9 aa, Homo Sapiens
FSTLYGRVL

SEQ ID NO: 168543 - protein, 9 aa, Homo Sapiens
FSTNLQRLM

SEQ ID NO: 168544 - protein, 9 aa, Homo Sapiens
FSTPPRQVL

SEQ ID NO: 168545 - protein, 9 aa, Homo Sapiens
FSTSLVHSI

SEQ ID NO: 168546 - protein, 9 aa, Homo Sapiens
FSTSTGRVY

SEQ ID NO: 168547 - protein, 9 aa, Homo Sapiens
FSTSVVRPF

SEQ ID NO: 168548 - protein, 9 aa, Homo Sapiens
FSTVKGVEL

SEQ ID NO: 168549 - protein, 9 aa, Homo Sapiens
FSTVVIHFL

SEQ ID NO: 168550 - protein, 9 aa, Homo Sapiens
FSVDSPRIY

SEQ ID NO: 168551 - protein, 9 aa, Homo Sapiens
FSVEGQLEF

SEQ ID NO: 168552 - protein, 9 aa, Homo Sapiens
FSVEQITAM

SEQ ID NO: 168553 - protein, 9 aa, Homo Sapiens
FSVNLFRTL

SEQ ID NO: 168554 - protein, 9 aa, Homo Sapiens
FSVVQPSSF

SEQ ID NO: 168555 - protein, 9 aa, Homo Sapiens
FSVVSPSSF

SEQ ID NO: 168556 - protein, 9 aa, Homo Sapiens
FSYAFPKAV

SEQ ID NO: 168557 - protein, 9 aa, Homo Sapiens
FSYAFPKEF

SEQ ID NO: 168558 - protein, 9 aa, Homo Sapiens
FSYVTPRAF

SEQ ID NO: 168559 - protein, 9 aa, Homo Sapiens
FTADFVRQL

SEQ ID NO: 168560 - protein, 9 aa, Homo Sapiens
FTAEMARVL

SEQ ID NO: 168561 - protein, 9 aa, Homo Sapiens
FTAERSSYY

SEQ ID NO: 168562 - protein, 9 aa, Homo Sapiens
FTAQPKPAT

SEQ ID NO: 168563 - protein, 9 aa, Homo Sapiens
FTGPLRPFF

SEQ ID NO: 168564 - protein, 9 aa, Homo Sapiens
FTHLYTLIV

SEQ ID NO: 168565 - protein, 9 aa, Homo Sapiens
FTHSQFIVV

SEQ ID NO: 168566 - protein, 9 aa, Homo Sapiens
FTIFRTISV

SEQ ID NO: 168567 - protein, 9 aa, Homo Sapiens
FTITKTVEY

SEQ ID NO: 168568 - protein, 9 aa, Homo Sapiens
FTKEQIREL

SEQ ID NO: 168569 - protein, 9 aa, Homo Sapiens
FTKGIPNVL

SEQ ID NO: 168570 - protein, 9 aa, Homo Sapiens
FTMEMVRQY

SEQ ID NO: 168571 - protein, 9 aa, Homo Sapiens
FTMPLHMTF

SEQ ID NO: 168572 - protein, 9 aa, Homo Sapiens
FTNPKVREW

SEQ ID NO: 168573 - protein, 9 aa, Homo Sapiens
FTNPWTKEL

SEQ ID NO: 168574 - protein, 9 aa, Homo Sapiens
FTREHYMEL

SEQ ID NO: 168575 - protein, 9 aa, Homo Sapiens
FTSAAFHEL

SEQ ID NO: 168576 - protein, 9 aa, Homo Sapiens
FTSDPKPTI

SEQ ID NO: 168577 - protein, 9 aa, Homo Sapiens
FTSEKFLVM

SEQ ID NO: 168578 - protein, 9 aa, Homo Sapiens
FTSKLHRMY

SEQ ID NO: 168579 - protein, 9 aa, Homo Sapiens
FTSNAFRKL

SEQ ID NO: 168580 - protein, 9 aa, Homo Sapiens
FTSPAVKRL

SEQ ID NO: 168581 - protein, 9 aa, Homo Sapiens
FTSPFCLQV

SEQ ID NO: 168582 - protein, 9 aa, Homo Sapiens
FTSQVIRNL

SEQ ID NO: 168583 - protein, 9 aa, Homo Sapiens
FTSYWIHWV

SEQ ID NO: 168584 - protein, 9 aa, Homo Sapiens
FTTAQKRVY

SEQ ID NO: 168585 - protein, 9 aa, Homo Sapiens
FTTKRPNTF

SEQ ID NO: 168586 - protein, 9 aa, Homo Sapiens
FTTNKKVSF

SEQ ID NO: 168587 - protein, 9 aa, Homo Sapiens
FTTSILRHW

SEQ ID NO: 168588 - protein, 9 aa, Homo Sapiens
FTTSNIRKV

SEQ ID NO: 168589 - protein, 9 aa, Homo Sapiens
FTTTAEREI

SEQ ID NO: 168590 - protein, 9 aa, Homo Sapiens
FTVDQIRAI

SEQ ID NO: 168591 - protein, 9 aa, Homo Sapiens
FTVNPKGEL

SEQ ID NO: 168592 - protein, 9 aa, Homo Sapiens
FTVPHTHVF

SEQ ID NO: 168593 - protein, 9 aa, Homo Sapiens
FTVVRVINF

SEQ ID NO: 168594 - protein, 9 aa, Homo Sapiens
FTYLEINPL

SEQ ID NO: 168595 - protein, 9 aa, Homo Sapiens
FVAEQKVEY

SEQ ID NO: 168596 - protein, 9 aa, Homo Sapiens
FVHDLVLYL

SEQ ID NO: 168597 - protein, 9 aa, Homo Sapiens
FVIETARQL

SEQ ID NO: 168598 - protein, 9 aa, Homo Sapiens
FVIQLGRIY

SEQ ID NO: 168599 - protein, 9 aa, Homo Sapiens
FVIRPSRFY

SEQ ID NO: 168600 - protein, 9 aa, Homo Sapiens
FVITFPRAY

SEQ ID NO: 168601 - protein, 9 aa, Homo Sapiens
FVITKPDVY

SEQ ID NO: 168602 - protein, 9 aa, Homo Sapiens
FVKEHFDEL

SEQ ID NO: 168603 - protein, 9 aa, Homo Sapiens
FVKFFIIGV

SEQ ID NO: 168604 - protein, 9 aa, Homo Sapiens
FVKPAVVTV

SEQ ID NO: 168605 - protein, 9 aa, Homo Sapiens
FVKPEFLLL

SEQ ID NO: 168606 - protein, 9 aa, Homo Sapiens
FVMETFVHL

SEQ ID NO: 168607 - protein, 9 aa, Homo Sapiens
FVNDYILYY

SEQ ID NO: 168608 - protein, 9 aa, Homo Sapiens
FVNPSLRVL

SEQ ID NO: 168609 - protein, 9 aa, Homo Sapiens
FVNPTSFVY

SEQ ID NO: 168610 - protein, 9 aa, Homo Sapiens
FVQLMPILI

SEQ ID NO: 168611 - protein, 9 aa, Homo Sapiens
FVQQRYLSY

SEQ ID NO: 168612 - protein, 9 aa, Homo Sapiens
FVQVPGRVV

SEQ ID NO: 168613 - protein, 9 aa, Homo Sapiens
FVRDMIREV

SEQ ID NO: 168614 - protein, 9 aa, Homo Sapiens
FVRDYMAVL

SEQ ID NO: 168615 - protein, 9 aa, Homo Sapiens
FVRPYSDYL

SEQ ID NO: 168616 - protein, 9 aa, Homo Sapiens
FVSERKPAL

SEQ ID NO: 168617 - protein, 9 aa, Homo Sapiens
FVTFSTRAM

SEQ ID NO: 168618 - protein, 9 aa, Homo Sapiens
FVTFTTRAM

SEQ ID NO: 168619 - protein, 9 aa, Homo Sapiens
FVTFYTRKA

SEQ ID NO: 168620 - protein, 9 aa, Homo Sapiens
FVTPHPRRI

SEQ ID NO: 168621 - protein, 9 aa, Homo Sapiens
FVTYVVREH

SEQ ID NO: 168622 - protein, 9 aa, Homo Sapiens
FVVTFPRAY

SEQ ID NO: 168623 - protein, 9 aa, Homo Sapiens
FVYLRQPYY

SEQ ID NO: 168624 - protein, 9 aa, Homo Sapiens
FWAPVPRVL

SEQ ID NO: 168625 - protein, 9 aa, Homo Sapiens
FYNNRLQAY

SEQ ID NO: 168626 - protein, 9 aa, Homo Sapiens
GAFLREYLY

SEQ ID NO: 168627 - protein, 9 aa, Homo Sapiens
GARWYSMEM

SEQ ID NO: 168628 - protein, 9 aa, Homo Sapiens
GASQLFRIW

SEQ ID NO: 168629 - protein, 9 aa, Homo Sapiens
GFQNALIVR

SEQ ID NO: 168630 - protein, 9 aa, Homo Sapiens
GFQVRMFEF

SEQ ID NO: 168631 - protein, 9 aa, Homo Sapiens
GLSPARLAV

SEQ ID NO: 168632 - protein, 9 aa, Homo Sapiens
GMLLRLEEF

SEQ ID NO: 168633 - protein, 9 aa, Homo Sapiens
GNYYKPWFF

SEQ ID NO: 168634 - protein, 9 aa, Homo Sapiens
GQWLRRVSY

SEQ ID NO: 168635 - protein, 9 aa, Homo Sapiens
GRTGPRAPL

SEQ ID NO: 168636 - protein, 9 aa, Homo Sapiens
GSFLRIYSL

SEQ ID NO: 168637 - protein, 9 aa, Homo Sapiens
GYAILRVSL

SEQ ID NO: 168638 - protein, 9 aa, Homo Sapiens
HAAGFAYTY

SEQ ID NO: 168639 - protein, 9 aa, Homo Sapiens
HAAHFARAF

SEQ ID NO: 168640 - protein, 9 aa, Homo Sapiens
HAAPFQNIL

SEQ ID NO: 168641 - protein, 9 aa, Homo Sapiens
HAAPFSKVL

SEQ ID NO: 168642 - protein, 9 aa, Homo Sapiens
HAASVFLTL

SEQ ID NO: 168643 - protein, 9 aa, Homo Sapiens
HAATIRLIF

SEQ ID NO: 168644 - protein, 9 aa, Homo Sapiens
HAIKSVKIY

SEQ ID NO: 168645 - protein, 9 aa, Homo Sapiens
HAIPPTLAM

SEQ ID NO: 168646 - protein, 9 aa, Homo Sapiens
HAISRYWYY

SEQ ID NO: 168647 - protein, 9 aa, Homo Sapiens
HAKEYIQQL

SEQ ID NO: 168648 - protein, 9 aa, Homo Sapiens
HAKGFGMTL

SEQ ID NO: 168649 - protein, 9 aa, Homo Sapiens
HAKMIFMEL

SEQ ID NO: 168650 - protein, 9 aa, Homo Sapiens
HAKPPTPSL

SEQ ID NO: 168651 - protein, 9 aa, Homo Sapiens
HALERLFTM

SEQ ID NO: 168652 - protein, 9 aa, Homo Sapiens
HANYQPVEI

SEQ ID NO: 168653 - protein, 9 aa, Homo Sapiens
HAPFTATSL

SEQ ID NO: 168654 - protein, 9 aa, Homo Sapiens
HARFYFLFH

SEQ ID NO: 168655 - protein, 9 aa, Homo Sapiens
HARLAPPSL

SEQ ID NO: 168656 - protein, 9 aa, Homo Sapiens
HASDRIIAL

SEQ ID NO: 168657 - protein, 9 aa, Homo Sapiens
HASTLHRLY

SEQ ID NO: 168658 - protein, 9 aa, Homo Sapiens
HATQAIFEI

SEQ ID NO: 168659 - protein, 9 aa, Homo Sapiens
HATTYIPLM

SEQ ID NO: 168660 - protein, 9 aa, Homo Sapiens
HAVLRVVDF

SEQ ID NO: 168661 - protein, 9 aa, Homo Sapiens
HCTGHIHVY

SEQ ID NO: 168662 - protein, 9 aa, Homo Sapiens
HDNEETFLK

SEQ ID NO: 168663 - protein, 9 aa, Homo Sapiens
HFNPKIESY

SEQ ID NO: 168664 - protein, 9 aa, Homo Sapiens
HFQIRNVTF

SEQ ID NO: 168665 - protein, 9 aa, Homo Sapiens
HFYMRKVKF

SEQ ID NO: 168666 - protein, 9 aa, Homo Sapiens
HGAEPLPYY

SEQ ID NO: 168667 - protein, 9 aa, Homo Sapiens
HIRESLPAL

SEQ ID NO: 168668 - protein, 9 aa, Homo Sapiens
HLPSGVKSL

SEQ ID NO: 168669 - protein, 9 aa, Homo Sapiens
HNALRILTF

SEQ ID NO: 168670 - protein, 9 aa, Homo Sapiens
HNSWQVVAM

SEQ ID NO: 168671 - protein, 9 aa, Homo Sapiens
HQRTFVLEV

SEQ ID NO: 168672 - protein, 9 aa, Homo Sapiens
HSFLKALYY

SEQ ID NO: 168673 - protein, 9 aa, Homo Sapiens
HSGPLRVAM

SEQ ID NO: 168674 - protein, 9 aa, Homo Sapiens
HSIVRLVAF

SEQ ID NO: 168675 - protein, 9 aa, Homo Sapiens
HSSMPRPDY

SEQ ID NO: 168676 - protein, 9 aa, Homo Sapiens
HSTVHLIEF

SEQ ID NO: 168677 - protein, 9 aa, Homo Sapiens
HTQTRLLSM

SEQ ID NO: 168678 - protein, 9 aa, Homo Sapiens
HTTILRPSY

SEQ ID NO: 168679 - protein, 9 aa, Homo Sapiens
IAAERWIKF

SEQ ID NO: 168680 - protein, 9 aa, Homo Sapiens
IAAMPLISL

SEQ ID NO: 168681 - protein, 9 aa, Homo Sapiens
IAAPDSRRW

SEQ ID NO: 168682 - protein, 9 aa, Homo Sapiens
IAASYVKYL

SEQ ID NO: 168683 - protein, 9 aa, Homo Sapiens
IAFFDVRTF

SEQ ID NO: 168684 - protein, 9 aa, Homo Sapiens
IAFLMINAV

SEQ ID NO: 168685 - protein, 9 aa, Homo Sapiens
IAFSRPVKY

SEQ ID NO: 168686 - protein, 9 aa, Homo Sapiens
IAFVRLPSL

SEQ ID NO: 168687 - protein, 9 aa, Homo Sapiens
IAIDWEPEM

SEQ ID NO: 168688 - protein, 9 aa, Homo Sapiens
IAIEPGAAL

SEQ ID NO: 168689 - protein, 9 aa, Homo Sapiens
IAIEVLHLL

SEQ ID NO: 168690 - protein, 9 aa, Homo Sapiens
IAIPVTVAF

SEQ ID NO: 168691 - protein, 9 aa, Homo Sapiens
IAISGTFAY

SEQ ID NO: 168692 - protein, 9 aa, Homo Sapiens
IAISLGKIF

SEQ ID NO: 168693 - protein, 9 aa, Homo Sapiens
IAISRTPVL

SEQ ID NO: 168694 - protein, 9 aa, Homo Sapiens
IAKNVFLHL

SEQ ID NO: 168695 - protein, 9 aa, Homo Sapiens
IALGFYRFW

SEQ ID NO: 168696 - protein, 9 aa, Homo Sapiens
IAMDLILKM

SEQ ID NO: 168697 - protein, 9 aa, Homo Sapiens
IAMGMAQAL

SEQ ID NO: 168698 - protein, 9 aa, Homo Sapiens
IAMPLHMIF

SEQ ID NO: 168699 - protein, 9 aa, Homo Sapiens
IANAVVKEL

SEQ ID NO: 168700 - protein, 9 aa, Homo Sapiens
IANDRFINM

SEQ ID NO: 168701 - protein, 9 aa, Homo Sapiens
IANQRITAF

SEQ ID NO: 168702 - protein, 9 aa, Homo Sapiens
IANTLYRIF

SEQ ID NO: 168703 - protein, 9 aa, Homo Sapiens
IAPGVTHEL

SEQ ID NO: 168704 - protein, 9 aa, Homo Sapiens
IAQAVPHIL

SEQ ID NO: 168705 - protein, 9 aa, Homo Sapiens
IAQDFKTDL

SEQ ID NO: 168706 - protein, 9 aa, Homo Sapiens
IAQDQPKIL

SEQ ID NO: 168707 - protein, 9 aa, Homo Sapiens
IAQLYGRLY

SEQ ID NO: 168708 - protein, 9 aa, Homo Sapiens
IAQRYLLQY

SEQ ID NO: 168709 - protein, 9 aa, Homo Sapiens
IAREWFFLL

SEQ ID NO: 168710 - protein, 9 aa, Homo Sapiens
IARIPPVAV

SEQ ID NO: 168711 - protein, 9 aa, Homo Sapiens
IARPFIEAL

SEQ ID NO: 168712 - protein, 9 aa, Homo Sapiens
IASEVARKL

SEQ ID NO: 168713 - protein, 9 aa, Homo Sapiens
IASEVLKLF

SEQ ID NO: 168714 - protein, 9 aa, Homo Sapiens
IASIHSFEL

SEQ ID NO: 168715 - protein, 9 aa, Homo Sapiens
IASLIPTPR

SEQ ID NO: 168716 - protein, 9 aa, Homo Sapiens
IASNYHLEV

SEQ ID NO: 168717 - protein, 9 aa, Homo Sapiens
IASPVIAAV

SEQ ID NO: 168718 - protein, 9 aa, Homo Sapiens
IASPVQPVL

SEQ ID NO: 168719 - protein, 9 aa, Homo Sapiens
IASQRLTPL

SEQ ID NO: 168720 - protein, 9 aa, Homo Sapiens
IASSYMYEM

SEQ ID NO: 168721 - protein, 9 aa, Homo Sapiens
IASTLVHKF

SEQ ID NO: 168722 - protein, 9 aa, Homo Sapiens
IATDIIHLH

SEQ ID NO: 168723 - protein, 9 aa, Homo Sapiens
IATEIILEI

SEQ ID NO: 168724 - protein, 9 aa, Homo Sapiens
IATFWNKAF

SEQ ID NO: 168725 - protein, 9 aa, Homo Sapiens
IATGILHLL

SEQ ID NO: 168726 - protein, 9 aa, Homo Sapiens
IATIKNISM

SEQ ID NO: 168727 - protein, 9 aa, Homo Sapiens
IATKDVRIF

SEQ ID NO: 168728 - protein, 9 aa, Homo Sapiens
IATLRAYVL

SEQ ID NO: 168729 - protein, 9 aa, Homo Sapiens
IATLRKYTY

SEQ ID NO: 168730 - protein, 9 aa, Homo Sapiens
IATPFIKLF

SEQ ID NO: 168731 - protein, 9 aa, Homo Sapiens
IATQVVVEK

SEQ ID NO: 168732 - protein, 9 aa, Homo Sapiens
IATSQNRIY

SEQ ID NO: 168733 - protein, 9 aa, Homo Sapiens
IAVEPVKTY

SEQ ID NO: 168734 - protein, 9 aa, Homo Sapiens
IAVGLVRAY

SEQ ID NO: 168735 - protein, 9 aa, Homo Sapiens
IAVIKGLTY

SEQ ID NO: 168736 - protein, 9 aa, Homo Sapiens
IAVLQAEVY

SEQ ID NO: 168737 - protein, 9 aa, Homo Sapiens
IAVLRGLAY

SEQ ID NO: 168738 - protein, 9 aa, Homo Sapiens
IAVPEARFL

SEQ ID NO: 168739 - protein, 9 aa, Homo Sapiens
IAVSIVRAL

SEQ ID NO: 168740 - protein, 9 aa, Homo Sapiens
IAYIRDLAL

SEQ ID NO: 168741 - protein, 9 aa, Homo Sapiens
IAYIRITQY

SEQ ID NO: 168742 - protein, 9 aa, Homo Sapiens
IAYSRPVYF

SEQ ID NO: 168743 - protein, 9 aa, Homo Sapiens
ICADPRVPW

SEQ ID NO: 168744 - protein, 9 aa, Homo Sapiens
IFFTRAVQF

SEQ ID NO: 168745 - protein, 9 aa, Homo Sapiens
IFGLRPVDY

SEQ ID NO: 168746 - protein, 9 aa, Homo Sapiens
IFLIRHSQY

SEQ ID NO: 168747 - protein, 9 aa, Homo Sapiens
IFMENRNEF

SEQ ID NO: 168748 - protein, 9 aa, Homo Sapiens
IFSIREVSF

SEQ ID NO: 168749 - protein, 9 aa, Homo Sapiens
IFSPEGRLY

SEQ ID NO: 168750 - protein, 9 aa, Homo Sapiens
IFVARLYYF

SEQ ID NO: 168751 - protein, 9 aa, Homo Sapiens
IGALRENTF

SEQ ID NO: 168752 - protein, 9 aa, Homo Sapiens
IGSPFLRAY

SEQ ID NO: 168753 - protein, 9 aa, Homo Sapiens
IGSSFPRMF

SEQ ID NO: 168754 - protein, 9 aa, Homo Sapiens
IGYARQYVY

SEQ ID NO: 168755 - protein, 9 aa, Homo Sapiens
IIAEPGRYY

SEQ ID NO: 168756 - protein, 9 aa, Homo Sapiens
IIAPPERKY

SEQ ID NO: 168757 - protein, 9 aa, Homo Sapiens
IIHYRHQEF

SEQ ID NO: 168758 - protein, 9 aa, Homo Sapiens
IIKNIWIPM

SEQ ID NO: 168759 - protein, 9 aa, Homo Sapiens
IIREPLTEL

SEQ ID NO: 168760 - protein, 9 aa, Homo Sapiens
IISEFALEY

SEQ ID NO: 168761 - protein, 9 aa, Homo Sapiens
IITAFIRAL

SEQ ID NO: 168762 - protein, 9 aa, Homo Sapiens
IITDLLRSV

SEQ ID NO: 168763 - protein, 9 aa, Homo Sapiens
IIVDPAREL

SEQ ID NO: 168764 - protein, 9 aa, Homo Sapiens
IIYDRDFSY

SEQ ID NO: 168765 - protein, 9 aa, Homo Sapiens
ILHLRQVTF

SEQ ID NO: 168766 - protein, 9 aa, Homo Sapiens
ILMDPSPEY

SEQ ID NO: 168767 - protein, 9 aa, Homo Sapiens
ILSGVIRSV

SEQ ID NO: 168768 - protein, 9 aa, Homo Sapiens
ILSPPRPPT

SEQ ID NO: 168769 - protein, 9 aa, Homo Sapiens
ILTERGYSF

SEQ ID NO: 168770 - protein, 9 aa, Homo Sapiens
ILTLIPRLF

SEQ ID NO: 168771 - protein, 9 aa, Homo Sapiens
ILYEFPRVF

SEQ ID NO: 168772 - protein, 9 aa, Homo Sapiens
ILYIRNLPY

SEQ ID NO: 168773 - protein, 9 aa, Homo Sapiens
IMNTRHIAF

SEQ ID NO: 168774 - protein, 9 aa, Homo Sapiens
INTDLSRIL

SEQ ID NO: 168775 - protein, 9 aa, Homo Sapiens
INTFKLLSY

SEQ ID NO: 168776 - protein, 9 aa, Homo Sapiens
IQMGRFISF

SEQ ID NO: 168777 - protein, 9 aa, Homo Sapiens
IQRTPKIQV

SEQ ID NO: 168778 - protein, 9 aa, Homo Sapiens
ISAARLYYY

SEQ ID NO: 168779 - protein, 9 aa, Homo Sapiens
ISAPQERLY

SEQ ID NO: 168780 - protein, 9 aa, Homo Sapiens
ISIHRPLAY

SEQ ID NO: 168781 - protein, 9 aa, Homo Sapiens
ISIVRPFSI

SEQ ID NO: 168782 - protein, 9 aa, Homo Sapiens
ISKNYALQI

SEQ ID NO: 168783 - protein, 9 aa, Homo Sapiens
ISLFQIESL

SEQ ID NO: 168784 - protein, 9 aa, Homo Sapiens
ISLLKAVFY

SEQ ID NO: 168785 - protein, 9 aa, Homo Sapiens
ISNLRDVFY

SEQ ID NO: 168786 - protein, 9 aa, Homo Sapiens
ISNPNSIIL

SEQ ID NO: 168787 - protein, 9 aa, Homo Sapiens
ISNPVTKEM

SEQ ID NO: 168788 - protein, 9 aa, Homo Sapiens
ISQVFEIAL

SEQ ID NO: 168789 - protein, 9 aa, Homo Sapiens
ISRDPFYEM

SEQ ID NO: 168790 - protein, 9 aa, Homo Sapiens
ISSIREFGF

SEQ ID NO: 168791 - protein, 9 aa, Homo Sapiens
ISSPFMVVY

SEQ ID NO: 168792 - protein, 9 aa, Homo Sapiens
ISSPPFRAI

SEQ ID NO: 168793 - protein, 9 aa, Homo Sapiens
ISSPVILQF

SEQ ID NO: 168794 - protein, 9 aa, Homo Sapiens
ISTEFIHKL

SEQ ID NO: 168795 - protein, 9 aa, Homo Sapiens
ISTEKVNQL

SEQ ID NO: 168796 - protein, 9 aa, Homo Sapiens
ISTIRTQNL

SEQ ID NO: 168797 - protein, 9 aa, Homo Sapiens
ISTNTLRIL

SEQ ID NO: 168798 - protein, 9 aa, Homo Sapiens
ISTPNVNAL

SEQ ID NO: 168799 - protein, 9 aa, Homo Sapiens
ISTPVIRTF

SEQ ID NO: 168800 - protein, 9 aa, Homo Sapiens
ISVERVIEY

SEQ ID NO: 168801 - protein, 9 aa, Homo Sapiens
ISYYKPEFY

SEQ ID NO: 168802 - protein, 9 aa, Homo Sapiens
ITAPPSRVL

SEQ ID NO: 168803 - protein, 9 aa, Homo Sapiens
ITAPTVRQY

SEQ ID NO: 168804 - protein, 9 aa, Homo Sapiens
ITFEGKVAF

SEQ ID NO: 168805 - protein, 9 aa, Homo Sapiens
ITLLREISL

SEQ ID NO: 168806 - protein, 9 aa, Homo Sapiens
ITQGIPRSY

SEQ ID NO: 168807 - protein, 9 aa, Homo Sapiens
ITSPVHVSF

SEQ ID NO: 168808 - protein, 9 aa, Homo Sapiens
ITSSPHPEY

SEQ ID NO: 168809 - protein, 9 aa, Homo Sapiens
ITTLRKYTY

SEQ ID NO: 168810 - protein, 9 aa, Homo Sapiens
ITTPGVRFY

SEQ ID NO: 168811 - protein, 9 aa, Homo Sapiens
ITTTFRPEL

SEQ ID NO: 168812 - protein, 9 aa, Homo Sapiens
ITTTVTRVL

SEQ ID NO: 168813 - protein, 9 aa, Homo Sapiens
ITTVIQHVF

SEQ ID NO: 168814 - protein, 9 aa, Homo Sapiens
ITVGPRGPL

SEQ ID NO: 168815 - protein, 9 aa, Homo Sapiens
IVSLRLLSL

SEQ ID NO: 168816 - protein, 9 aa, Homo Sapiens
IVTELIRDY

SEQ ID NO: 168817 - protein, 9 aa, Homo Sapiens
IVTERLVAL

SEQ ID NO: 168818 - protein, 9 aa, Homo Sapiens
IWFEKRLAY

SEQ ID NO: 168819 - protein, 9 aa, Homo Sapiens
KAADFVKAF

SEQ ID NO: 168820 - protein, 9 aa, Homo Sapiens
KAADPVPSF

SEQ ID NO: 168821 - protein, 9 aa, Homo Sapiens
KAALAHPFF

SEQ ID NO: 168822 - protein, 9 aa, Homo Sapiens
KAAMLFRQY

SEQ ID NO: 168823 - protein, 9 aa, Homo Sapiens
KAASVRPVL

SEQ ID NO: 168824 - protein, 9 aa, Homo Sapiens
KAAVLLHLL

SEQ ID NO: 168825 - protein, 9 aa, Homo Sapiens
KAAVMVHQL

SEQ ID NO: 168826 - protein, 9 aa, Homo Sapiens
KAFARPWSL

SEQ ID NO: 168827 - protein, 9 aa, Homo Sapiens
KAFDQRLTF

SEQ ID NO: 168828 - protein, 9 aa, Homo Sapiens
KAFVFSVAL

SEQ ID NO: 168829 - protein, 9 aa, Homo Sapiens
KAIDYIKYL

SEQ ID NO: 168830 - protein, 9 aa, Homo Sapiens
KAIDYIRFL

SEQ ID NO: 168831 - protein, 9 aa, Homo Sapiens
KAIGLFISF

SEQ ID NO: 168832 - protein, 9 aa, Homo Sapiens
KALNRFEKL

SEQ ID NO: 168833 - protein, 9 aa, Homo Sapiens
KAMDDTFYL

SEQ ID NO: 168834 - protein, 9 aa, Homo Sapiens
KAMELIREL

SEQ ID NO: 168835 - protein, 9 aa, Homo Sapiens
KAMPYRLLL

SEQ ID NO: 168836 - protein, 9 aa, Homo Sapiens
KANAFLKEF

SEQ ID NO: 168837 - protein, 9 aa, Homo Sapiens
KANPALYVL

SEQ ID NO: 168838 - protein, 9 aa, Homo Sapiens
KAQDFYVEM

SEQ ID NO: 168839 - protein, 9 aa, Homo Sapiens
KASALLRLY

SEQ ID NO: 168840 - protein, 9 aa, Homo Sapiens
KASDAFHFF

SEQ ID NO: 168841 - protein, 9 aa, Homo Sapiens
KASDLYITL

SEQ ID NO: 168842 - protein, 9 aa, Homo Sapiens
KASGIIHSY

SEQ ID NO: 168843 - protein, 9 aa, Homo Sapiens
KASGTLREY

SEQ ID NO: 168844 - protein, 9 aa, Homo Sapiens
KASLRELAL

SEQ ID NO: 168845 - protein, 9 aa, Homo Sapiens
KASSITREL

SEQ ID NO: 168846 - protein, 9 aa, Homo Sapiens
KATAYILSV

SEQ ID NO: 168847 - protein, 9 aa, Homo Sapiens
KATEYIQYM

SEQ ID NO: 168848 - protein, 9 aa, Homo Sapiens
KATFHYRTL

SEQ ID NO: 168849 - protein, 9 aa, Homo Sapiens
KATFIIKII

SEQ ID NO: 168850 - protein, 9 aa, Homo Sapiens
KATNVVRLL

SEQ ID NO: 168851 - protein, 9 aa, Homo Sapiens
KATPIKLIW

SEQ ID NO: 168852 - protein, 9 aa, Homo Sapiens
KATPTTRLW

SEQ ID NO: 168853 - protein, 9 aa, Homo Sapiens
KATQNFKVM

SEQ ID NO: 168854 - protein, 9 aa, Homo Sapiens
KAVDQPRQL

SEQ ID NO: 168855 - protein, 9 aa, Homo Sapiens
KAVFVARVL

SEQ ID NO: 168856 - protein, 9 aa, Homo Sapiens
KAVIRVNVF

SEQ ID NO: 168857 - protein, 9 aa, Homo Sapiens
KAVSLFLCY

SEQ ID NO: 168858 - protein, 9 aa, Homo Sapiens
KAYERGISL

SEQ ID NO: 168859 - protein, 9 aa, Homo Sapiens
KAYFDVKEY

SEQ ID NO: 168860 - protein, 9 aa, Homo Sapiens
KAYLKKISM

SEQ ID NO: 168861 - protein, 9 aa, Homo Sapiens
KAYLREDFF

SEQ ID NO: 168862 - protein, 9 aa, Homo Sapiens
KAYVRVLDL

SEQ ID NO: 168863 - protein, 9 aa, Homo Sapiens
KCWLRYIEF

SEQ ID NO: 168864 - protein, 9 aa, Homo Sapiens
KEEVVTVET

SEQ ID NO: 168865 - protein, 9 aa, Homo Sapiens
KFDLRIYVY

SEQ ID NO: 168866 - protein, 9 aa, Homo Sapiens
KGAPPKVSY

SEQ ID NO: 168867 - protein, 9 aa, Homo Sapiens
KGSSAVRVY

SEQ ID NO: 168868 - protein, 9 aa, Homo Sapiens
KIDALNENK

SEQ ID NO: 168869 - protein, 9 aa, Homo Sapiens
KIINAFRYY

SEQ ID NO: 168870 - protein, 9 aa, Homo Sapiens
KILKDMRIF

SEQ ID NO: 168871 - protein, 9 aa, Homo Sapiens
KILNHPRVY

SEQ ID NO: 168872 - protein, 9 aa, Homo Sapiens
KINEAFIEM

SEQ ID NO: 168873 - protein, 9 aa, Homo Sapiens
KISSFIRKY

SEQ ID NO: 168874 - protein, 9 aa, Homo Sapiens
KITPWFKII

SEQ ID NO: 168875 - protein, 9 aa, Homo Sapiens
KLPGNISSL

SEQ ID NO: 168876 - protein, 9 aa, Homo Sapiens
KLSEIVREF

SEQ ID NO: 168877 - protein, 9 aa, Homo Sapiens
KLSELLRYY

SEQ ID NO: 168878 - protein, 9 aa, Homo Sapiens
KLSTYIRLY

SEQ ID NO: 168879 - protein, 9 aa, Homo Sapiens
KLTELLRYY

SEQ ID NO: 168880 - protein, 9 aa, Homo Sapiens
KMFLRGTFY

SEQ ID NO: 168881 - protein, 9 aa, Homo Sapiens
KNQAKLIEF

SEQ ID NO: 168882 - protein, 9 aa, Homo Sapiens
KQFHRIVTY

SEQ ID NO: 168883 - protein, 9 aa, Homo Sapiens
KSFFRRLSF

SEQ ID NO: 168884 - protein, 9 aa, Homo Sapiens
KSFVKVYNY

SEQ ID NO: 168885 - protein, 9 aa, Homo Sapiens
KSKDFVQVM

SEQ ID NO: 168886 - protein, 9 aa, Homo Sapiens
KSLWKHHEY

SEQ ID NO: 168887 - protein, 9 aa, Homo Sapiens
KSNPKPLVL

SEQ ID NO: 168888 - protein, 9 aa, Homo Sapiens
KSSDIAKTF

SEQ ID NO: 168889 - protein, 9 aa, Homo Sapiens
KSSWKRVSF

SEQ ID NO: 168890 - protein, 9 aa, Homo Sapiens
KSTAISLFY

SEQ ID NO: 168891 - protein, 9 aa, Homo Sapiens
KSTDVAKTF

SEQ ID NO: 168892 - protein, 9 aa, Homo Sapiens
KTFARYLSF

SEQ ID NO: 168893 - protein, 9 aa, Homo Sapiens
KTHLYTLIL

SEQ ID NO: 168894 - protein, 9 aa, Homo Sapiens
KTIDPKVAF

SEQ ID NO: 168895 - protein, 9 aa, Homo Sapiens
KTLDPKAVF

SEQ ID NO: 168896 - protein, 9 aa, Homo Sapiens
KTSDFLKVL

SEQ ID NO: 168897 - protein, 9 aa, Homo Sapiens
KTTKFIKSF

SEQ ID NO: 168898 - protein, 9 aa, Homo Sapiens
KVFERAVQY

SEQ ID NO: 168899 - protein, 9 aa, Homo Sapiens
KVMERLIEF

SEQ ID NO: 168900 - protein, 9 aa, Homo Sapiens
KVTELLRTF

SEQ ID NO: 168901 - protein, 9 aa, Homo Sapiens
KVYERAVEF

SEQ ID NO: 168902 - protein, 9 aa, Homo Sapiens
KWLLRLEEY

SEQ ID NO: 168903 - protein, 9 aa, Homo Sapiens
KYFLRGYRY

SEQ ID NO: 168904 - protein, 9 aa, Homo Sapiens
LAAAMVRVL

SEQ ID NO: 168905 - protein, 9 aa, Homo Sapiens
LAAARLAAA

SEQ ID NO: 168906 - protein, 9 aa, Homo Sapiens
LAAEFLKQV

SEQ ID NO: 168907 - protein, 9 aa, Homo Sapiens
LAAEVHRVL

SEQ ID NO: 168908 - protein, 9 aa, Homo Sapiens
LAAGKPRVL

SEQ ID NO: 168909 - protein, 9 aa, Homo Sapiens
LAAIWFRTY

SEQ ID NO: 168910 - protein, 9 aa, Homo Sapiens
LAALAKAPF

SEQ ID NO: 168911 - protein, 9 aa, Homo Sapiens
LAALPRPQL

SEQ ID NO: 168912 - protein, 9 aa, Homo Sapiens
LAALRLQSL

SEQ ID NO: 168913 - protein, 9 aa, Homo Sapiens
LAAPSRFVL

SEQ ID NO: 168914 - protein, 9 aa, Homo Sapiens
LAASALPAL

SEQ ID NO: 168915 - protein, 9 aa, Homo Sapiens
LAAVKAIAW

SEQ ID NO: 168916 - protein, 9 aa, Homo Sapiens
LAAYHPWVV

SEQ ID NO: 168917 - protein, 9 aa, Homo Sapiens
LAFDQQPAM

SEQ ID NO: 168918 - protein, 9 aa, Homo Sapiens
LAFERGYEF

SEQ ID NO: 168919 - protein, 9 aa, Homo Sapiens
LAFLRFVVY

SEQ ID NO: 168920 - protein, 9 aa, Homo Sapiens
LAFLRGLSY

SEQ ID NO: 168921 - protein, 9 aa, Homo Sapiens
LAFLRHLTL

SEQ ID NO: 168922 - protein, 9 aa, Homo Sapiens
LAFVKNDSY

SEQ ID NO: 168923 - protein, 9 aa, Homo Sapiens
LAGPLRPAA

SEQ ID NO: 168924 - protein, 9 aa, Homo Sapiens
LAIDAIHQL

SEQ ID NO: 168925 - protein, 9 aa, Homo Sapiens
LAIEHVRFF

SEQ ID NO: 168926 - protein, 9 aa, Homo Sapiens
LAIPITNTY

SEQ ID NO: 168927 - protein, 9 aa, Homo Sapiens
LAIPVFLTL

SEQ ID NO: 168928 - protein, 9 aa, Homo Sapiens
LAITCSFPL

SEQ ID NO: 168929 - protein, 9 aa, Homo Sapiens
LAKDGVLTL

SEQ ID NO: 168930 - protein, 9 aa, Homo Sapiens
LAKNFFNEL

SEQ ID NO: 168931 - protein, 9 aa, Homo Sapiens
LAKPPVVSV

SEQ ID NO: 168932 - protein, 9 aa, Homo Sapiens
LALAIAQEL

SEQ ID NO: 168933 - protein, 9 aa, Homo Sapiens
LALARLETY

SEQ ID NO: 168934 - protein, 9 aa, Homo Sapiens
LALEPGVAY

SEQ ID NO: 168935 - protein, 9 aa, Homo Sapiens
LALLNNVSY

SEQ ID NO: 168936 - protein, 9 aa, Homo Sapiens
LALLRELSL

SEQ ID NO: 168937 - protein, 9 aa, Homo Sapiens
LAMEPTPEL

SEQ ID NO: 168938 - protein, 9 aa, Homo Sapiens
LAMINRFQF

SEQ ID NO: 168939 - protein, 9 aa, Homo Sapiens
LANERLMTL

SEQ ID NO: 168940 - protein, 9 aa, Homo Sapiens
LANGEVRIY

SEQ ID NO: 168941 - protein, 9 aa, Homo Sapiens
LANGSILVY

SEQ ID NO: 168942 - protein, 9 aa, Homo Sapiens
LAPLTYISL

SEQ ID NO: 168943 - protein, 9 aa, Homo Sapiens
LAQDIFKEL

SEQ ID NO: 168944 - protein, 9 aa, Homo Sapiens
LAQEIVKAL

SEQ ID NO: 168945 - protein, 9 aa, Homo Sapiens
LAQIRQQQY

SEQ ID NO: 168946 - protein, 9 aa, Homo Sapiens
LAQQYYLVY

SEQ ID NO: 168947 - protein, 9 aa, Homo Sapiens
LAQTTRTAY

SEQ ID NO: 168948 - protein, 9 aa, Homo Sapiens
LARFNAREF

SEQ ID NO: 168949 - protein, 9 aa, Homo Sapiens
LARIYSFQM

SEQ ID NO: 168950 - protein, 9 aa, Homo Sapiens
LARIYSYQM

SEQ ID NO: 168951 - protein, 9 aa, Homo Sapiens
LARPLVLAL

SEQ ID NO: 168952 - protein, 9 aa, Homo Sapiens
LASAFFLVV

SEQ ID NO: 168953 - protein, 9 aa, Homo Sapiens
LASFKILAL

SEQ ID NO: 168954 - protein, 9 aa, Homo Sapiens
LASFREMVY

SEQ ID NO: 168955 - protein, 9 aa, Homo Sapiens
LASGKYRTF

SEQ ID NO: 168956 - protein, 9 aa, Homo Sapiens
LASHYIHIV

SEQ ID NO: 168957 - protein, 9 aa, Homo Sapiens
LASLKSLTY

SEQ ID NO: 168958 - protein, 9 aa, Homo Sapiens
LASLKTDTF

SEQ ID NO: 168959 - protein, 9 aa, Homo Sapiens
LASLSNRLY

SEQ ID NO: 168960 - protein, 9 aa, Homo Sapiens
LASNSIREA

SEQ ID NO: 168961 - protein, 9 aa, Homo Sapiens
LASPGHISV

SEQ ID NO: 168962 - protein, 9 aa, Homo Sapiens
LASPPWRVL

SEQ ID NO: 168963 - protein, 9 aa, Homo Sapiens
LASPVRAEM

SEQ ID NO: 168964 - protein, 9 aa, Homo Sapiens
LASSYERKL

SEQ ID NO: 168965 - protein, 9 aa, Homo Sapiens
LASYIHYVF

SEQ ID NO: 168966 - protein, 9 aa, Homo Sapiens
LASYVHYVF

SEQ ID NO: 168967 - protein, 9 aa, Homo Sapiens
LATAAALTY

SEQ ID NO: 168968 - protein, 9 aa, Homo Sapiens
LATAVVQLY

SEQ ID NO: 168969 - protein, 9 aa, Homo Sapiens
LATAYIHRF

SEQ ID NO: 168970 - protein, 9 aa, Homo Sapiens
LATDFIQSL

SEQ ID NO: 168971 - protein, 9 aa, Homo Sapiens
LATETVRSI

SEQ ID NO: 168972 - protein, 9 aa, Homo Sapiens
LATIRLLDV

SEQ ID NO: 168973 - protein, 9 aa, Homo Sapiens
LATKILHLL

SEQ ID NO: 168974 - protein, 9 aa, Homo Sapiens
LATLRNYDY

SEQ ID NO: 168975 - protein, 9 aa, Homo Sapiens
LATNFLLEM

SEQ ID NO: 168976 - protein, 9 aa, Homo Sapiens
LATPLHHTW

SEQ ID NO: 168977 - protein, 9 aa, Homo Sapiens
LATQMVRMI

SEQ ID NO: 168978 - protein, 9 aa, Homo Sapiens
LATRILHLL

SEQ ID NO: 168979 - protein, 9 aa, Homo Sapiens
LATSLPRLM

SEQ ID NO: 168980 - protein, 9 aa, Homo Sapiens
LATTVRPVF

SEQ ID NO: 168981 - protein, 9 aa, Homo Sapiens
LATWATKEL

SEQ ID NO: 168982 - protein, 9 aa, Homo Sapiens
LAVALNRSY

SEQ ID NO: 168983 - protein, 9 aa, Homo Sapiens
LAVDRLSLA

SEQ ID NO: 168984 - protein, 9 aa, Homo Sapiens
LAVGLSRIF

SEQ ID NO: 168985 - protein, 9 aa, Homo Sapiens
LAVLKLYQF

SEQ ID NO: 168986 - protein, 9 aa, Homo Sapiens
LAVLRLDSL

SEQ ID NO: 168987 - protein, 9 aa, Homo Sapiens
LAVNLTRVL

SEQ ID NO: 168988 - protein, 9 aa, Homo Sapiens
LAVSLVKVF

SEQ ID NO: 168989 - protein, 9 aa, Homo Sapiens
LAYLRLNTL

SEQ ID NO: 168990 - protein, 9 aa, Homo Sapiens
LAYLRTECY

SEQ ID NO: 168991 - protein, 9 aa, Homo Sapiens
LAYTLARVY

SEQ ID NO: 168992 - protein, 9 aa, Homo Sapiens
LFASTILHL

SEQ ID NO: 168993 - protein, 9 aa, Homo Sapiens
LFDERKYPY

SEQ ID NO: 168994 - protein, 9 aa, Homo Sapiens
LFLPGRMAY

SEQ ID NO: 168995 - protein, 9 aa, Homo Sapiens
LFMPRSTEF

SEQ ID NO: 168996 - protein, 9 aa, Homo Sapiens
LFSERIDVF

SEQ ID NO: 168997 - protein, 9 aa, Homo Sapiens
LFYERFRAY

SEQ ID NO: 168998 - protein, 9 aa, Homo Sapiens
LFYQRQDTF

SEQ ID NO: 168999 - protein, 9 aa, Homo Sapiens
LGALRELGF

SEQ ID NO: 169000 - protein, 9 aa, Homo Sapiens
LGAPAKPPL

SEQ ID NO: 169001 - protein, 9 aa, Homo Sapiens
LHYPIDSLT

SEQ ID NO: 169002 - protein, 9 aa, Homo Sapiens
LIAPPRYVM

SEQ ID NO: 169003 - protein, 9 aa, Homo Sapiens
LIKSYFLIV

SEQ ID NO: 169004 - protein, 9 aa, Homo Sapiens
LIVEPSREL

SEQ ID NO: 169005 - protein, 9 aa, Homo Sapiens
LLAARLVTF

SEQ ID NO: 169006 - protein, 9 aa, Homo Sapiens
LLETALTRV

SEQ ID NO: 169007 - protein, 9 aa, Homo Sapiens
LLHERIVQY

SEQ ID NO: 169008 - protein, 9 aa, Homo Sapiens
LLLLRGYAF

SEQ ID NO: 169009 - protein, 9 aa, Homo Sapiens
LLPPPMKEL

SEQ ID NO: 169010 - protein, 9 aa, Homo Sapiens
LLSDYIRLI

SEQ ID NO: 169011 - protein, 9 aa, Homo Sapiens
LLSLRILSF

SEQ ID NO: 169012 - protein, 9 aa, Homo Sapiens
LMAKPRPPL

SEQ ID NO: 169013 - protein, 9 aa, Homo Sapiens
LMSPVKPFY

SEQ ID NO: 169014 - protein, 9 aa, Homo Sapiens
LNSPYAKLY

SEQ ID NO: 169015 - protein, 9 aa, Homo Sapiens
LNTPENREY

SEQ ID NO: 169016 - protein, 9 aa, Homo Sapiens
LPINGNGKQ

SEQ ID NO: 169017 - protein, 9 aa, Homo Sapiens
LQAMPRTEF

SEQ ID NO: 169018 - protein, 9 aa, Homo Sapiens
LQGYLRSVF

SEQ ID NO: 169019 - protein, 9 aa, Homo Sapiens
LQIGVIRVY

SEQ ID NO: 169020 - protein, 9 aa, Homo Sapiens
LQQTRDLAF

SEQ ID NO: 169021 - protein, 9 aa, Homo Sapiens
LQSEVIRHY

SEQ ID NO: 169022 - protein, 9 aa, Homo Sapiens
LQSQWLRAY

SEQ ID NO: 169023 - protein, 9 aa, Homo Sapiens
LSADPRSVY

SEQ ID NO: 169024 - protein, 9 aa, Homo Sapiens
LSAEVYRIL

SEQ ID NO: 169025 - protein, 9 aa, Homo Sapiens
LSAGATRVY

SEQ ID NO: 169026 - protein, 9 aa, Homo Sapiens
LSALEEYTK

SEQ ID NO: 169027 - protein, 9 aa, Homo Sapiens
LSAMKEFAY

SEQ ID NO: 169028 - protein, 9 aa, Homo Sapiens
LSAPLHPEF

SEQ ID NO: 169029 - protein, 9 aa, Homo Sapiens
LSAVGERVF

SEQ ID NO: 169030 - protein, 9 aa, Homo Sapiens
LSEVTFRPL

SEQ ID NO: 169031 - protein, 9 aa, Homo Sapiens
LSFFMARVF

SEQ ID NO: 169032 - protein, 9 aa, Homo Sapiens
LSFIRSTEL

SEQ ID NO: 169033 - protein, 9 aa, Homo Sapiens
LSFPTTKTY

SEQ ID NO: 169034 - protein, 9 aa, Homo Sapiens
LSFQEVREY

SEQ ID NO: 169035 - protein, 9 aa, Homo Sapiens
LSFVRAFEF

SEQ ID NO: 169036 - protein, 9 aa, Homo Sapiens
LSIPYRLIF

SEQ ID NO: 169037 - protein, 9 aa, Homo Sapiens
LSIQRLWYF

SEQ ID NO: 169038 - protein, 9 aa, Homo Sapiens
LSKDSILSL

SEQ ID NO: 169039 - protein, 9 aa, Homo Sapiens
LSKDYTLIV

SEQ ID NO: 169040 - protein, 9 aa, Homo Sapiens
LSKFYELEL

SEQ ID NO: 169041 - protein, 9 aa, Homo Sapiens
LSKGPGLEV

SEQ ID NO: 169042 - protein, 9 aa, Homo Sapiens
LSLFRDEVF

SEQ ID NO: 169043 - protein, 9 aa, Homo Sapiens
LSLHNDHPY

SEQ ID NO: 169044 - protein, 9 aa, Homo Sapiens
LSLVSKTEI

SEQ ID NO: 169045 - protein, 9 aa, Homo Sapiens
LSMERMVPA

SEQ ID NO: 169046 - protein, 9 aa, Homo Sapiens
LSMTRPVSI

SEQ ID NO: 169047 - protein, 9 aa, Homo Sapiens
LSQERIIQF

SEQ ID NO: 169048 - protein, 9 aa, Homo Sapiens
LSQIRIDAL

SEQ ID NO: 169049 - protein, 9 aa, Homo Sapiens
LSQNRVAEF

SEQ ID NO: 169050 - protein, 9 aa, Homo Sapiens
LSQVRFLVL

SEQ ID NO: 169051 - protein, 9 aa, Homo Sapiens
LSQYRDQHF

SEQ ID NO: 169052 - protein, 9 aa, Homo Sapiens
LSRPNIFIL

SEQ ID NO: 169053 - protein, 9 aa, Homo Sapiens
LSSFKVAQY

SEQ ID NO: 169054 - protein, 9 aa, Homo Sapiens
LSSLRSVSL

SEQ ID NO: 169055 - protein, 9 aa, Homo Sapiens
LSSPWYHTY

SEQ ID NO: 169056 - protein, 9 aa, Homo Sapiens
LSSSVIREL

SEQ ID NO: 169057 - protein, 9 aa, Homo Sapiens
LSTALSLLY

SEQ ID NO: 169058 - protein, 9 aa, Homo Sapiens
LSTEAARVL

SEQ ID NO: 169059 - protein, 9 aa, Homo Sapiens
LSTEALRLW

SEQ ID NO: 169060 - protein, 9 aa, Homo Sapiens
LSTFRKHSL

SEQ ID NO: 169061 - protein, 9 aa, Homo Sapiens
LSTIQKIAL

SEQ ID NO: 169062 - protein, 9 aa, Homo Sapiens
LSTIREVAV

SEQ ID NO: 169063 - protein, 9 aa, Homo Sapiens
LSTLVRPVF

SEQ ID NO: 169064 - protein, 9 aa, Homo Sapiens
LSTMFRVEY

SEQ ID NO: 169065 - protein, 9 aa, Homo Sapiens
LSTPLIRTF

SEQ ID NO: 169066 - protein, 9 aa, Homo Sapiens
LSTPYIHSL

SEQ ID NO: 169067 - protein, 9 aa, Homo Sapiens
LSTTKPFEY

SEQ ID NO: 169068 - protein, 9 aa, Homo Sapiens
LSTTVKREL

SEQ ID NO: 169069 - protein, 9 aa, Homo Sapiens
LSVIQLWHY

SEQ ID NO: 169070 - protein, 9 aa, Homo Sapiens
LSYLRESSL

SEQ ID NO: 169071 - protein, 9 aa, Homo Sapiens
LTADFLREY

SEQ ID NO: 169072 - protein, 9 aa, Homo Sapiens
LTAKVFRTY

SEQ ID NO: 169073 - protein, 9 aa, Homo Sapiens
LTIFTARLY

SEQ ID NO: 169074 - protein, 9 aa, Homo Sapiens
LTLLRFLEY

SEQ ID NO: 169075 - protein, 9 aa, Homo Sapiens
LTRGYFLEH

SEQ ID NO: 169076 - protein, 9 aa, Homo Sapiens
LTTDISLIF

SEQ ID NO: 169077 - protein, 9 aa, Homo Sapiens
LTTEVHPEL

SEQ ID NO: 169078 - protein, 9 aa, Homo Sapiens
LTTLRVWCY

SEQ ID NO: 169079 - protein, 9 aa, Homo Sapiens
LTVLVPRVW

SEQ ID NO: 169080 - protein, 9 aa, Homo Sapiens
LTVQVARVY

SEQ ID NO: 169081 - protein, 9 aa, Homo Sapiens
LVAASQAAL

SEQ ID NO: 169082 - protein, 9 aa, Homo Sapiens
LVEPEGIEK

SEQ ID NO: 169083 - protein, 9 aa, Homo Sapiens
LVPPWTRVY

SEQ ID NO: 169084 - protein, 9 aa, Homo Sapiens
LVRPEVDVM

SEQ ID NO: 169085 - protein, 9 aa, Homo Sapiens
LVTGFARIF

SEQ ID NO: 169086 - protein, 9 aa, Homo Sapiens
LVTGTVRTF

SEQ ID NO: 169087 - protein, 9 aa, Homo Sapiens
MAADGRLVF

SEQ ID NO: 169088 - protein, 9 aa, Homo Sapiens
MAAGLARLL

SEQ ID NO: 169089 - protein, 9 aa, Homo Sapiens
MAALRTQTL

SEQ ID NO: 169090 - protein, 9 aa, Homo Sapiens
MAAMPQTVY

SEQ ID NO: 169091 - protein, 9 aa, Homo Sapiens
MAAYYEHRL

SEQ ID NO: 169092 - protein, 9 aa, Homo Sapiens
MAFNRAASF

SEQ ID NO: 169093 - protein, 9 aa, Homo Sapiens
MAFYVVKMY

SEQ ID NO: 169094 - protein, 9 aa, Homo Sapiens
MAGPLRAPL

SEQ ID NO: 169095 - protein, 9 aa, Homo Sapiens
MAISGVPVL

SEQ ID NO: 169096 - protein, 9 aa, Homo Sapiens
MAIVGGMAL

SEQ ID NO: 169097 - protein, 9 aa, Homo Sapiens
MAKMRLLTF

SEQ ID NO: 169098 - protein, 9 aa, Homo Sapiens
MAKRFAYPL

SEQ ID NO: 169099 - protein, 9 aa, Homo Sapiens
MALLFLLPL

SEQ ID NO: 169100 - protein, 9 aa, Homo Sapiens
MALVRFVNL

SEQ ID NO: 169101 - protein, 9 aa, Homo Sapiens
MANIPLPEY

SEQ ID NO: 169102 - protein, 9 aa, Homo Sapiens
MANPTALLL

SEQ ID NO: 169103 - protein, 9 aa, Homo Sapiens
MANWQLIHM

SEQ ID NO: 169104 - protein, 9 aa, Homo Sapiens
MAPLKMLAL

SEQ ID NO: 169105 - protein, 9 aa, Homo Sapiens
MAQLKCYYF

SEQ ID NO: 169106 - protein, 9 aa, Homo Sapiens
MAQRLVRVL

SEQ ID NO: 169107 - protein, 9 aa, Homo Sapiens
MARANARLF

SEQ ID NO: 169108 - protein, 9 aa, Homo Sapiens
MARGAALAL

SEQ ID NO: 169109 - protein, 9 aa, Homo Sapiens
MASGLVRLL

SEQ ID NO: 169110 - protein, 9 aa, Homo Sapiens
MASIRLQGL

SEQ ID NO: 169111 - protein, 9 aa, Homo Sapiens
MASKILKSY

SEQ ID NO: 169112 - protein, 9 aa, Homo Sapiens
MASLRSLSL

SEQ ID NO: 169113 - protein, 9 aa, Homo Sapiens
MATGDERFY

SEQ ID NO: 169114 - protein, 9 aa, Homo Sapiens
MATLLRTSF

SEQ ID NO: 169115 - protein, 9 aa, Homo Sapiens
MATNTVYVF

SEQ ID NO: 169116 - protein, 9 aa, Homo Sapiens
MATPYMNHY

SEQ ID NO: 169117 - protein, 9 aa, Homo Sapiens
MATVVYKVF

SEQ ID NO: 169118 - protein, 9 aa, Homo Sapiens
MAVEFLHEL

SEQ ID NO: 169119 - protein, 9 aa, Homo Sapiens
MAVERCLAL

SEQ ID NO: 169120 - protein, 9 aa, Homo Sapiens
MAVKQGRFY

SEQ ID NO: 169121 - protein, 9 aa, Homo Sapiens
MAVLLGKVY

SEQ ID NO: 169122 - protein, 9 aa, Homo Sapiens
MAYLKIQKY

SEQ ID NO: 169123 - protein, 9 aa, Homo Sapiens
MFLIRDWSY

SEQ ID NO: 169124 - protein, 9 aa, Homo Sapiens
MFLVRDWSF

SEQ ID NO: 169125 - protein, 9 aa, Homo Sapiens
MGYIRNVAY

SEQ ID NO: 169126 - protein, 9 aa, Homo Sapiens
MIRAAPPPL

SEQ ID NO: 169127 - protein, 9 aa, Homo Sapiens
MISEPRISY

SEQ ID NO: 169128 - protein, 9 aa, Homo Sapiens
MLAPPRELF

SEQ ID NO: 169129 - protein, 9 aa, Homo Sapiens
MMSEVIRIL

SEQ ID NO: 169130 - protein, 9 aa, Homo Sapiens
MNSLRKSNT

SEQ ID NO: 169131 - protein, 9 aa, Homo Sapiens
MNVVRNLTY

SEQ ID NO: 169132 - protein, 9 aa, Homo Sapiens
MQAPGRGPL

SEQ ID NO: 169133 - protein, 9 aa, Homo Sapiens
MQIAWSREF

SEQ ID NO: 169134 - protein, 9 aa, Homo Sapiens
MQTVYLREI

SEQ ID NO: 169135 - protein, 9 aa, Homo Sapiens
MSADRVVAF

SEQ ID NO: 169136 - protein, 9 aa, Homo Sapiens
MSAGPRYEY

SEQ ID NO: 169137 - protein, 9 aa, Homo Sapiens
MSIPFRSAY

SEQ ID NO: 169138 - protein, 9 aa, Homo Sapiens
MSLPYRLVF

SEQ ID NO: 169139 - protein, 9 aa, Homo Sapiens
MSRSVALAV

SEQ ID NO: 169140 - protein, 9 aa, Homo Sapiens
MSSLRPLAI

SEQ ID NO: 169141 - protein, 9 aa, Homo Sapiens
MSSPLSKEL

SEQ ID NO: 169142 - protein, 9 aa, Homo Sapiens
MSSSVVRRL

SEQ ID NO: 169143 - protein, 9 aa, Homo Sapiens
MSVEVRQTL

SEQ ID NO: 169144 - protein, 9 aa, Homo Sapiens
MTALQNTAL

SEQ ID NO: 169145 - protein, 9 aa, Homo Sapiens
MTAPLKLTY

SEQ ID NO: 169146 - protein, 9 aa, Homo Sapiens
MTAVRAWEF

SEQ ID NO: 169147 - protein, 9 aa, Homo Sapiens
MTFPGERIY

SEQ ID NO: 169148 - protein, 9 aa, Homo Sapiens
MTIEPFISL

SEQ ID NO: 169149 - protein, 9 aa, Homo Sapiens
MTMEYKQEL

SEQ ID NO: 169150 - protein, 9 aa, Homo Sapiens
MTQLRIIFY

SEQ ID NO: 169151 - protein, 9 aa, Homo Sapiens
MTQQPRPVL

SEQ ID NO: 169152 - protein, 9 aa, Homo Sapiens
MTSSRLWFS

SEQ ID NO: 169153 - protein, 9 aa, Homo Sapiens
MTTAFIHAL

SEQ ID NO: 169154 - protein, 9 aa, Homo Sapiens
MTTEILRSM

SEQ ID NO: 169155 - protein, 9 aa, Homo Sapiens
MVSAIVRTM

SEQ ID NO: 169156 - protein, 9 aa, Homo Sapiens
MWLPVVRTW

SEQ ID NO: 169157 - protein, 9 aa, Homo Sapiens
NAAERRGPL

SEQ ID NO: 169158 - protein, 9 aa, Homo Sapiens
NAFTMPLHM

SEQ ID NO: 169159 - protein, 9 aa, Homo Sapiens
NAIWRAWYM

SEQ ID NO: 169160 - protein, 9 aa, Homo Sapiens
NAKAALLEL

SEQ ID NO: 169161 - protein, 9 aa, Homo Sapiens
NAKDFFRVL

SEQ ID NO: 169162 - protein, 9 aa, Homo Sapiens
NAKGYTIPL

SEQ ID NO: 169163 - protein, 9 aa, Homo Sapiens
NAKKILLEM

SEQ ID NO: 169164 - protein, 9 aa, Homo Sapiens
NALGHVRYV

SEQ ID NO: 169165 - protein, 9 aa, Homo Sapiens
NALGVILQV

SEQ ID NO: 169166 - protein, 9 aa, Homo Sapiens
NALLRPRTF

SEQ ID NO: 169167 - protein, 9 aa, Homo Sapiens
NALVHLIEI

SEQ ID NO: 169168 - protein, 9 aa, Homo Sapiens
NALVHLIEV

SEQ ID NO: 169169 - protein, 9 aa, Homo Sapiens
NAMDVVVQF

SEQ ID NO: 169170 - protein, 9 aa, Homo Sapiens
NAMGFHVIL

SEQ ID NO: 169171 - protein, 9 aa, Homo Sapiens
NAMGYVRMI

SEQ ID NO: 169172 - protein, 9 aa, Homo Sapiens
NAMPHIKTY

SEQ ID NO: 169173 - protein, 9 aa, Homo Sapiens
NANEMFRIF

SEQ ID NO: 169174 - protein, 9 aa, Homo Sapiens
NANLLEICY

SEQ ID NO: 169175 - protein, 9 aa, Homo Sapiens
NAQLRNINF

SEQ ID NO: 169176 - protein, 9 aa, Homo Sapiens
NASFPKVFI

SEQ ID NO: 169177 - protein, 9 aa, Homo Sapiens
NASPINRIV

SEQ ID NO: 169178 - protein, 9 aa, Homo Sapiens
NASVFGRVM

SEQ ID NO: 169179 - protein, 9 aa, Homo Sapiens
NATAFFRQH

SEQ ID NO: 169180 - protein, 9 aa, Homo Sapiens
NATAVVRHM

SEQ ID NO: 169181 - protein, 9 aa, Homo Sapiens
NATDLLRKM

SEQ ID NO: 169182 - protein, 9 aa, Homo Sapiens
NATEWVREH

SEQ ID NO: 169183 - protein, 9 aa, Homo Sapiens
NATFRILEV

SEQ ID NO: 169184 - protein, 9 aa, Homo Sapiens
NATGPRPAL

SEQ ID NO: 169185 - protein, 9 aa, Homo Sapiens
NATIMVVSV

SEQ ID NO: 169186 - protein, 9 aa, Homo Sapiens
NATIRVTNL

SEQ ID NO: 169187 - protein, 9 aa, Homo Sapiens
NATKARIPF

SEQ ID NO: 169188 - protein, 9 aa, Homo Sapiens
NATKLERVF

SEQ ID NO: 169189 - protein, 9 aa, Homo Sapiens
NATKTFREF

SEQ ID NO: 169190 - protein, 9 aa, Homo Sapiens
NATLWYKIF

SEQ ID NO: 169191 - protein, 9 aa, Homo Sapiens
NATPLTIER

SEQ ID NO: 169192 - protein, 9 aa, Homo Sapiens
NATQFIKQL

SEQ ID NO: 169193 - protein, 9 aa, Homo Sapiens
NATSLQHLL

SEQ ID NO: 169194 - protein, 9 aa, Homo Sapiens
NATSRILDM

SEQ ID NO: 169195 - protein, 9 aa, Homo Sapiens
NATVKGVNF

SEQ ID NO: 169196 - protein, 9 aa, Homo Sapiens
NAVEGLRTL

SEQ ID NO: 169197 - protein, 9 aa, Homo Sapiens
NAWHRVHVY

SEQ ID NO: 169198 - protein, 9 aa, Homo Sapiens
NFGLRTDMY

SEQ ID NO: 169199 - protein, 9 aa, Homo Sapiens
NFHWRDWTY

SEQ ID NO: 169200 - protein, 9 aa, Homo Sapiens
NFTPNLRVW

SEQ ID NO: 169201 - protein, 9 aa, Homo Sapiens
NGTYRLLEF

SEQ ID NO: 169202 - protein, 9 aa, Homo Sapiens
NIFSEVRVY

SEQ ID NO: 169203 - protein, 9 aa, Homo Sapiens
NIRLRLEEY

SEQ ID NO: 169204 - protein, 9 aa, Homo Sapiens
NIYIRRYVF

SEQ ID NO: 169205 - protein, 9 aa, Homo Sapiens
NLSIRIAAY

SEQ ID NO: 169206 - protein, 9 aa, Homo Sapiens
NLSQRVVSY

SEQ ID NO: 169207 - protein, 9 aa, Homo Sapiens
NMAEFRPEM

SEQ ID NO: 169208 - protein, 9 aa, Homo Sapiens
NMASRPLTF

SEQ ID NO: 169209 - protein, 9 aa, Homo Sapiens
NMTVRFFSF

SEQ ID NO: 169210 - protein, 9 aa, Homo Sapiens
NQTEFERVF

SEQ ID NO: 169211 - protein, 9 aa, Homo Sapiens
NRKMTYIAL

SEQ ID NO: 169212 - protein, 9 aa, Homo Sapiens
NSALRQMSY

SEQ ID NO: 169213 - protein, 9 aa, Homo Sapiens
NSANRLFQY

SEQ ID NO: 169214 - protein, 9 aa, Homo Sapiens
NSAVRTCGF

SEQ ID NO: 169215 - protein, 9 aa, Homo Sapiens
NSILRKQAF

SEQ ID NO: 169216 - protein, 9 aa, Homo Sapiens
NSLINPFIY

SEQ ID NO: 169217 - protein, 9 aa, Homo Sapiens
NSLLRENSF

SEQ ID NO: 169218 - protein, 9 aa, Homo Sapiens
NSSEKLQFY

SEQ ID NO: 169219 - protein, 9 aa, Homo Sapiens
NSTNKLFQY

SEQ ID NO: 169220 - protein, 9 aa, Homo Sapiens
NSTPWVKEV

SEQ ID NO: 169221 - protein, 9 aa, Homo Sapiens
NSTVRLYEW

SEQ ID NO: 169222 - protein, 9 aa, Homo Sapiens
NSTYIMRVL

SEQ ID NO: 169223 - protein, 9 aa, Homo Sapiens
NSYLRDQWF

SEQ ID NO: 169224 - protein, 9 aa, Homo Sapiens
NTIDPSHPM

SEQ ID NO: 169225 - protein, 9 aa, Homo Sapiens
NTLFRFWSF

SEQ ID NO: 169226 - protein, 9 aa, Homo Sapiens
NTSLPRPAL

SEQ ID NO: 169227 - protein, 9 aa, Homo Sapiens
NVRPVPLEL

SEQ ID NO: 169228 - protein, 9 aa, Homo Sapiens
PARLAVPAV

SEQ ID NO: 169229 - protein, 9 aa, Homo Sapiens
PASLRDVAY

SEQ ID NO: 169230 - protein, 9 aa, Homo Sapiens
PSVNYSKVY

SEQ ID NO: 169231 - protein, 9 aa, Homo Sapiens
QAAARLLVF

SEQ ID NO: 169232 - protein, 9 aa, Homo Sapiens
QAAAVRHVL

SEQ ID NO: 169233 - protein, 9 aa, Homo Sapiens
QAAMRLYVM

SEQ ID NO: 169234 - protein, 9 aa, Homo Sapiens
QAAPVKWIF

SEQ ID NO: 169235 - protein, 9 aa, Homo Sapiens
QAIENAHVL

SEQ ID NO: 169236 - protein, 9 aa, Homo Sapiens
QAIETARAW

SEQ ID NO: 169237 - protein, 9 aa, Homo Sapiens
QAIGAIRTL

SEQ ID NO: 169238 - protein, 9 aa, Homo Sapiens
QAITRVIPL

SEQ ID NO: 169239 - protein, 9 aa, Homo Sapiens
QALDYFLKM

SEQ ID NO: 169240 - protein, 9 aa, Homo Sapiens
QALPQVRLY

SEQ ID NO: 169241 - protein, 9 aa, Homo Sapiens
QALPWVRYI

SEQ ID NO: 169242 - protein, 9 aa, Homo Sapiens
QAMPPLFSL

SEQ ID NO: 169243 - protein, 9 aa, Homo Sapiens
QANIRLTSL

SEQ ID NO: 169244 - protein, 9 aa, Homo Sapiens
QANTIFHLF

SEQ ID NO: 169245 - protein, 9 aa, Homo Sapiens
QAQTDRVSL

SEQ ID NO: 169246 - protein, 9 aa, Homo Sapiens
QAREYVLEM

SEQ ID NO: 169247 - protein, 9 aa, Homo Sapiens
QASLKLFEM

SEQ ID NO: 169248 - protein, 9 aa, Homo Sapiens
QASWYIHKY

SEQ ID NO: 169249 - protein, 9 aa, Homo Sapiens
QATELVHQL

SEQ ID NO: 169250 - protein, 9 aa, Homo Sapiens
QATIYVHKV

SEQ ID NO: 169251 - protein, 9 aa, Homo Sapiens
QATPLLHAL

SEQ ID NO: 169252 - protein, 9 aa, Homo Sapiens
QATTAYFLY

SEQ ID NO: 169253 - protein, 9 aa, Homo Sapiens
QATTLNVAF

SEQ ID NO: 169254 - protein, 9 aa, Homo Sapiens
QATTLVHQI

SEQ ID NO: 169255 - protein, 9 aa, Homo Sapiens
QAVQVRPSL

SEQ ID NO: 169256 - protein, 9 aa, Homo Sapiens
QCSLKSVAF

SEQ ID NO: 169257 - protein, 9 aa, Homo Sapiens
QCTQVRVEF

SEQ ID NO: 169258 - protein, 9 aa, Homo Sapiens
QFALRLLAF

SEQ ID NO: 169259 - protein, 9 aa, Homo Sapiens
QIPEIKQTL

SEQ ID NO: 169260 - protein, 9 aa, Homo Sapiens
QLMLRVNEY

SEQ ID NO: 169261 - protein, 9 aa, Homo Sapiens
QLSLRTVSL

SEQ ID NO: 169262 - protein, 9 aa, Homo Sapiens
QNMERIFSF

SEQ ID NO: 169263 - protein, 9 aa, Homo Sapiens
QNVARRIEF

SEQ ID NO: 169264 - protein, 9 aa, Homo Sapiens
QQSPVRPSF

SEQ ID NO: 169265 - protein, 9 aa, Homo Sapiens
QQTLRTVAF

SEQ ID NO: 169266 - protein, 9 aa, Homo Sapiens
QSRPFFNEL

SEQ ID NO: 169267 - protein, 9 aa, Homo Sapiens
QSSSWTRVF

SEQ ID NO: 169268 - protein, 9 aa, Homo Sapiens
QSTDIIRYL

SEQ ID NO: 169269 - protein, 9 aa, Homo Sapiens
QTAPLRAEL

SEQ ID NO: 169270 - protein, 9 aa, Homo Sapiens
QTLQRSWAY

SEQ ID NO: 169271 - protein, 9 aa, Homo Sapiens
QTRGWFYTL

SEQ ID NO: 169272 - protein, 9 aa, Homo Sapiens
QTSEFIRAL

SEQ ID NO: 169273 - protein, 9 aa, Homo Sapiens
QVTEAFREF

SEQ ID NO: 169274 - protein, 9 aa, Homo Sapiens
QWSLREVVF

SEQ ID NO: 169275 - protein, 9 aa, Homo Sapiens
RAAAFFLSL

SEQ ID NO: 169276 - protein, 9 aa, Homo Sapiens
RAAEGVRAW

SEQ ID NO: 169277 - protein, 9 aa, Homo Sapiens
RAAEMEHLL

SEQ ID NO: 169278 - protein, 9 aa, Homo Sapiens
RAAEPLLTL

SEQ ID NO: 169279 - protein, 9 aa, Homo Sapiens
RAALRLLTY

SEQ ID NO: 169280 - protein, 9 aa, Homo Sapiens
RAALRVYAV

SEQ ID NO: 169281 - protein, 9 aa, Homo Sapiens
RAAPFSLEY

SEQ ID NO: 169282 - protein, 9 aa, Homo Sapiens
RAAPHRISL

SEQ ID NO: 169283 - protein, 9 aa, Homo Sapiens
RAAQFLRKM

SEQ ID NO: 169284 - protein, 9 aa, Homo Sapiens
RAIDALREF

SEQ ID NO: 169285 - protein, 9 aa, Homo Sapiens
RAIDSIHQL

SEQ ID NO: 169286 - protein, 9 aa, Homo Sapiens
RAIIRENEF

SEQ ID NO: 169287 - protein, 9 aa, Homo Sapiens
RAILRIIYF

SEQ ID NO: 169288 - protein, 9 aa, Homo Sapiens
RAIQFYLEF

SEQ ID NO: 169289 - protein, 9 aa, Homo Sapiens
RAKELFHEL

SEQ ID NO: 169290 - protein, 9 aa, Homo Sapiens
RAKNWVKEL

SEQ ID NO: 169291 - protein, 9 aa, Homo Sapiens
RALDHYLTL

SEQ ID NO: 169292 - protein, 9 aa, Homo Sapiens
RALDYALQI

SEQ ID NO: 169293 - protein, 9 aa, Homo Sapiens
RANIQAVSL

SEQ ID NO: 169294 - protein, 9 aa, Homo Sapiens
RARARPPQF

SEQ ID NO: 169295 - protein, 9 aa, Homo Sapiens
RARDLFFAL

SEQ ID NO: 169296 - protein, 9 aa, Homo Sapiens
RAREVIEAL

SEQ ID NO: 169297 - protein, 9 aa, Homo Sapiens
RASFIFISV

SEQ ID NO: 169298 - protein, 9 aa, Homo Sapiens
RASLKTAIY

SEQ ID NO: 169299 - protein, 9 aa, Homo Sapiens
RASLLLKTY

SEQ ID NO: 169300 - protein, 9 aa, Homo Sapiens
RASPFLLQY

SEQ ID NO: 169301 - protein, 9 aa, Homo Sapiens
RASWIAQVF

SEQ ID NO: 169302 - protein, 9 aa, Homo Sapiens
RATDYVFRI

SEQ ID NO: 169303 - protein, 9 aa, Homo Sapiens
RATFYLNVL

SEQ ID NO: 169304 - protein, 9 aa, Homo Sapiens
RATHRLLLL

SEQ ID NO: 169305 - protein, 9 aa, Homo Sapiens
RATKLLKAL

SEQ ID NO: 169306 - protein, 9 aa, Homo Sapiens
RATVHVRLV

SEQ ID NO: 169307 - protein, 9 aa, Homo Sapiens
RATWKSNYF

SEQ ID NO: 169308 - protein, 9 aa, Homo Sapiens
RAVEPLRTF

SEQ ID NO: 169309 - protein, 9 aa, Homo Sapiens
RAWTRLYAM

SEQ ID NO: 169310 - protein, 9 aa, Homo Sapiens
RAYAKALHY

SEQ ID NO: 169311 - protein, 9 aa, Homo Sapiens
RAYPTVKFY

SEQ ID NO: 169312 - protein, 9 aa, Homo Sapiens
RCFHKMISY

SEQ ID NO: 169313 - protein, 9 aa, Homo Sapiens
RFTEWLHEV

SEQ ID NO: 169314 - protein, 9 aa, Homo Sapiens
RFYGRDYEY

SEQ ID NO: 169315 - protein, 9 aa, Homo Sapiens
RGFFRSVFY

SEQ ID NO: 169316 - protein, 9 aa, Homo Sapiens
RGKDYFLTI

SEQ ID NO: 169317 - protein, 9 aa, Homo Sapiens
RGTDFVRTL

SEQ ID NO: 169318 - protein, 9 aa, Homo Sapiens
RGTPWLRVH

SEQ ID NO: 169319 - protein, 9 aa, Homo Sapiens
RIAEFAFEY

SEQ ID NO: 169320 - protein, 9 aa, Homo Sapiens
RISGVDRYY

SEQ ID NO: 169321 - protein, 9 aa, Homo Sapiens
RITAVRRVY

SEQ ID NO: 169322 - protein, 9 aa, Homo Sapiens
RLALRTVYY

SEQ ID NO: 169323 - protein, 9 aa, Homo Sapiens
RLFPNLPEL

SEQ ID NO: 169324 - protein, 9 aa, Homo Sapiens
RLFSRLYTY

SEQ ID NO: 169325 - protein, 9 aa, Homo Sapiens
RLFVGARIY

SEQ ID NO: 169326 - protein, 9 aa, Homo Sapiens
RLHLRPVAF

SEQ ID NO: 169327 - protein, 9 aa, Homo Sapiens
RLTDLVKEY

SEQ ID NO: 169328 - protein, 9 aa, Homo Sapiens
RLTPIDRVF

SEQ ID NO: 169329 - protein, 9 aa, Homo Sapiens
RMSGMIRLY

SEQ ID NO: 169330 - protein, 9 aa, Homo Sapiens
RNFSRYIAY

SEQ ID NO: 169331 - protein, 9 aa, Homo Sapiens
RNYYRKIGY

SEQ ID NO: 169332 - protein, 9 aa, Homo Sapiens
RPSAFRLTW

SEQ ID NO: 169333 - protein, 9 aa, Homo Sapiens
RSALPRPSL

SEQ ID NO: 169334 - protein, 9 aa, Homo Sapiens
RSFLRGLPA

SEQ ID NO: 169335 - protein, 9 aa, Homo Sapiens
RSHPFIKEY

SEQ ID NO: 169336 - protein, 9 aa, Homo Sapiens
RSILREFAF

SEQ ID NO: 169337 - protein, 9 aa, Homo Sapiens
RSMEAHNIL

SEQ ID NO: 169338 - protein, 9 aa, Homo Sapiens
RSSEYLRAL

SEQ ID NO: 169339 - protein, 9 aa, Homo Sapiens
RSSPVEYEF

SEQ ID NO: 169340 - protein, 9 aa, Homo Sapiens
RSTDSIRLL

SEQ ID NO: 169341 - protein, 9 aa, Homo Sapiens
RTTFFHHEY

SEQ ID NO: 169342 - protein, 9 aa, Homo Sapiens
RTTNLIRHF

SEQ ID NO: 169343 - protein, 9 aa, Homo Sapiens
RVRESLPEL

SEQ ID NO: 169344 - protein, 9 aa, Homo Sapiens
RVTALLKVY

SEQ ID NO: 169345 - protein, 9 aa, Homo Sapiens
RVTNWNRKL

SEQ ID NO: 169346 - protein, 9 aa, Homo Sapiens
RWPDYVREL

SEQ ID NO: 169347 - protein, 9 aa, Homo Sapiens
SAAAAPHLL

SEQ ID NO: 169348 - protein, 9 aa, Homo Sapiens
SAAAFYYVF

SEQ ID NO: 169349 - protein, 9 aa, Homo Sapiens
SAAAIFKIY

SEQ ID NO: 169350 - protein, 9 aa, Homo Sapiens
SAAELRHVM

SEQ ID NO: 169351 - protein, 9 aa, Homo Sapiens
SAAENFLVL

SEQ ID NO: 169352 - protein, 9 aa, Homo Sapiens
SAAERPLEI

SEQ ID NO: 169353 - protein, 9 aa, Homo Sapiens
SAAFAVKLF

SEQ ID NO: 169354 - protein, 9 aa, Homo Sapiens
SAALPLPVL

SEQ ID NO: 169355 - protein, 9 aa, Homo Sapiens
SAANIQPIF

SEQ ID NO: 169356 - protein, 9 aa, Homo Sapiens
SAAPLPRLA

SEQ ID NO: 169357 - protein, 9 aa, Homo Sapiens
SAAPLQPVL

SEQ ID NO: 169358 - protein, 9 aa, Homo Sapiens
SAAPPLPSL

SEQ ID NO: 169359 - protein, 9 aa, Homo Sapiens
SAAPVAHLL

SEQ ID NO: 169360 - protein, 9 aa, Homo Sapiens
SAAQPGVAF

SEQ ID NO: 169361 - protein, 9 aa, Homo Sapiens
SAAQRLTAL

SEQ ID NO: 169362 - protein, 9 aa, Homo Sapiens
SAAYLPRMW

SEQ ID NO: 169363 - protein, 9 aa, Homo Sapiens
SAAYYLNDL

SEQ ID NO: 169364 - protein, 9 aa, Homo Sapiens
SAFDRKVQF

SEQ ID NO: 169365 - protein, 9 aa, Homo Sapiens
SAFINLVEF

SEQ ID NO: 169366 - protein, 9 aa, Homo Sapiens
SAFLKTIAL

SEQ ID NO: 169367 - protein, 9 aa, Homo Sapiens
SAFLPARFY

SEQ ID NO: 169368 - protein, 9 aa, Homo Sapiens
SAFPEVRSL

SEQ ID NO: 169369 - protein, 9 aa, Homo Sapiens
SAFPFPVTV

SEQ ID NO: 169370 - protein, 9 aa, Homo Sapiens
SAFPHLRVL

SEQ ID NO: 169371 - protein, 9 aa, Homo Sapiens
SAFYRKYEL

SEQ ID NO: 169372 - protein, 9 aa, Homo Sapiens
SAGLRLFAL

SEQ ID NO: 169373 - protein, 9 aa, Homo Sapiens
SAGLRVLAL

SEQ ID NO: 169374 - protein, 9 aa, Homo Sapiens
SAGPLLRPY

SEQ ID NO: 169375 - protein, 9 aa, Homo Sapiens
SAHSHFISL

SEQ ID NO: 169376 - protein, 9 aa, Homo Sapiens
SAIASTKVM

SEQ ID NO: 169377 - protein, 9 aa, Homo Sapiens
SAIAVFLVL

SEQ ID NO: 169378 - protein, 9 aa, Homo Sapiens
SAIDFYRKF

SEQ ID NO: 169379 - protein, 9 aa, Homo Sapiens
SAIDRIFTL

SEQ ID NO: 169380 - protein, 9 aa, Homo Sapiens
SAIGYIHSL

SEQ ID NO: 169381 - protein, 9 aa, Homo Sapiens
SAILDLPVL

SEQ ID NO: 169382 - protein, 9 aa, Homo Sapiens
SAIPHPLIM

SEQ ID NO: 169383 - protein, 9 aa, Homo Sapiens
SAIQNRFKY

SEQ ID NO: 169384 - protein, 9 aa, Homo Sapiens
SAISSVRLY

SEQ ID NO: 169385 - protein, 9 aa, Homo Sapiens
SAITRPFPF

SEQ ID NO: 169386 - protein, 9 aa, Homo Sapiens
SAIYRLFDY

SEQ ID NO: 169387 - protein, 9 aa, Homo Sapiens
SAKDFEVAM

SEQ ID NO: 169388 - protein, 9 aa, Homo Sapiens
SAKDYFFKA

SEQ ID NO: 169389 - protein, 9 aa, Homo Sapiens
SAKPYAHIL

SEQ ID NO: 169390 - protein, 9 aa, Homo Sapiens
SAKTPGFSV

SEQ ID NO: 169391 - protein, 9 aa, Homo Sapiens
SAKWPLPSC

SEQ ID NO: 169392 - protein, 9 aa, Homo Sapiens
SALDMTRYW

SEQ ID NO: 169393 - protein, 9 aa, Homo Sapiens
SALEVPRLY

SEQ ID NO: 169394 - protein, 9 aa, Homo Sapiens
SALEVVRKY

SEQ ID NO: 169395 - protein, 9 aa, Homo Sapiens
SALFLGVAY

SEQ ID NO: 169396 - protein, 9 aa, Homo Sapiens
SALTRLASF

SEQ ID NO: 169397 - protein, 9 aa, Homo Sapiens
SAMEVVPAL

SEQ ID NO: 169398 - protein, 9 aa, Homo Sapiens
SAMMYIQEL

SEQ ID NO: 169399 - protein, 9 aa, Homo Sapiens
SAMPSRLMM

SEQ ID NO: 169400 - protein, 9 aa, Homo Sapiens
SAMVRVISV

SEQ ID NO: 169401 - protein, 9 aa, Homo Sapiens
SAMYSRKAM

SEQ ID NO: 169402 - protein, 9 aa, Homo Sapiens
SANDIYLIF

SEQ ID NO: 169403 - protein, 9 aa, Homo Sapiens
SANHNILQI

SEQ ID NO: 169404 - protein, 9 aa, Homo Sapiens
SANIRLTAM

SEQ ID NO: 169405 - protein, 9 aa, Homo Sapiens
SANNVYLVM

SEQ ID NO: 169406 - protein, 9 aa, Homo Sapiens
SANVRTVNL

SEQ ID NO: 169407 - protein, 9 aa, Homo Sapiens
SAPGIISAL

SEQ ID NO: 169408 - protein, 9 aa, Homo Sapiens
SAQDRFLIM

SEQ ID NO: 169409 - protein, 9 aa, Homo Sapiens
SAQDRQLTL

SEQ ID NO: 169410 - protein, 9 aa, Homo Sapiens
SAQFALRLL

SEQ ID NO: 169411 - protein, 9 aa, Homo Sapiens
SAQGKPLAL

SEQ ID NO: 169412 - protein, 9 aa, Homo Sapiens
SARDHAISL

SEQ ID NO: 169413 - protein, 9 aa, Homo Sapiens
SARFRPFTF

SEQ ID NO: 169414 - protein, 9 aa, Homo Sapiens
SARNAFFLL

SEQ ID NO: 169415 - protein, 9 aa, Homo Sapiens
SASAIRKLM

SEQ ID NO: 169416 - protein, 9 aa, Homo Sapiens
SASALAVAL

SEQ ID NO: 169417 - protein, 9 aa, Homo Sapiens
SASDYFKAM

SEQ ID NO: 169418 - protein, 9 aa, Homo Sapiens
SASEVLKEW

SEQ ID NO: 169419 - protein, 9 aa, Homo Sapiens
SASNFYRQF

SEQ ID NO: 169420 - protein, 9 aa, Homo Sapiens
SASPWALTI

SEQ ID NO: 169421 - protein, 9 aa, Homo Sapiens
SASSFFKEL

SEQ ID NO: 169422 - protein, 9 aa, Homo Sapiens
SASSLARAY

SEQ ID NO: 169423 - protein, 9 aa, Homo Sapiens
SASTVFIAL

SEQ ID NO: 169424 - protein, 9 aa, Homo Sapiens
SATALKHVF

SEQ ID NO: 169425 - protein, 9 aa, Homo Sapiens
SATAVAQLY

SEQ ID NO: 169426 - protein, 9 aa, Homo Sapiens
SATDTIRKM

SEQ ID NO: 169427 - protein, 9 aa, Homo Sapiens
SATGLARYY

SEQ ID NO: 169428 - protein, 9 aa, Homo Sapiens
SATHLNISF

SEQ ID NO: 169429 - protein, 9 aa, Homo Sapiens
SATHYVAEL

SEQ ID NO: 169430 - protein, 9 aa, Homo Sapiens
SATLRNVEL

SEQ ID NO: 169431 - protein, 9 aa, Homo Sapiens
SATLRVEDF

SEQ ID NO: 169432 - protein, 9 aa, Homo Sapiens
SATNALRSM

SEQ ID NO: 169433 - protein, 9 aa, Homo Sapiens
SATPTFLFF

SEQ ID NO: 169434 - protein, 9 aa, Homo Sapiens
SATRYIKAL

SEQ ID NO: 169435 - protein, 9 aa, Homo Sapiens
SATSLLHTV

SEQ ID NO: 169436 - protein, 9 aa, Homo Sapiens
SATTSLRVL

SEQ ID NO: 169437 - protein, 9 aa, Homo Sapiens
SATVKIIQM

SEQ ID NO: 169438 - protein, 9 aa, Homo Sapiens
SATWLALSR

SEQ ID NO: 169439 - protein, 9 aa, Homo Sapiens
SATYIAEEY

SEQ ID NO: 169440 - protein, 9 aa, Homo Sapiens
SATYRILEV

SEQ ID NO: 169441 - protein, 9 aa, Homo Sapiens
SAVAAIRTL

SEQ ID NO: 169442 - protein, 9 aa, Homo Sapiens
SAVADVRLY

SEQ ID NO: 169443 - protein, 9 aa, Homo Sapiens
SAVDFIRTL

SEQ ID NO: 169444 - protein, 9 aa, Homo Sapiens
SAVNIIRTF

SEQ ID NO: 169445 - protein, 9 aa, Homo Sapiens
SAVTNIPHV

SEQ ID NO: 169446 - protein, 9 aa, Homo Sapiens
SAVTSVRIL

SEQ ID NO: 169447 - protein, 9 aa, Homo Sapiens
SAVVHEYAL

SEQ ID NO: 169448 - protein, 9 aa, Homo Sapiens
SAWERNLVY

SEQ ID NO: 169449 - protein, 9 aa, Homo Sapiens
SAYARLIDY

SEQ ID NO: 169450 - protein, 9 aa, Homo Sapiens
SAYGSVKAY

SEQ ID NO: 169451 - protein, 9 aa, Homo Sapiens
SAYPLSVEW

SEQ ID NO: 169452 - protein, 9 aa, Homo Sapiens
SAYQRYYSL

SEQ ID NO: 169453 - protein, 9 aa, Homo Sapiens
SAYVKKIQF

SEQ ID NO: 169454 - protein, 9 aa, Homo Sapiens
SCSPFHRNL

SEQ ID NO: 169455 - protein, 9 aa, Homo Sapiens
SCYGYPIQL

SEQ ID NO: 169456 - protein, 9 aa, Homo Sapiens
SFFNRLWEV

SEQ ID NO: 169457 - protein, 9 aa, Homo Sapiens
SFFVRGQEF

SEQ ID NO: 169458 - protein, 9 aa, Homo Sapiens
SFLQRITEY

SEQ ID NO: 169459 - protein, 9 aa, Homo Sapiens
SGAPNLPVY

SEQ ID NO: 169460 - protein, 9 aa, Homo Sapiens
SGLVRLYSF

SEQ ID NO: 169461 - protein, 9 aa, Homo Sapiens
SGTVLRAML

SEQ ID NO: 169462 - protein, 9 aa, Homo Sapiens
SIIGRLLEV

SEQ ID NO: 169463 - protein, 9 aa, Homo Sapiens
SIKDYFLEF

SEQ ID NO: 169464 - protein, 9 aa, Homo Sapiens
SIPTKALEL

SEQ ID NO: 169465 - protein, 9 aa, Homo Sapiens
SISDFFRLF

SEQ ID NO: 169466 - protein, 9 aa, Homo Sapiens
SISDVFRQY

SEQ ID NO: 169467 - protein, 9 aa, Homo Sapiens
SITERYRIY

SEQ ID NO: 169468 - protein, 9 aa, Homo Sapiens
SITRLIKKY

SEQ ID NO: 169469 - protein, 9 aa, Homo Sapiens
SITSVFITK

SEQ ID NO: 169470 - protein, 9 aa, Homo Sapiens
SIVENIRIY

SEQ ID NO: 169471 - protein, 9 aa, Homo Sapiens
SIVEPKPTL

SEQ ID NO: 169472 - protein, 9 aa, Homo Sapiens
SLARMPPPL

SEQ ID NO: 169473 - protein, 9 aa, Homo Sapiens
SLFFRKVPF

SEQ ID NO: 169474 - protein, 9 aa, Homo Sapiens
SLLERLLTY

SEQ ID NO: 169475 - protein, 9 aa, Homo Sapiens
SMAGPRLEI

SEQ ID NO: 169476 - protein, 9 aa, Homo Sapiens
SMDLLGIVL

SEQ ID NO: 169477 - protein, 9 aa, Homo Sapiens
SMIFRKEPF

SEQ ID NO: 169478 - protein, 9 aa, Homo Sapiens
SMLLRLIQY

SEQ ID NO: 169479 - protein, 9 aa, Homo Sapiens
SMQVKTVAY

SEQ ID NO: 169480 - protein, 9 aa, Homo Sapiens
SNMIKTIAF

SEQ ID NO: 169481 - protein, 9 aa, Homo Sapiens
SNTIRSLSF

SEQ ID NO: 169482 - protein, 9 aa, Homo Sapiens
SNTLRPLTY

SEQ ID NO: 169483 - protein, 9 aa, Homo Sapiens
SNYAKLIEM

SEQ ID NO: 169484 - protein, 9 aa, Homo Sapiens
SPNAEIHIL

SEQ ID NO: 169485 - protein, 9 aa, Homo Sapiens
SQAPQRLSF

SEQ ID NO: 169486 - protein, 9 aa, Homo Sapiens
SQQYRPYSF

SEQ ID NO: 169487 - protein, 9 aa, Homo Sapiens
SQSLRILCY

SEQ ID NO: 169488 - protein, 9 aa, Homo Sapiens
SQSLRVDSF

SEQ ID NO: 169489 - protein, 9 aa, Homo Sapiens
SQTPVLREL

SEQ ID NO: 169490 - protein, 9 aa, Homo Sapiens
SSAFAAFVK

SEQ ID NO: 169491 - protein, 9 aa, Homo Sapiens
SSAFTNRIF

SEQ ID NO: 169492 - protein, 9 aa, Homo Sapiens
SSAPPRTAF

SEQ ID NO: 169493 - protein, 9 aa, Homo Sapiens
SSAPTARVF

SEQ ID NO: 169494 - protein, 9 aa, Homo Sapiens
SSAPVPKVM

SEQ ID NO: 169495 - protein, 9 aa, Homo Sapiens
SSASLVLKR

SEQ ID NO: 169496 - protein, 9 aa, Homo Sapiens
SSAVRALEL

SEQ ID NO: 169497 - protein, 9 aa, Homo Sapiens
SSMVRDWVM

SEQ ID NO: 169498 - protein, 9 aa, Homo Sapiens
SSQGTVRFF

SEQ ID NO: 169499 - protein, 9 aa, Homo Sapiens
SSSAVFLII

SEQ ID NO: 169500 - protein, 9 aa, Homo Sapiens
SSSIKTVYF

SEQ ID NO: 169501 - protein, 9 aa, Homo Sapiens
SSSLRSIAL

SEQ ID NO: 169502 - protein, 9 aa, Homo Sapiens
SSSLRVLVY

SEQ ID NO: 169503 - protein, 9 aa, Homo Sapiens
SSSYREAVF

SEQ ID NO: 169504 - protein, 9 aa, Homo Sapiens
SSTPVVLVR

SEQ ID NO: 169505 - protein, 9 aa, Homo Sapiens
SSVEVRMEF

SEQ ID NO: 169506 - protein, 9 aa, Homo Sapiens
SSVPGVRLL

SEQ ID NO: 169507 - protein, 9 aa, Homo Sapiens
STAIREISL

SEQ ID NO: 169508 - protein, 9 aa, Homo Sapiens
STMLRLYEF

SEQ ID NO: 169509 - protein, 9 aa, Homo Sapiens
STSDVVRQY

SEQ ID NO: 169510 - protein, 9 aa, Homo Sapiens
STSKWNHLL

SEQ ID NO: 169511 - protein, 9 aa, Homo Sapiens
SVAVRVLSY

SEQ ID NO: 169512 - protein, 9 aa, Homo Sapiens
SVRPVPLEV

SEQ ID NO: 169513 - protein, 9 aa, Homo Sapiens
SVSPLQRIY

SEQ ID NO: 169514 - protein, 9 aa, Homo Sapiens
SVSPVVRVA

SEQ ID NO: 169515 - protein, 9 aa, Homo Sapiens
SVSTITRIY

SEQ ID NO: 169516 - protein, 9 aa, Homo Sapiens
SVTELDRVY

SEQ ID NO: 169517 - protein, 9 aa, Homo Sapiens
SVTGVHRLY

SEQ ID NO: 169518 - protein, 9 aa, Homo Sapiens
SVTISFRIY

SEQ ID NO: 169519 - protein, 9 aa, Homo Sapiens
SVVFHSTVI

SEQ ID NO: 169520 - protein, 9 aa, Homo Sapiens
TAADIFKQY

SEQ ID NO: 169521 - protein, 9 aa, Homo Sapiens
TAAFWTRLY

SEQ ID NO: 169522 - protein, 9 aa, Homo Sapiens
TAANVYHLL

SEQ ID NO: 169523 - protein, 9 aa, Homo Sapiens
TAAPGRFSF

SEQ ID NO: 169524 - protein, 9 aa, Homo Sapiens
TAAQVARVL

SEQ ID NO: 169525 - protein, 9 aa, Homo Sapiens
TAASLFKEM

SEQ ID NO: 169526 - protein, 9 aa, Homo Sapiens
TAIELIPSV

SEQ ID NO: 169527 - protein, 9 aa, Homo Sapiens
TAIESTPTL

SEQ ID NO: 169528 - protein, 9 aa, Homo Sapiens
TAISLFYEL

SEQ ID NO: 169529 - protein, 9 aa, Homo Sapiens
TALRRGPLL

SEQ ID NO: 169530 - protein, 9 aa, Homo Sapiens
TAMDWFIAV

SEQ ID NO: 169531 - protein, 9 aa, Homo Sapiens
TAQTLVRIL

SEQ ID NO: 169532 - protein, 9 aa, Homo Sapiens
TARDYYTFL

SEQ ID NO: 169533 - protein, 9 aa, Homo Sapiens
TASDKILIV

SEQ ID NO: 169534 - protein, 9 aa, Homo Sapiens
TASEMILVL

SEQ ID NO: 169535 - protein, 9 aa, Homo Sapiens
TASEWERFI

SEQ ID NO: 169536 - protein, 9 aa, Homo Sapiens
TASNPKPYM

SEQ ID NO: 169537 - protein, 9 aa, Homo Sapiens
TASNTFRVV

SEQ ID NO: 169538 - protein, 9 aa, Homo Sapiens
TASNWLHLI

SEQ ID NO: 169539 - protein, 9 aa, Homo Sapiens
TASPFFRAL

SEQ ID NO: 169540 - protein, 9 aa, Homo Sapiens
TASPLVKSV

SEQ ID NO: 169541 - protein, 9 aa, Homo Sapiens
TASPVAVSL

SEQ ID NO: 169542 - protein, 9 aa, Homo Sapiens
TASPVIKAV

SEQ ID NO: 169543 - protein, 9 aa, Homo Sapiens
TASQRFIEL

SEQ ID NO: 169544 - protein, 9 aa, Homo Sapiens
TASRVIREL

SEQ ID NO: 169545 - protein, 9 aa, Homo Sapiens
TATALAIIY

SEQ ID NO: 169546 - protein, 9 aa, Homo Sapiens
TATDIRVAF

SEQ ID NO: 169547 - protein, 9 aa, Homo Sapiens
TATGFSHVL

SEQ ID NO: 169548 - protein, 9 aa, Homo Sapiens
TATHFPRVY

SEQ ID NO: 169549 - protein, 9 aa, Homo Sapiens
TATMHILVV

SEQ ID NO: 169550 - protein, 9 aa, Homo Sapiens
TATQAIRIF

SEQ ID NO: 169551 - protein, 9 aa, Homo Sapiens
TATQLLKLA

SEQ ID NO: 169552 - protein, 9 aa, Homo Sapiens
TATVRSVHF

SEQ ID NO: 169553 - protein, 9 aa, Homo Sapiens
TAVALLRLL

SEQ ID NO: 169554 - protein, 9 aa, Homo Sapiens
TAVENMPSL

SEQ ID NO: 169555 - protein, 9 aa, Homo Sapiens
TAVMPKVSL

SEQ ID NO: 169556 - protein, 9 aa, Homo Sapiens
TAVVKFIDY

SEQ ID NO: 169557 - protein, 9 aa, Homo Sapiens
TAVWLPRYY

SEQ ID NO: 169558 - protein, 9 aa, Homo Sapiens
TCTLKLLEY

SEQ ID NO: 169559 - protein, 9 aa, Homo Sapiens
TFALRYLNF

SEQ ID NO: 169560 - protein, 9 aa, Homo Sapiens
TFDLLRNSY

SEQ ID NO: 169561 - protein, 9 aa, Homo Sapiens
TFFQRAVYL

SEQ ID NO: 169562 - protein, 9 aa, Homo Sapiens
TFFSRGLSF

SEQ ID NO: 169563 - protein, 9 aa, Homo Sapiens
TFGERVVAF

SEQ ID NO: 169564 - protein, 9 aa, Homo Sapiens
TFHQRGIAL

SEQ ID NO: 169565 - protein, 9 aa, Homo Sapiens
TFIDPRIPL

SEQ ID NO: 169566 - protein, 9 aa, Homo Sapiens
TFMEKLYPY

SEQ ID NO: 169567 - protein, 9 aa, Homo Sapiens
TFNLRPNEF

SEQ ID NO: 169568 - protein, 9 aa, Homo Sapiens
TFQLRGLEF

SEQ ID NO: 169569 - protein, 9 aa, Homo Sapiens
TFSQRKVEF

SEQ ID NO: 169570 - protein, 9 aa, Homo Sapiens
TFTERMMAY

SEQ ID NO: 169571 - protein, 9 aa, Homo Sapiens
TGMVRETVF

SEQ ID NO: 169572 - protein, 9 aa, Homo Sapiens
TIREFFILL

SEQ ID NO: 169573 - protein, 9 aa, Homo Sapiens
TITDQIRLW

SEQ ID NO: 169574 - protein, 9 aa, Homo Sapiens
TITEPYRTL

SEQ ID NO: 169575 - protein, 9 aa, Homo Sapiens
TITQVIKVL

SEQ ID NO: 169576 - protein, 9 aa, Homo Sapiens
TITSYIKEM

SEQ ID NO: 169577 - protein, 9 aa, Homo Sapiens
TLLERLFSY

SEQ ID NO: 169578 - protein, 9 aa, Homo Sapiens
TLNERFTSY

SEQ ID NO: 169579 - protein, 9 aa, Homo Sapiens
TLQERLLAF

SEQ ID NO: 169580 - protein, 9 aa, Homo Sapiens
TLTALVRYY

SEQ ID NO: 169581 - protein, 9 aa, Homo Sapiens
TLTDVAHEY

SEQ ID NO: 169582 - protein, 9 aa, Homo Sapiens
TMPDTPRLF

SEQ ID NO: 169583 - protein, 9 aa, Homo Sapiens
TNTLRILAL

SEQ ID NO: 169584 - protein, 9 aa, Homo Sapiens
TQAVRAVAF

SEQ ID NO: 169585 - protein, 9 aa, Homo Sapiens
TSFERALSL

SEQ ID NO: 169586 - protein, 9 aa, Homo Sapiens
TSFERMLSL

SEQ ID NO: 169587 - protein, 9 aa, Homo Sapiens
TSFIRTIEL

SEQ ID NO: 169588 - protein, 9 aa, Homo Sapiens
TSPEAFLAL

SEQ ID NO: 169589 - protein, 9 aa, Homo Sapiens
TSQFRPVEL

SEQ ID NO: 169590 - protein, 9 aa, Homo Sapiens
TSSFQPVSM

SEQ ID NO: 169591 - protein, 9 aa, Homo Sapiens
TSSLPKYPL

SEQ ID NO: 169592 - protein, 9 aa, Homo Sapiens
TSSLRSVCF

SEQ ID NO: 169593 - protein, 9 aa, Homo Sapiens
TSSPPRLAM

SEQ ID NO: 169594 - protein, 9 aa, Homo Sapiens
TSSTRFLVF

SEQ ID NO: 169595 - protein, 9 aa, Homo Sapiens
TSSWVIRDL

SEQ ID NO: 169596 - protein, 9 aa, Homo Sapiens
TSTGVIRDF

SEQ ID NO: 169597 - protein, 9 aa, Homo Sapiens
TSYVRPVKF

SEQ ID NO: 169598 - protein, 9 aa, Homo Sapiens
TTRDYYFAL

SEQ ID NO: 169599 - protein, 9 aa, Homo Sapiens
TTSERIIAY

SEQ ID NO: 169600 - protein, 9 aa, Homo Sapiens
TTSLRVLAL

SEQ ID NO: 169601 - protein, 9 aa, Homo Sapiens
TTSWIHPVM

SEQ ID NO: 169602 - protein, 9 aa, Homo Sapiens
TTTNRDIAF

SEQ ID NO: 169603 - protein, 9 aa, Homo Sapiens
TTTSLLRSL

SEQ ID NO: 169604 - protein, 9 aa, Homo Sapiens
TTTSSSRIF

SEQ ID NO: 169605 - protein, 9 aa, Homo Sapiens
TTTTEHRFF

SEQ ID NO: 169606 - protein, 9 aa, Homo Sapiens
TVALRAAAY

SEQ ID NO: 169607 - protein, 9 aa, Homo Sapiens
TVALRGYAF

SEQ ID NO: 169608 - protein, 9 aa, Homo Sapiens
TVFLRSDSY

SEQ ID NO: 169609 - protein, 9 aa, Homo Sapiens
TVSEWLRLL

SEQ ID NO: 169610 - protein, 9 aa, Homo Sapiens
TVTDVVRFI

SEQ ID NO: 169611 - protein, 9 aa, Homo Sapiens
TVTSYLKLL

SEQ ID NO: 169612 - protein, 9 aa, Homo Sapiens
TVTTVILEV

SEQ ID NO: 169613 - protein, 9 aa, Homo Sapiens
TVWAYFRVM

SEQ ID NO: 169614 - protein, 9 aa, Homo Sapiens
TVYLRDIAL

SEQ ID NO: 169615 - protein, 9 aa, Homo Sapiens
TYGERVVAF

SEQ ID NO: 169616 - protein, 9 aa, Homo Sapiens
VAAALARLL

SEQ ID NO: 169617 - protein, 9 aa, Homo Sapiens
VAAKKNVSI

SEQ ID NO: 169618 - protein, 9 aa, Homo Sapiens
VAALLTRTF

SEQ ID NO: 169619 - protein, 9 aa, Homo Sapiens
VAAMQPRML

SEQ ID NO: 169620 - protein, 9 aa, Homo Sapiens
VAAPKHWML

SEQ ID NO: 169621 - protein, 9 aa, Homo Sapiens
VAAPQLPVL

SEQ ID NO: 169622 - protein, 9 aa, Homo Sapiens
VAASLVREF

SEQ ID NO: 169623 - protein, 9 aa, Homo Sapiens
VAATLLKQL

SEQ ID NO: 169624 - protein, 9 aa, Homo Sapiens
VAATRWWQL

SEQ ID NO: 169625 - protein, 9 aa, Homo Sapiens
VAAVGNRLY

SEQ ID NO: 169626 - protein, 9 aa, Homo Sapiens
VAAVLVKKY

SEQ ID NO: 169627 - protein, 9 aa, Homo Sapiens
VAAVRAAAW

SEQ ID NO: 169628 - protein, 9 aa, Homo Sapiens
VAAVREFYL

SEQ ID NO: 169629 - protein, 9 aa, Homo Sapiens
VAAWLKKIF

SEQ ID NO: 169630 - protein, 9 aa, Homo Sapiens
VACPPPPAY

SEQ ID NO: 169631 - protein, 9 aa, Homo Sapiens
VAFFRENGF

SEQ ID NO: 169632 - protein, 9 aa, Homo Sapiens
VAFLRLEDF

SEQ ID NO: 169633 - protein, 9 aa, Homo Sapiens
VAIAAARVW

SEQ ID NO: 169634 - protein, 9 aa, Homo Sapiens
VAIAGLMEV

SEQ ID NO: 169635 - protein, 9 aa, Homo Sapiens
VAIAKVKLY

SEQ ID NO: 169636 - protein, 9 aa, Homo Sapiens
VAIDRGLAF

SEQ ID NO: 169637 - protein, 9 aa, Homo Sapiens
VAIESTPMI

SEQ ID NO: 169638 - protein, 9 aa, Homo Sapiens
VAIPLKYEV

SEQ ID NO: 169639 - protein, 9 aa, Homo Sapiens
VAISPWKTY

SEQ ID NO: 169640 - protein, 9 aa, Homo Sapiens
VAIVKALYY

SEQ ID NO: 169641 - protein, 9 aa, Homo Sapiens
VAIWGRVVF

SEQ ID NO: 169642 - protein, 9 aa, Homo Sapiens
VAKAVTQAL

SEQ ID NO: 169643 - protein, 9 aa, Homo Sapiens
VAKDYPFYL

SEQ ID NO: 169644 - protein, 9 aa, Homo Sapiens
VAKDYVRLM

SEQ ID NO: 169645 - protein, 9 aa, Homo Sapiens
VAKEIIYTL

SEQ ID NO: 169646 - protein, 9 aa, Homo Sapiens
VAKMYISEL

SEQ ID NO: 169647 - protein, 9 aa, Homo Sapiens
VAKPIPEEL

SEQ ID NO: 169648 - protein, 9 aa, Homo Sapiens
VAKPNFVVM

SEQ ID NO: 169649 - protein, 9 aa, Homo Sapiens
VALDFEQEM

SEQ ID NO: 169650 - protein, 9 aa, Homo Sapiens
VALGNMYEL

SEQ ID NO: 169651 - protein, 9 aa, Homo Sapiens
VALLRLLLL

SEQ ID NO: 169652 - protein, 9 aa, Homo Sapiens
VALLRVTPF

SEQ ID NO: 169653 - protein, 9 aa, Homo Sapiens
VALPMVLVL

SEQ ID NO: 169654 - protein, 9 aa, Homo Sapiens
VALPPGLAV

SEQ ID NO: 169655 - protein, 9 aa, Homo Sapiens
VALPVFLVI

SEQ ID NO: 169656 - protein, 9 aa, Homo Sapiens
VALPYFWEH

SEQ ID NO: 169657 - protein, 9 aa, Homo Sapiens
VALYNPVSF

SEQ ID NO: 169658 - protein, 9 aa, Homo Sapiens
VAMIYPLEY

SEQ ID NO: 169659 - protein, 9 aa, Homo Sapiens
VAMKFAQVF

SEQ ID NO: 169660 - protein, 9 aa, Homo Sapiens
VAMPGVPAF

SEQ ID NO: 169661 - protein, 9 aa, Homo Sapiens
VAMPYQWEY

SEQ ID NO: 169662 - protein, 9 aa, Homo Sapiens
VAMYGGLVL

SEQ ID NO: 169663 - protein, 9 aa, Homo Sapiens
VANAIIHLF

SEQ ID NO: 169664 - protein, 9 aa, Homo Sapiens
VANDYARQL

SEQ ID NO: 169665 - protein, 9 aa, Homo Sapiens
VANPAFLKY

SEQ ID NO: 169666 - protein, 9 aa, Homo Sapiens
VANPEHMEM

SEQ ID NO: 169667 - protein, 9 aa, Homo Sapiens
VANPNSAIF

SEQ ID NO: 169668 - protein, 9 aa, Homo Sapiens
VANPRLDTF

SEQ ID NO: 169669 - protein, 9 aa, Homo Sapiens
VANPSHLEA

SEQ ID NO: 169670 - protein, 9 aa, Homo Sapiens
VANTMRTSL

SEQ ID NO: 169671 - protein, 9 aa, Homo Sapiens
VANVFLEAY

SEQ ID NO: 169672 - protein, 9 aa, Homo Sapiens
VANVSLLAL

SEQ ID NO: 169673 - protein, 9 aa, Homo Sapiens
VAPEEHPVL

SEQ ID NO: 169674 - protein, 9 aa, Homo Sapiens
VAQITQRFY

SEQ ID NO: 169675 - protein, 9 aa, Homo Sapiens
VAQPVPLLM

SEQ ID NO: 169676 - protein, 9 aa, Homo Sapiens
VAQTWFRFL

SEQ ID NO: 169677 - protein, 9 aa, Homo Sapiens
VAQYRPEEY

SEQ ID NO: 169678 - protein, 9 aa, Homo Sapiens
VARDLRAEF

SEQ ID NO: 169679 - protein, 9 aa, Homo Sapiens
VAREWFFLI

SEQ ID NO: 169680 - protein, 9 aa, Homo Sapiens
VARLLEVPV

SEQ ID NO: 169681 - protein, 9 aa, Homo Sapiens
VARPAPVAV

SEQ ID NO: 169682 - protein, 9 aa, Homo Sapiens
VARPDVVEM

SEQ ID NO: 169683 - protein, 9 aa, Homo Sapiens
VARPPNIVL

SEQ ID NO: 169684 - protein, 9 aa, Homo Sapiens
VARSNILTL

SEQ ID NO: 169685 - protein, 9 aa, Homo Sapiens
VARVESLEM

SEQ ID NO: 169686 - protein, 9 aa, Homo Sapiens
VASALWRHF

SEQ ID NO: 169687 - protein, 9 aa, Homo Sapiens
VASEVYKAV

SEQ ID NO: 169688 - protein, 9 aa, Homo Sapiens
VASFPRTVL

SEQ ID NO: 169689 - protein, 9 aa, Homo Sapiens
VASFRSKAY

SEQ ID NO: 169690 - protein, 9 aa, Homo Sapiens
VASFSKRFF

SEQ ID NO: 169691 - protein, 9 aa, Homo Sapiens
VASGMILVM

SEQ ID NO: 169692 - protein, 9 aa, Homo Sapiens
VASIRLFGF

SEQ ID NO: 169693 - protein, 9 aa, Homo Sapiens
VASKILKTF

SEQ ID NO: 169694 - protein, 9 aa, Homo Sapiens
VASMTVREL

SEQ ID NO: 169695 - protein, 9 aa, Homo Sapiens
VASNVPKVV

SEQ ID NO: 169696 - protein, 9 aa, Homo Sapiens
VASPALRAV

SEQ ID NO: 169697 - protein, 9 aa, Homo Sapiens
VASPQVHFI

SEQ ID NO: 169698 - protein, 9 aa, Homo Sapiens
VASQLPRIF

SEQ ID NO: 169699 - protein, 9 aa, Homo Sapiens
VASVGHGVF

SEQ ID NO: 169700 - protein, 9 aa, Homo Sapiens
VASVPKELY

SEQ ID NO: 169701 - protein, 9 aa, Homo Sapiens
VASVRPAVL

SEQ ID NO: 169702 - protein, 9 aa, Homo Sapiens
VATAMARVL

SEQ ID NO: 169703 - protein, 9 aa, Homo Sapiens
VATAQGRYY

SEQ ID NO: 169704 - protein, 9 aa, Homo Sapiens
VATEKAVEL

SEQ ID NO: 169705 - protein, 9 aa, Homo Sapiens
VATEVLMWF

SEQ ID NO: 169706 - protein, 9 aa, Homo Sapiens
VATFFAKML

SEQ ID NO: 169707 - protein, 9 aa, Homo Sapiens
VATIKSVSF

SEQ ID NO: 169708 - protein, 9 aa, Homo Sapiens
VATNLLKLF

SEQ ID NO: 169709 - protein, 9 aa, Homo Sapiens
VATPVLIPK

SEQ ID NO: 169710 - protein, 9 aa, Homo Sapiens
VATQVGIEW

SEQ ID NO: 169711 - protein, 9 aa, Homo Sapiens
VATSFIRTI

SEQ ID NO: 169712 - protein, 9 aa, Homo Sapiens
VATSPGRLF

SEQ ID NO: 169713 - protein, 9 aa, Homo Sapiens
VATSRIIKY

SEQ ID NO: 169714 - protein, 9 aa, Homo Sapiens
VATTFTHSY

SEQ ID NO: 169715 - protein, 9 aa, Homo Sapiens
VATTRDYYF

SEQ ID NO: 169716 - protein, 9 aa, Homo Sapiens
VATTRIETM

SEQ ID NO: 169717 - protein, 9 aa, Homo Sapiens
VATVQISSL

SEQ ID NO: 169718 - protein, 9 aa, Homo Sapiens
VATWFNQPA

SEQ ID NO: 169719 - protein, 9 aa, Homo Sapiens
VAVDVAVPK

SEQ ID NO: 169720 - protein, 9 aa, Homo Sapiens
VAVGRALYY

SEQ ID NO: 169721 - protein, 9 aa, Homo Sapiens
VAVHYYRLY

SEQ ID NO: 169722 - protein, 9 aa, Homo Sapiens
VAVILMRVL

SEQ ID NO: 169723 - protein, 9 aa, Homo Sapiens
VAVLRAYNY

SEQ ID NO: 169724 - protein, 9 aa, Homo Sapiens
VAVMTVREL

SEQ ID NO: 169725 - protein, 9 aa, Homo Sapiens
VAVNKPAEF

SEQ ID NO: 169726 - protein, 9 aa, Homo Sapiens
VAVNYIPEV

SEQ ID NO: 169727 - protein, 9 aa, Homo Sapiens
VAVVKGLTY

SEQ ID NO: 169728 - protein, 9 aa, Homo Sapiens
VAVWEGRIY

SEQ ID NO: 169729 - protein, 9 aa, Homo Sapiens
VAVWNGRQV

SEQ ID NO: 169730 - protein, 9 aa, Homo Sapiens
VAWNPSPAV

SEQ ID NO: 169731 - protein, 9 aa, Homo Sapiens
VAWPNPREI

SEQ ID NO: 169732 - protein, 9 aa, Homo Sapiens
VAYLRFLEL

SEQ ID NO: 169733 - protein, 9 aa, Homo Sapiens
VAYMNPIAM

SEQ ID NO: 169734 - protein, 9 aa, Homo Sapiens
VAYVSSVAL

SEQ ID NO: 169735 - protein, 9 aa, Homo Sapiens
VAYWRQAGL

SEQ ID NO: 169736 - protein, 9 aa, Homo Sapiens
VCTFVYKEF

SEQ ID NO: 169737 - protein, 9 aa, Homo Sapiens
VFALRPVGF

SEQ ID NO: 169738 - protein, 9 aa, Homo Sapiens
VFFSRGSSF

SEQ ID NO: 169739 - protein, 9 aa, Homo Sapiens
VFGIRYDDY

SEQ ID NO: 169740 - protein, 9 aa, Homo Sapiens
VFHDRRLQY

SEQ ID NO: 169741 - protein, 9 aa, Homo Sapiens
VFQLRDSVY

SEQ ID NO: 169742 - protein, 9 aa, Homo Sapiens
VFQYRLVEY

SEQ ID NO: 169743 - protein, 9 aa, Homo Sapiens
VFSFKMVSY

SEQ ID NO: 169744 - protein, 9 aa, Homo Sapiens
VFSHRLSVY

SEQ ID NO: 169745 - protein, 9 aa, Homo Sapiens
VFSVRGTSF

SEQ ID NO: 169746 - protein, 9 aa, Homo Sapiens
VGAALRPAF

SEQ ID NO: 169747 - protein, 9 aa, Homo Sapiens
VGAIRNAAF

SEQ ID NO: 169748 - protein, 9 aa, Homo Sapiens
VGFNRLLEY

SEQ ID NO: 169749 - protein, 9 aa, Homo Sapiens
VGGVQPVSI

SEQ ID NO: 169750 - protein, 9 aa, Homo Sapiens
VGSFRSNSF

SEQ ID NO: 169751 - protein, 9 aa, Homo Sapiens
VGTKSTRFF

SEQ ID NO: 169752 - protein, 9 aa, Homo Sapiens
VIGDVIRVY

SEQ ID NO: 169753 - protein, 9 aa, Homo Sapiens
VIIDDHPEV

SEQ ID NO: 169754 - protein, 9 aa, Homo Sapiens
VIIDDRHVY

SEQ ID NO: 169755 - protein, 9 aa, Homo Sapiens
VINGNIKTV

SEQ ID NO: 169756 - protein, 9 aa, Homo Sapiens
VIPTNVPEL

SEQ ID NO: 169757 - protein, 9 aa, Homo Sapiens
VLAIRQQSF

SEQ ID NO: 169758 - protein, 9 aa, Homo Sapiens
VLAIRYDAF

SEQ ID NO: 169759 - protein, 9 aa, Homo Sapiens
VLALRPWSF

SEQ ID NO: 169760 - protein, 9 aa, Homo Sapiens
VLFLRTFQF

SEQ ID NO: 169761 - protein, 9 aa, Homo Sapiens
VLMERLCKY

SEQ ID NO: 169762 - protein, 9 aa, Homo Sapiens
VLQAPLPPM

SEQ ID NO: 169763 - protein, 9 aa, Homo Sapiens
VLQLRVHTF

SEQ ID NO: 169764 - protein, 9 aa, Homo Sapiens
VLQQRLIAL

SEQ ID NO: 169765 - protein, 9 aa, Homo Sapiens
VLRQPRPAL

SEQ ID NO: 169766 - protein, 9 aa, Homo Sapiens
VNALRPFYF

SEQ ID NO: 169767 - protein, 9 aa, Homo Sapiens
VNIMRTYTY

SEQ ID NO: 169768 - protein, 9 aa, Homo Sapiens
VNNPHFLIM

SEQ ID NO: 169769 - protein, 9 aa, Homo Sapiens
VNTEKLTAF

SEQ ID NO: 169770 - protein, 9 aa, Homo Sapiens
VQAIRITSY

SEQ ID NO: 169771 - protein, 9 aa, Homo Sapiens
VQALRTVSL

SEQ ID NO: 169772 - protein, 9 aa, Homo Sapiens
VQMQREWSF

SEQ ID NO: 169773 - protein, 9 aa, Homo Sapiens
VSALFSRIF

SEQ ID NO: 169774 - protein, 9 aa, Homo Sapiens
VSAPLRLQA

SEQ ID NO: 169775 - protein, 9 aa, Homo Sapiens
VSAPPMPSV

SEQ ID NO: 169776 - protein, 9 aa, Homo Sapiens
VSASLPRSY

SEQ ID NO: 169777 - protein, 9 aa, Homo Sapiens
VSGPGRPEL

SEQ ID NO: 169778 - protein, 9 aa, Homo Sapiens
VSHVRKLVF

SEQ ID NO: 169779 - protein, 9 aa, Homo Sapiens
VSLLREVQY

SEQ ID NO: 169780 - protein, 9 aa, Homo Sapiens
VSLLRLYQY

SEQ ID NO: 169781 - protein, 9 aa, Homo Sapiens
VSLLRVLEM

SEQ ID NO: 169782 - protein, 9 aa, Homo Sapiens
VSLVASRVI

SEQ ID NO: 169783 - protein, 9 aa, Homo Sapiens
VSNFKPGVY

SEQ ID NO: 169784 - protein, 9 aa, Homo Sapiens
VSNVKPLSL

SEQ ID NO: 169785 - protein, 9 aa, Homo Sapiens
VSRPLFLVL

SEQ ID NO: 169786 - protein, 9 aa, Homo Sapiens
VSSFRPNEF

SEQ ID NO: 169787 - protein, 9 aa, Homo Sapiens
VSSFVLRAM

SEQ ID NO: 169788 - protein, 9 aa, Homo Sapiens
VSSGVQRVL

SEQ ID NO: 169789 - protein, 9 aa, Homo Sapiens
VSSHVERVF

SEQ ID NO: 169790 - protein, 9 aa, Homo Sapiens
VSSTKLVSF

SEQ ID NO: 169791 - protein, 9 aa, Homo Sapiens
VSSTWDRQF

SEQ ID NO: 169792 - protein, 9 aa, Homo Sapiens
VSSTWLRDF

SEQ ID NO: 169793 - protein, 9 aa, Homo Sapiens
VSSVRWISY

SEQ ID NO: 169794 - protein, 9 aa, Homo Sapiens
VSTDVIRRV

SEQ ID NO: 169795 - protein, 9 aa, Homo Sapiens
VSTHVSQIF

SEQ ID NO: 169796 - protein, 9 aa, Homo Sapiens
VSTLWLHLL

SEQ ID NO: 169797 - protein, 9 aa, Homo Sapiens
VSTPFHEIM

SEQ ID NO: 169798 - protein, 9 aa, Homo Sapiens
VSTPISEVY

SEQ ID NO: 169799 - protein, 9 aa, Homo Sapiens
VSTPQRPPL

SEQ ID NO: 169800 - protein, 9 aa, Homo Sapiens
VSTPRSSFY

SEQ ID NO: 169801 - protein, 9 aa, Homo Sapiens
VSTSYIKVW

SEQ ID NO: 169802 - protein, 9 aa, Homo Sapiens
VSTVLTSKY

SEQ ID NO: 169803 - protein, 9 aa, Homo Sapiens
VSTWRPVEL

SEQ ID NO: 169804 - protein, 9 aa, Homo Sapiens
VSVDTARTL

SEQ ID NO: 169805 - protein, 9 aa, Homo Sapiens
VSVTHRPPL

SEQ ID NO: 169806 - protein, 9 aa, Homo Sapiens
VSYLRAKSF

SEQ ID NO: 169807 - protein, 9 aa, Homo Sapiens
VSYLRPLDF

SEQ ID NO: 169808 - protein, 9 aa, Homo Sapiens
VSYLRVKSF

SEQ ID NO: 169809 - protein, 9 aa, Homo Sapiens
VSYVRSVYL

SEQ ID NO: 169810 - protein, 9 aa, Homo Sapiens
VTAGVRLAM

SEQ ID NO: 169811 - protein, 9 aa, Homo Sapiens
VTIVKPIVY

SEQ ID NO: 169812 - protein, 9 aa, Homo Sapiens
VTKEFFLLL

SEQ ID NO: 169813 - protein, 9 aa, Homo Sapiens
VTQLRLIFY

SEQ ID NO: 169814 - protein, 9 aa, Homo Sapiens
VTSDGRYVF

SEQ ID NO: 169815 - protein, 9 aa, Homo Sapiens
VTSELLRLL

SEQ ID NO: 169816 - protein, 9 aa, Homo Sapiens
VTSEVNRLL

SEQ ID NO: 169817 - protein, 9 aa, Homo Sapiens
VTSFRFVYF

SEQ ID NO: 169818 - protein, 9 aa, Homo Sapiens
VTSGKIIEY

SEQ ID NO: 169819 - protein, 9 aa, Homo Sapiens
VTSPIRASY

SEQ ID NO: 169820 - protein, 9 aa, Homo Sapiens
VTSPLTVEW

SEQ ID NO: 169821 - protein, 9 aa, Homo Sapiens
VTTGLLTYL

SEQ ID NO: 169822 - protein, 9 aa, Homo Sapiens
VTTTWERLY

SEQ ID NO: 169823 - protein, 9 aa, Homo Sapiens
VVIDPTRTI

SEQ ID NO: 169824 - protein, 9 aa, Homo Sapiens
VVIDPYLVY

SEQ ID NO: 169825 - protein, 9 aa, Homo Sapiens
VVSDAIFEL

SEQ ID NO: 169826 - protein, 9 aa, Homo Sapiens
VVSPPKFVF

SEQ ID NO: 169827 - protein, 9 aa, Homo Sapiens
VVSVPQRIM

SEQ ID NO: 169828 - protein, 9 aa, Homo Sapiens
VWFDRRTNY

SEQ ID NO: 169829 - protein, 9 aa, Homo Sapiens
VWKLRIVSY

SEQ ID NO: 169830 - protein, 9 aa, Homo Sapiens
VWNMRLVFF

SEQ ID NO: 169831 - protein, 9 aa, Homo Sapiens
VWWYRPFQY

SEQ ID NO: 169832 - protein, 9 aa, Homo Sapiens
WAAPIRKLY

SEQ ID NO: 169833 - protein, 9 aa, Homo Sapiens
WAMDLRPEL

SEQ ID NO: 169834 - protein, 9 aa, Homo Sapiens
YAAAQLRQY

SEQ ID NO: 169835 - protein, 9 aa, Homo Sapiens
YAAFKRWHF

SEQ ID NO: 169836 - protein, 9 aa, Homo Sapiens
YAAGAKLVL

SEQ ID NO: 169837 - protein, 9 aa, Homo Sapiens
YAAIQENAL

SEQ ID NO: 169838 - protein, 9 aa, Homo Sapiens
YAAIRDNYF

SEQ ID NO: 169839 - protein, 9 aa, Homo Sapiens
YAAIRYDTV

SEQ ID NO: 169840 - protein, 9 aa, Homo Sapiens
YAALHGEFY

SEQ ID NO: 169841 - protein, 9 aa, Homo Sapiens
YAALHHRIL

SEQ ID NO: 169842 - protein, 9 aa, Homo Sapiens
YAANLKNVM

SEQ ID NO: 169843 - protein, 9 aa, Homo Sapiens
YAAPHFFHL

SEQ ID NO: 169844 - protein, 9 aa, Homo Sapiens
YAAPWFLTL

SEQ ID NO: 169845 - protein, 9 aa, Homo Sapiens
YAAQAHLKL

SEQ ID NO: 169846 - protein, 9 aa, Homo Sapiens
YAAQLERQL

SEQ ID NO: 169847 - protein, 9 aa, Homo Sapiens
YAAQRIISL

SEQ ID NO: 169848 - protein, 9 aa, Homo Sapiens
YAASFINLL

SEQ ID NO: 169849 - protein, 9 aa, Homo Sapiens
YAASSYLSL

SEQ ID NO: 169850 - protein, 9 aa, Homo Sapiens
YAATYPRQL

SEQ ID NO: 169851 - protein, 9 aa, Homo Sapiens
YAAVKIHQL

SEQ ID NO: 169852 - protein, 9 aa, Homo Sapiens
YAAYPLTEV

SEQ ID NO: 169853 - protein, 9 aa, Homo Sapiens
YAFAHILTV

SEQ ID NO: 169854 - protein, 9 aa, Homo Sapiens
YAFGGGCEL

SEQ ID NO: 169855 - protein, 9 aa, Homo Sapiens
YAFLRREYY

SEQ ID NO: 169856 - protein, 9 aa, Homo Sapiens
YAFNMKATV

SEQ ID NO: 169857 - protein, 9 aa, Homo Sapiens
YAFPKAVSV

SEQ ID NO: 169858 - protein, 9 aa, Homo Sapiens
YAFPKEFPY

SEQ ID NO: 169859 - protein, 9 aa, Homo Sapiens
YAFPKSITV

SEQ ID NO: 169860 - protein, 9 aa, Homo Sapiens
YAFPLAHSL

SEQ ID NO: 169861 - protein, 9 aa, Homo Sapiens
YAFSRRFAW

SEQ ID NO: 169862 - protein, 9 aa, Homo Sapiens
YAFVRPVIL

SEQ ID NO: 169863 - protein, 9 aa, Homo Sapiens
YAGLKLVEY

SEQ ID NO: 169864 - protein, 9 aa, Homo Sapiens
YAHFPINVV

SEQ ID NO: 169865 - protein, 9 aa, Homo Sapiens
YAHLTPREL

SEQ ID NO: 169866 - protein, 9 aa, Homo Sapiens
YAIDNPLHY

SEQ ID NO: 169867 - protein, 9 aa, Homo Sapiens
YAIDSVLEV

SEQ ID NO: 169868 - protein, 9 aa, Homo Sapiens
YAIEKVREI

SEQ ID NO: 169869 - protein, 9 aa, Homo Sapiens
YAIESQLQL

SEQ ID NO: 169870 - protein, 9 aa, Homo Sapiens
YAIFRILLY

SEQ ID NO: 169871 - protein, 9 aa, Homo Sapiens
YAIGVSHPL

SEQ ID NO: 169872 - protein, 9 aa, Homo Sapiens
YAIHGVLEV

SEQ ID NO: 169873 - protein, 9 aa, Homo Sapiens
YAISKPEVL

SEQ ID NO: 169874 - protein, 9 aa, Homo Sapiens
YAITTLHNL

SEQ ID NO: 169875 - protein, 9 aa, Homo Sapiens
YAIVRFNQY

SEQ ID NO: 169876 - protein, 9 aa, Homo Sapiens
YAKDDPLEF

SEQ ID NO: 169877 - protein, 9 aa, Homo Sapiens
YAKIVEIPF

SEQ ID NO: 169878 - protein, 9 aa, Homo Sapiens
YAKLFADAV

SEQ ID NO: 169879 - protein, 9 aa, Homo Sapiens
YAKMIFMEL

SEQ ID NO: 169880 - protein, 9 aa, Homo Sapiens
YAKPYFLRL

SEQ ID NO: 169881 - protein, 9 aa, Homo Sapiens
YAKRPGIGL

SEQ ID NO: 169882 - protein, 9 aa, Homo Sapiens
YALELLTVY

SEQ ID NO: 169883 - protein, 9 aa, Homo Sapiens
YALERLKVM

SEQ ID NO: 169884 - protein, 9 aa, Homo Sapiens
YALLNLYEH

SEQ ID NO: 169885 - protein, 9 aa, Homo Sapiens
YALNHTLSV

SEQ ID NO: 169886 - protein, 9 aa, Homo Sapiens
YALPAGLEV

SEQ ID NO: 169887 - protein, 9 aa, Homo Sapiens
YALTSPLQL

SEQ ID NO: 169888 - protein, 9 aa, Homo Sapiens
YALYNNWEH

SEQ ID NO: 169889 - protein, 9 aa, Homo Sapiens
YALYQIKEM

SEQ ID NO: 169890 - protein, 9 aa, Homo Sapiens
YAMDELRSL

SEQ ID NO: 169891 - protein, 9 aa, Homo Sapiens
YAMDIVKGL

SEQ ID NO: 169892 - protein, 9 aa, Homo Sapiens
YANAKIYKL

SEQ ID NO: 169893 - protein, 9 aa, Homo Sapiens
YANDVTRVL

SEQ ID NO: 169894 - protein, 9 aa, Homo Sapiens
YANLMLLTL

SEQ ID NO: 169895 - protein, 9 aa, Homo Sapiens
YANYFIRLL

SEQ ID NO: 169896 - protein, 9 aa, Homo Sapiens
YANYYTREV

SEQ ID NO: 169897 - protein, 9 aa, Homo Sapiens
YAPYPSPVL

SEQ ID NO: 169898 - protein, 9 aa, Homo Sapiens
YAQIRTIAI

SEQ ID NO: 169899 - protein, 9 aa, Homo Sapiens
YAQLHSFTL

SEQ ID NO: 169900 - protein, 9 aa, Homo Sapiens
YAQLHSLTL

SEQ ID NO: 169901 - protein, 9 aa, Homo Sapiens
YAQQWNQYY

SEQ ID NO: 169902 - protein, 9 aa, Homo Sapiens
YARLHPRAV

SEQ ID NO: 169903 - protein, 9 aa, Homo Sapiens
YARLLALDM

SEQ ID NO: 169904 - protein, 9 aa, Homo Sapiens
YARLYPVLL

SEQ ID NO: 169905 - protein, 9 aa, Homo Sapiens
YARPSSEVI

SEQ ID NO: 169906 - protein, 9 aa, Homo Sapiens
YARQLEMIV

SEQ ID NO: 169907 - protein, 9 aa, Homo Sapiens
YARVSVRTV

SEQ ID NO: 169908 - protein, 9 aa, Homo Sapiens
YASGVERTI

SEQ ID NO: 169909 - protein, 9 aa, Homo Sapiens
YASLHGRIY

SEQ ID NO: 169910 - protein, 9 aa, Homo Sapiens
YASLRIEEL

SEQ ID NO: 169911 - protein, 9 aa, Homo Sapiens
YASPVVAFY

SEQ ID NO: 169912 - protein, 9 aa, Homo Sapiens
YASQQIRQI

SEQ ID NO: 169913 - protein, 9 aa, Homo Sapiens
YASQWFLTL

SEQ ID NO: 169914 - protein, 9 aa, Homo Sapiens
YASQYIARY

SEQ ID NO: 169915 - protein, 9 aa, Homo Sapiens
YASVVVKRY

SEQ ID NO: 169916 - protein, 9 aa, Homo Sapiens
YATASLRKL

SEQ ID NO: 169917 - protein, 9 aa, Homo Sapiens
YATEKLRMI

SEQ ID NO: 169918 - protein, 9 aa, Homo Sapiens
YATFIVTNY

SEQ ID NO: 169919 - protein, 9 aa, Homo Sapiens
YATKERIEY

SEQ ID NO: 169920 - protein, 9 aa, Homo Sapiens
YATKHLRVL

SEQ ID NO: 169921 - protein, 9 aa, Homo Sapiens
YATLREESL

SEQ ID NO: 169922 - protein, 9 aa, Homo Sapiens
YATLYYREH

SEQ ID NO: 169923 - protein, 9 aa, Homo Sapiens
YATQLQKTY

SEQ ID NO: 169924 - protein, 9 aa, Homo Sapiens
YAVDRAITH

SEQ ID NO: 169925 - protein, 9 aa, Homo Sapiens
YAVLDIREF

SEQ ID NO: 169926 - protein, 9 aa, Homo Sapiens
YAVNSKRML

SEQ ID NO: 169927 - protein, 9 aa, Homo Sapiens
YAVNSQFTM

SEQ ID NO: 169928 - protein, 9 aa, Homo Sapiens
YAVQRNYGF

SEQ ID NO: 169929 - protein, 9 aa, Homo Sapiens
YAYEKPHVV

SEQ ID NO: 169930 - protein, 9 aa, Homo Sapiens
YAYLYIRML

SEQ ID NO: 169931 - protein, 9 aa, Homo Sapiens
YAYPGVLLI

SEQ ID NO: 169932 - protein, 9 aa, Homo Sapiens
YAYPYSYYY

SEQ ID NO: 169933 - protein, 9 aa, Homo Sapiens
YAYTGRLEL

SEQ ID NO: 169934 - protein, 9 aa, Homo Sapiens
YCSNLVRTL

SEQ ID NO: 169935 - protein, 9 aa, Homo Sapiens
YFAFRNFLY

SEQ ID NO: 169936 - protein, 9 aa, Homo Sapiens
YFFKRTQYF

SEQ ID NO: 169937 - protein, 9 aa, Homo Sapiens
YFGLRTEEM

SEQ ID NO: 169938 - protein, 9 aa, Homo Sapiens
YFHDATRVY

SEQ ID NO: 169939 - protein, 9 aa, Homo Sapiens
YFHDRFLEL

SEQ ID NO: 169940 - protein, 9 aa, Homo Sapiens
YFHDRVASF

SEQ ID NO: 169941 - protein, 9 aa, Homo Sapiens
YFINRSWEW

SEQ ID NO: 169942 - protein, 9 aa, Homo Sapiens
YFLLRPETL

SEQ ID NO: 169943 - protein, 9 aa, Homo Sapiens
YFLNRKLVY

SEQ ID NO: 169944 - protein, 9 aa, Homo Sapiens
YFQHREFSF

SEQ ID NO: 169945 - protein, 9 aa, Homo Sapiens
YFVDDRLVM

SEQ ID NO: 169946 - protein, 9 aa, Homo Sapiens
YFVMTRQEY

SEQ ID NO: 169947 - protein, 9 aa, Homo Sapiens
YGADALRLY

SEQ ID NO: 169948 - protein, 9 aa, Homo Sapiens
YGAEIRPSL

SEQ ID NO: 169949 - protein, 9 aa, Homo Sapiens
YGIDTIRLY

SEQ ID NO: 169950 - protein, 9 aa, Homo Sapiens
YGKIAVMEL

SEQ ID NO: 169951 - protein, 9 aa, Homo Sapiens
YGLEKFWAF

SEQ ID NO: 169952 - protein, 9 aa, Homo Sapiens
YGMDSRPPM

SEQ ID NO: 169953 - protein, 9 aa, Homo Sapiens
YGNERFIQY

SEQ ID NO: 169954 - protein, 9 aa, Homo Sapiens
YGPPVRTEY

SEQ ID NO: 169955 - protein, 9 aa, Homo Sapiens
YGQFRVVSW

SEQ ID NO: 169956 - protein, 9 aa, Homo Sapiens
YGQWKNETY

SEQ ID NO: 169957 - protein, 9 aa, Homo Sapiens
YGSEGRFTF

SEQ ID NO: 169958 - protein, 9 aa, Homo Sapiens
YGTIKIGTY

SEQ ID NO: 169959 - protein, 9 aa, Homo Sapiens
YGYDNVKEY

SEQ ID NO: 169960 - protein, 9 aa, Homo Sapiens
YGYNQRPPY

SEQ ID NO: 169961 - protein, 9 aa, Homo Sapiens
YIIDFGLAK

SEQ ID NO: 169962 - protein, 9 aa, Homo Sapiens
YIIDTTGKL

SEQ ID NO: 169963 - protein, 9 aa, Homo Sapiens
YIIGVFRKF

SEQ ID NO: 169964 - protein, 9 aa, Homo Sapiens
YIMDWMDEM

SEQ ID NO: 169965 - protein, 9 aa, Homo Sapiens
YIRDLALEY

SEQ ID NO: 169966 - protein, 9 aa, Homo Sapiens
YISAKPLEM

SEQ ID NO: 169967 - protein, 9 aa, Homo Sapiens
YISFRHHVY

SEQ ID NO: 169968 - protein, 9 aa, Homo Sapiens
YISGLPRTM

SEQ ID NO: 169969 - protein, 9 aa, Homo Sapiens
YITFVKPAF

SEQ ID NO: 169970 - protein, 9 aa, Homo Sapiens
YITSVSRLY

SEQ ID NO: 169971 - protein, 9 aa, Homo Sapiens
YIYIRGEFY

SEQ ID NO: 169972 - protein, 9 aa, Homo Sapiens
YLKPYFLEA

SEQ ID NO: 169973 - protein, 9 aa, Homo Sapiens
YLKQDPLEM

SEQ ID NO: 169974 - protein, 9 aa, Homo Sapiens
YLPYRDYNY

SEQ ID NO: 169975 - protein, 9 aa, Homo Sapiens
YLRPPNTSL

SEQ ID NO: 169976 - protein, 9 aa, Homo Sapiens
YLYLRGLVY

SEQ ID NO: 169977 - protein, 9 aa, Homo Sapiens
YMADRLLSF

SEQ ID NO: 169978 - protein, 9 aa, Homo Sapiens
YMDYRGYSY

SEQ ID NO: 169979 - protein, 9 aa, Homo Sapiens
YMGIRNESF

SEQ ID NO: 169980 - protein, 9 aa, Homo Sapiens
YMREPILDL

SEQ ID NO: 169981 - protein, 9 aa, Homo Sapiens
YNFEKPVVM

SEQ ID NO: 169982 - protein, 9 aa, Homo Sapiens
YNYYKKFSY

SEQ ID NO: 169983 - protein, 9 aa, Homo Sapiens
YQADIERMY

SEQ ID NO: 169984 - protein, 9 aa, Homo Sapiens
YQILRGLAY

SEQ ID NO: 169985 - protein, 9 aa, Homo Sapiens
YQQELEREL

SEQ ID NO: 169986 - protein, 9 aa, Homo Sapiens
YQRDYSLIM

SEQ ID NO: 169987 - protein, 9 aa, Homo Sapiens
YQTPFNKEV

SEQ ID NO: 169988 - protein, 9 aa, Homo Sapiens
YSAAKSWVF

SEQ ID NO: 169989 - protein, 9 aa, Homo Sapiens
YSAEPLPEL

SEQ ID NO: 169990 - protein, 9 aa, Homo Sapiens
YSALREIAF

SEQ ID NO: 169991 - protein, 9 aa, Homo Sapiens
YSALSHPYF

SEQ ID NO: 169992 - protein, 9 aa, Homo Sapiens
YSAPVIHVL

SEQ ID NO: 169993 - protein, 9 aa, Homo Sapiens
YSAVRPFGC

SEQ ID NO: 169994 - protein, 9 aa, Homo Sapiens
YSFHKFHYL

SEQ ID NO: 169995 - protein, 9 aa, Homo Sapiens
YSFTHIVPY

SEQ ID NO: 169996 - protein, 9 aa, Homo Sapiens
YSFYLPIAA

SEQ ID NO: 169997 - protein, 9 aa, Homo Sapiens
YSGLRVQAM

SEQ ID NO: 169998 - protein, 9 aa, Homo Sapiens
YSHPHVRLL

SEQ ID NO: 169999 - protein, 9 aa, Homo Sapiens
YSISERLEM

SEQ ID NO: 170000 - protein, 9 aa, Homo Sapiens
YSISRKYDY

SEQ ID NO: 170001 - protein, 9 aa, Homo Sapiens
YSIYVYKVL

SEQ ID NO: 170002 - protein, 9 aa, Homo Sapiens
YSKLPGVSL

SEQ ID NO: 170003 - protein, 9 aa, Homo Sapiens
YSLNKIHAY

SEQ ID NO: 170004 - protein, 9 aa, Homo Sapiens
YSMPISIEF

SEQ ID NO: 170005 - protein, 9 aa, Homo Sapiens
YSMPSTHAM

SEQ ID NO: 170006 - protein, 9 aa, Homo Sapiens
YSMPVHAAV

SEQ ID NO: 170007 - protein, 9 aa, Homo Sapiens
YSMYREFWA

SEQ ID NO: 170008 - protein, 9 aa, Homo Sapiens
YSNTRAYYF

SEQ ID NO: 170009 - protein, 9 aa, Homo Sapiens
YSQEQRQAF

SEQ ID NO: 170010 - protein, 9 aa, Homo Sapiens
YSQERVNCF

SEQ ID NO: 170011 - protein, 9 aa, Homo Sapiens
YSSDFRQIF

SEQ ID NO: 170012 - protein, 9 aa, Homo Sapiens
YSSFSRFIM

SEQ ID NO: 170013 - protein, 9 aa, Homo Sapiens
YSSGLVRLY

SEQ ID NO: 170014 - protein, 9 aa, Homo Sapiens
YSSKLYRFF

SEQ ID NO: 170015 - protein, 9 aa, Homo Sapiens
YSSLRVVGV

SEQ ID NO: 170016 - protein, 9 aa, Homo Sapiens
YSSLSRFLM

SEQ ID NO: 170017 - protein, 9 aa, Homo Sapiens
YSSPLFRSL

SEQ ID NO: 170018 - protein, 9 aa, Homo Sapiens
YSSPYPQEY

SEQ ID NO: 170019 - protein, 9 aa, Homo Sapiens
YSTAPRPSL

SEQ ID NO: 170020 - protein, 9 aa, Homo Sapiens
YSTELKKLY

SEQ ID NO: 170021 - protein, 9 aa, Homo Sapiens
YSTIRKQEY

SEQ ID NO: 170022 - protein, 9 aa, Homo Sapiens
YSTKLYRFF

SEQ ID NO: 170023 - protein, 9 aa, Homo Sapiens
YSTPHAFTF

SEQ ID NO: 170024 - protein, 9 aa, Homo Sapiens
YSYFEKETL

SEQ ID NO: 170025 - protein, 9 aa, Homo Sapiens
YSYFSPRTM

SEQ ID NO: 170026 - protein, 9 aa, Homo Sapiens
YSYVRPERL

SEQ ID NO: 170027 - protein, 9 aa, Homo Sapiens
YTAVVPLVY

SEQ ID NO: 170028 - protein, 9 aa, Homo Sapiens
YTIENPRHF

SEQ ID NO: 170029 - protein, 9 aa, Homo Sapiens
YTKPLVLEI

SEQ ID NO: 170030 - protein, 9 aa, Homo Sapiens
YTLINHRVL

SEQ ID NO: 170031 - protein, 9 aa, Homo Sapiens
YTLMHKAHT

SEQ ID NO: 170032 - protein, 9 aa, Homo Sapiens
YTMPNFRQY

SEQ ID NO: 170033 - protein, 9 aa, Homo Sapiens
YTMVYWHAL

SEQ ID NO: 170034 - protein, 9 aa, Homo Sapiens
YTRPGLPTL

SEQ ID NO: 170035 - protein, 9 aa, Homo Sapiens
YTRQQVLEL

SEQ ID NO: 170036 - protein, 9 aa, Homo Sapiens
YTRYQTLEL

SEQ ID NO: 170037 - protein, 9 aa, Homo Sapiens
YTSDYFISY

SEQ ID NO: 170038 - protein, 9 aa, Homo Sapiens
YTSGDVRVW

SEQ ID NO: 170039 - protein, 9 aa, Homo Sapiens
YTSGTFRTV

SEQ ID NO: 170040 - protein, 9 aa, Homo Sapiens
YTSSEIRVF

SEQ ID NO: 170041 - protein, 9 aa, Homo Sapiens
YTTDFIYQL

SEQ ID NO: 170042 - protein, 9 aa, Homo Sapiens
YTTDRVMTV

SEQ ID NO: 170043 - protein, 9 aa, Homo Sapiens
YTTFVKPAF

SEQ ID NO: 170044 - protein, 9 aa, Homo Sapiens
YTVDGFRYF

SEQ ID NO: 170045 - protein, 9 aa, Homo Sapiens
YTYLRINFY

SEQ ID NO: 170046 - protein, 9 aa, Homo Sapiens
YVHELSLEM

SEQ ID NO: 170047 - protein, 9 aa, Homo Sapiens
YVIVRAYQY

SEQ ID NO: 170048 - protein, 9 aa, Homo Sapiens
YVKDIYQYL

SEQ ID NO: 170049 - protein, 9 aa, Homo Sapiens
YVQDFHPRL

SEQ ID NO: 170050 - protein, 9 aa, Homo Sapiens
YVSDITRTW

SEQ ID NO: 170051 - protein, 9 aa, Homo Sapiens
YVSDLGKVF

SEQ ID NO: 170052 - protein, 9 aa, Homo Sapiens
YVSPRILTA

SEQ ID NO: 170053 - protein, 9 aa, Homo Sapiens
YVTSLLKMY

SEQ ID NO: 170054 - protein, 9 aa, Homo Sapiens
YVTSVILHI

SEQ ID NO: 170055 - protein, 9 aa, Homo Sapiens
YVTTSTRTY

SEQ ID NO: 170056 - protein, 9 aa, Homo Sapiens
YVVEPYRKY

SEQ ID NO: 170057 - protein, 9 aa, Homo Sapiens
YYHARVYEF

SEQ ID NO: 170058 - protein, 10 aa, Homo Sapiens
AAAISHGRVF

SEQ ID NO: 170059 - protein, 10 aa, Homo Sapiens
AAAQKAVSAL

SEQ ID NO: 170060 - protein, 10 aa, Homo Sapiens
AAIDPRVQYL

SEQ ID NO: 170061 - protein, 10 aa, Homo Sapiens
AAINPELLQL

SEQ ID NO: 170062 - protein, 10 aa, Homo Sapiens
AAKMMSTAAI

SEQ ID NO: 170063 - protein, 10 aa, Homo Sapiens
AAMAKAFSTL

SEQ ID NO: 170064 - protein, 10 aa, Homo Sapiens
AASQHVFRFY

SEQ ID NO: 170065 - protein, 10 aa, Homo Sapiens
AAVAVGHRVY

SEQ ID NO: 170066 - protein, 10 aa, Homo Sapiens
AAVDFFRPSA

SEQ ID NO: 170067 - protein, 10 aa, Homo Sapiens
AFALAGNQDK

SEQ ID NO: 170068 - protein, 10 aa, Homo Sapiens
AGILENGAVR

SEQ ID NO: 170069 - protein, 10 aa, Homo Sapiens
AGSTVMVIHA

SEQ ID NO: 170070 - protein, 10 aa, Homo Sapiens
ALPEDDFLSL

SEQ ID NO: 170071 - protein, 10 aa, Homo Sapiens
ATPAGDIMEL

SEQ ID NO: 170072 - protein, 10 aa, Homo Sapiens
AVTDALVWVI

SEQ ID NO: 170073 - protein, 10 aa, Homo Sapiens
AWRRRAALGL

SEQ ID NO: 170074 - protein, 10 aa, Homo Sapiens
CAFYDPTHAW

SEQ ID NO: 170075 - protein, 10 aa, Homo Sapiens
DEPPQSPWDR

SEQ ID NO: 170076 - protein, 10 aa, Homo Sapiens
DEYGRPFLII

SEQ ID NO: 170077 - protein, 10 aa, Homo Sapiens
EALPLAFTQK

SEQ ID NO: 170078 - protein, 10 aa, Homo Sapiens
EFNAETFTFH

SEQ ID NO: 170079 - protein, 10 aa, Homo Sapiens
FAAQGEPKVY

SEQ ID NO: 170080 - protein, 10 aa, Homo Sapiens
FAFESDLHSL

SEQ ID NO: 170081 - protein, 10 aa, Homo Sapiens
FAFSPDGRHL

SEQ ID NO: 170082 - protein, 10 aa, Homo Sapiens
FAGDRDQYIL

SEQ ID NO: 170083 - protein, 10 aa, Homo Sapiens
FAIDLNGKKY

SEQ ID NO: 170084 - protein, 10 aa, Homo Sapiens
FAIGGIARTY

SEQ ID NO: 170085 - protein, 10 aa, Homo Sapiens
FAKLPNLLQL

SEQ ID NO: 170086 - protein, 10 aa, Homo Sapiens
FALTNGIYPH

SEQ ID NO: 170087 - protein, 10 aa, Homo Sapiens
FAMDVYKNLY

SEQ ID NO: 170088 - protein, 10 aa, Homo Sapiens
FANDLKPKVY

SEQ ID NO: 170089 - protein, 10 aa, Homo Sapiens
FAQDVGRMFK

SEQ ID NO: 170090 - protein, 10 aa, Homo Sapiens
FAQETFGKQY

SEQ ID NO: 170091 - protein, 10 aa, Homo Sapiens
FASLAEGRLY

SEQ ID NO: 170092 - protein, 10 aa, Homo Sapiens
FASYMEQHLM

SEQ ID NO: 170093 - protein, 10 aa, Homo Sapiens
FATLVSDRFL

SEQ ID NO: 170094 - protein, 10 aa, Homo Sapiens
FAVDLEHHSY

SEQ ID NO: 170095 - protein, 10 aa, Homo Sapiens
FAVDPRFLAY

SEQ ID NO: 170096 - protein, 10 aa, Homo Sapiens
FAVEAENREM

SEQ ID NO: 170097 - protein, 10 aa, Homo Sapiens
FAVGVGRPSF

SEQ ID NO: 170098 - protein, 10 aa, Homo Sapiens
FAVNPLLRVI

SEQ ID NO: 170099 - protein, 10 aa, Homo Sapiens
FAVSAVVHEY

SEQ ID NO: 170100 - protein, 10 aa, Homo Sapiens
FAVTVEGKVY

SEQ ID NO: 170101 - protein, 10 aa, Homo Sapiens
FAYDPSNYEY

SEQ ID NO: 170102 - protein, 10 aa, Homo Sapiens
FAYGGHPYPF

SEQ ID NO: 170103 - protein, 10 aa, Homo Sapiens
FFLDHVRTSF

SEQ ID NO: 170104 - protein, 10 aa, Homo Sapiens
FFTDAERRSV

SEQ ID NO: 170105 - protein, 10 aa, Homo Sapiens
FFYNLIHPEY

SEQ ID NO: 170106 - protein, 10 aa, Homo Sapiens
FGSAAPPRQF

SEQ ID NO: 170107 - protein, 10 aa, Homo Sapiens
FLPARFYQAL

SEQ ID NO: 170108 - protein, 10 aa, Homo Sapiens
FLTDAKRPAL

SEQ ID NO: 170109 - protein, 10 aa, Homo Sapiens
FMSRTNRPPL

SEQ ID NO: 170110 - protein, 10 aa, Homo Sapiens
FSAPSALRVY

SEQ ID NO: 170111 - protein, 10 aa, Homo Sapiens
FSLGSKGFYY

SEQ ID NO: 170112 - protein, 10 aa, Homo Sapiens
FTLDPLYREL

SEQ ID NO: 170113 - protein, 10 aa, Homo Sapiens
FTPFVDPRVY

SEQ ID NO: 170114 - protein, 10 aa, Homo Sapiens
FTSEPRLIVI

SEQ ID NO: 170115 - protein, 10 aa, Homo Sapiens
FTTDLFGRDL

SEQ ID NO: 170116 - protein, 10 aa, Homo Sapiens
FTVETASREY

SEQ ID NO: 170117 - protein, 10 aa, Homo Sapiens
FVNDIFERIA

SEQ ID NO: 170118 - protein, 10 aa, Homo Sapiens
GEKVVEIVKK

SEQ ID NO: 170119 - protein, 10 aa, Homo Sapiens
GGYDGYRPSF

SEQ ID NO: 170120 - protein, 10 aa, Homo Sapiens
GIPTHHPRVY

SEQ ID NO: 170121 - protein, 10 aa, Homo Sapiens
HAKDPNNLFM

SEQ ID NO: 170122 - protein, 10 aa, Homo Sapiens
HDNEETFLKK

SEQ ID NO: 170123 - protein, 10 aa, Homo Sapiens
HIPDHLRPEY

SEQ ID NO: 170124 - protein, 10 aa, Homo Sapiens
IATPFIKLFQ

SEQ ID NO: 170125 - protein, 10 aa, Homo Sapiens
IATPGRLIDF

SEQ ID NO: 170126 - protein, 10 aa, Homo Sapiens
IATSQNRIYL

SEQ ID NO: 170127 - protein, 10 aa, Homo Sapiens
IAVDTAGRVL

SEQ ID NO: 170128 - protein, 10 aa, Homo Sapiens
ISIEGNKMPL

SEQ ID NO: 170129 - protein, 10 aa, Homo Sapiens
IVSPYTSRIL

SEQ ID NO: 170130 - protein, 10 aa, Homo Sapiens
KAIEYVHGYF

SEQ ID NO: 170131 - protein, 10 aa, Homo Sapiens
KAKWPDRITL

SEQ ID NO: 170132 - protein, 10 aa, Homo Sapiens
KATAYILSVQ

SEQ ID NO: 170133 - protein, 10 aa, Homo Sapiens
KATNVVRLLL

SEQ ID NO: 170134 - protein, 10 aa, Homo Sapiens
KAVPPSKRFL

SEQ ID NO: 170135 - protein, 10 aa, Homo Sapiens
KISPWTGRFY

SEQ ID NO: 170136 - protein, 10 aa, Homo Sapiens
KVPQLEIVPN

SEQ ID NO: 170137 - protein, 10 aa, Homo Sapiens
LAAESNFRIY

SEQ ID NO: 170138 - protein, 10 aa, Homo Sapiens
LAAPGHPPVL

SEQ ID NO: 170139 - protein, 10 aa, Homo Sapiens
LAEFAFSLYR

SEQ ID NO: 170140 - protein, 10 aa, Homo Sapiens
LAIDKRFRVF

SEQ ID NO: 170141 - protein, 10 aa, Homo Sapiens
LAVEPKTETY

SEQ ID NO: 170142 - protein, 10 aa, Homo Sapiens
LETPDFQLFK

SEQ ID NO: 170143 - protein, 10 aa, Homo Sapiens
LLFYETSASF

SEQ ID NO: 170144 - protein, 10 aa, Homo Sapiens
LPLAGIRSAL

SEQ ID NO: 170145 - protein, 10 aa, Homo Sapiens
LSAFLPARFY

SEQ ID NO: 170146 - protein, 10 aa, Homo Sapiens
LSKDPDPIPL

SEQ ID NO: 170147 - protein, 10 aa, Homo Sapiens
LSQDSFYRVL

SEQ ID NO: 170148 - protein, 10 aa, Homo Sapiens
LVAASQAALG

SEQ ID NO: 170149 - protein, 10 aa, Homo Sapiens
LWLESVRLEY

SEQ ID NO: 170150 - protein, 10 aa, Homo Sapiens
MATPTPGHIM

SEQ ID NO: 170151 - protein, 10 aa, Homo Sapiens
MAYGASFLSF

SEQ ID NO: 170152 - protein, 10 aa, Homo Sapiens
MIKEGDYNPL

SEQ ID NO: 170153 - protein, 10 aa, Homo Sapiens
NAADIENRVL

SEQ ID NO: 170154 - protein, 10 aa, Homo Sapiens
NAADWHNLIL

SEQ ID NO: 170155 - protein, 10 aa, Homo Sapiens
NATLNNMRVY

SEQ ID NO: 170156 - protein, 10 aa, Homo Sapiens
NNATKTFREF

SEQ ID NO: 170157 - protein, 10 aa, Homo Sapiens
QAINPKLLQL

SEQ ID NO: 170158 - protein, 10 aa, Homo Sapiens
QAINPKLMQL

SEQ ID NO: 170159 - protein, 10 aa, Homo Sapiens
QSVQSIRPPY

SEQ ID NO: 170160 - protein, 10 aa, Homo Sapiens
RAFGIPIRVY

SEQ ID NO: 170161 - protein, 10 aa, Homo Sapiens
RASMDPKRFY

SEQ ID NO: 170162 - protein, 10 aa, Homo Sapiens
RAVEPGRPPL

SEQ ID NO: 170163 - protein, 10 aa, Homo Sapiens
RFVEVGRVAY

SEQ ID NO: 170164 - protein, 10 aa, Homo Sapiens
RSNFGYNIPL

SEQ ID NO: 170165 - protein, 10 aa, Homo Sapiens
RTTTWTRPIM

SEQ ID NO: 170166 - protein, 10 aa, Homo Sapiens
SAADPQIRQF

SEQ ID NO: 170167 - protein, 10 aa, Homo Sapiens
SAAYIPAHTY

SEQ ID NO: 170168 - protein, 10 aa, Homo Sapiens
SAKDFIDLTL

SEQ ID NO: 170169 - protein, 10 aa, Homo Sapiens
SAMPRDILIV

SEQ ID NO: 170170 - protein, 10 aa, Homo Sapiens
SAMQGWRVSM

SEQ ID NO: 170171 - protein, 10 aa, Homo Sapiens
SAMSRYILIM

SEQ ID NO: 170172 - protein, 10 aa, Homo Sapiens
SAPGYLPTSL

SEQ ID NO: 170173 - protein, 10 aa, Homo Sapiens
SATDAAIRVW

SEQ ID NO: 170174 - protein, 10 aa, Homo Sapiens
SGNTFRPEVH

SEQ ID NO: 170175 - protein, 10 aa, Homo Sapiens
SITHVFSLNK

SEQ ID NO: 170176 - protein, 10 aa, Homo Sapiens
SIVHPSYNSN

SEQ ID NO: 170177 - protein, 10 aa, Homo Sapiens
SLPAIVRPEF

SEQ ID NO: 170178 - protein, 10 aa, Homo Sapiens
SLSTMFRVEY

SEQ ID NO: 170179 - protein, 10 aa, Homo Sapiens
SSFDLLPREF

SEQ ID NO: 170180 - protein, 10 aa, Homo Sapiens
STFSPDGRVF

SEQ ID NO: 170181 - protein, 10 aa, Homo Sapiens
SVMHEALHNR

SEQ ID NO: 170182 - protein, 10 aa, Homo Sapiens
SVPDSTWRIM

SEQ ID NO: 170183 - protein, 10 aa, Homo Sapiens
TIFSPEGRLY

SEQ ID NO: 170184 - protein, 10 aa, Homo Sapiens
VAAMPRPVSY

SEQ ID NO: 170185 - protein, 10 aa, Homo Sapiens
VAFDRHLYVF

SEQ ID NO: 170186 - protein, 10 aa, Homo Sapiens
VAFSPDGRYL

SEQ ID NO: 170187 - protein, 10 aa, Homo Sapiens
VAIESTPMIL

SEQ ID NO: 170188 - protein, 10 aa, Homo Sapiens
VAIKGAFKVY

SEQ ID NO: 170189 - protein, 10 aa, Homo Sapiens
VALHQPLISF

SEQ ID NO: 170190 - protein, 10 aa, Homo Sapiens
VASDFYLRYY

SEQ ID NO: 170191 - protein, 10 aa, Homo Sapiens
VASEALARVV

SEQ ID NO: 170192 - protein, 10 aa, Homo Sapiens
VATNLLKLFL

SEQ ID NO: 170193 - protein, 10 aa, Homo Sapiens
VAVDPSGRLL

SEQ ID NO: 170194 - protein, 10 aa, Homo Sapiens
VAVGHRVYSF

SEQ ID NO: 170195 - protein, 10 aa, Homo Sapiens
VDGVEVHNAK

SEQ ID NO: 170196 - protein, 10 aa, Homo Sapiens
VFLMIEQNTK

SEQ ID NO: 170197 - protein, 10 aa, Homo Sapiens
VFTDVKRPGY

SEQ ID NO: 170198 - protein, 10 aa, Homo Sapiens
VGAETKTLPS

SEQ ID NO: 170199 - protein, 10 aa, Homo Sapiens
VLPTLPFHVL

SEQ ID NO: 170200 - protein, 10 aa, Homo Sapiens
VSAAPRTVAL

SEQ ID NO: 170201 - protein, 10 aa, Homo Sapiens
VTSTSLTIKS

SEQ ID NO: 170202 - protein, 10 aa, Homo Sapiens
VTSYDPLRIY

SEQ ID NO: 170203 - protein, 10 aa, Homo Sapiens
VVPPFLQPEV

SEQ ID NO: 170204 - protein, 10 aa, Homo Sapiens
WIASHTTEER

SEQ ID NO: 170205 - protein, 10 aa, Homo Sapiens
YAAEFHARFV

SEQ ID NO: 170206 - protein, 10 aa, Homo Sapiens
YAANPRPDAL

SEQ ID NO: 170207 - protein, 10 aa, Homo Sapiens
YAAVPLYRLY

SEQ ID NO: 170208 - protein, 10 aa, Homo Sapiens
YAFDKYRDQY

SEQ ID NO: 170209 - protein, 10 aa, Homo Sapiens
YAFNGTQRFL

SEQ ID NO: 170210 - protein, 10 aa, Homo Sapiens
YAFQTEGKLY

SEQ ID NO: 170211 - protein, 10 aa, Homo Sapiens
YAKIYPDPEL

SEQ ID NO: 170212 - protein, 10 aa, Homo Sapiens
YAKNFQPFAL

SEQ ID NO: 170213 - protein, 10 aa, Homo Sapiens
YASPAKLESI

SEQ ID NO: 170214 - protein, 10 aa, Homo Sapiens
YATTVIPRVY

SEQ ID NO: 170215 - protein, 10 aa, Homo Sapiens
YAVDAYFREA

SEQ ID NO: 170216 - protein, 10 aa, Homo Sapiens
YAVEGRDLTL

SEQ ID NO: 170217 - protein, 10 aa, Homo Sapiens
YGAEALERMF

SEQ ID NO: 170218 - protein, 10 aa, Homo Sapiens
YIAPWSGRFY

SEQ ID NO: 170219 - protein, 10 aa, Homo Sapiens
YITFIEGRSY

SEQ ID NO: 170220 - protein, 10 aa, Homo Sapiens
YITPFIRPVM

SEQ ID NO: 170221 - protein, 10 aa, Homo Sapiens
YMIDPSGVSY

SEQ ID NO: 170222 - protein, 10 aa, Homo Sapiens
YSQEADDRVF

SEQ ID NO: 170223 - protein, 10 aa, Homo Sapiens
YSSAFTNRIF

SEQ ID NO: 170224 - protein, 10 aa, Homo Sapiens
YTLIGASGQR

SEQ ID NO: 170225 - protein, 10 aa, Homo Sapiens
YVADPVYRTF

SEQ ID NO: 170226 - protein, 10 aa, Homo Sapiens
YVGGQEHFAH

SEQ ID NO: 170227 - protein, 10 aa, Homo Sapiens
YVPAEPKLAF

SEQ ID NO: 170228 - protein, 10 aa, Homo Sapiens
YVPDQPHPEI

SEQ ID NO: 170229 - protein, 10 aa, Homo Sapiens
YVTAIEDRQY

SEQ ID NO: 170230 - protein, 10 aa, Homo Sapiens
YVTDVLYRVM

SEQ ID NO: 170231 - protein, 11 aa, Homo Sapiens
AAIDWFDGKEF

SEQ ID NO: 170232 - protein, 11 aa, Homo Sapiens
AALPDASPGNL

SEQ ID NO: 170233 - protein, 11 aa, Homo Sapiens
AAMASLGALAL

SEQ ID NO: 170234 - protein, 11 aa, Homo Sapiens
AARQPIELLSM

SEQ ID NO: 170235 - protein, 11 aa, Homo Sapiens
AASNAKLALFY

SEQ ID NO: 170236 - protein, 11 aa, Homo Sapiens
AASPNAEIHIL

SEQ ID NO: 170237 - protein, 11 aa, Homo Sapiens
AAVIGDVIRVY

SEQ ID NO: 170238 - protein, 11 aa, Homo Sapiens
AAVPEIMDRIY

SEQ ID NO: 170239 - protein, 11 aa, Homo Sapiens
ADREDDPNFFK

SEQ ID NO: 170240 - protein, 11 aa, Homo Sapiens
AFALAGNQDKR

SEQ ID NO: 170241 - protein, 11 aa, Homo Sapiens
AFHDNEETFLK

SEQ ID NO: 170242 - protein, 11 aa, Homo Sapiens
ALEVDETYVPK

SEQ ID NO: 170243 - protein, 11 aa, Homo Sapiens
APPPLPPVYSM

SEQ ID NO: 170244 - protein, 11 aa, Homo Sapiens
ASDGFKANLVF

SEQ ID NO: 170245 - protein, 11 aa, Homo Sapiens
DVINGSPISQK

SEQ ID NO: 170246 - protein, 11 aa, Homo Sapiens
EERAAPFSLEY

SEQ ID NO: 170247 - protein, 11 aa, Homo Sapiens
FAFEGIGDEDL

SEQ ID NO: 170248 - protein, 11 aa, Homo Sapiens
FAKPVYPGQTL

SEQ ID NO: 170249 - protein, 11 aa, Homo Sapiens
FALPSELERSY

SEQ ID NO: 170250 - protein, 11 aa, Homo Sapiens
FAQEAISVLAL

SEQ ID NO: 170251 - protein, 11 aa, Homo Sapiens
FAQEALTVLSL

SEQ ID NO: 170252 - protein, 11 aa, Homo Sapiens
FASKEIAENAL

SEQ ID NO: 170253 - protein, 11 aa, Homo Sapiens
FAVDNVGNRTL

SEQ ID NO: 170254 - protein, 11 aa, Homo Sapiens
FAYDGKDYLTL

SEQ ID NO: 170255 - protein, 11 aa, Homo Sapiens
FFSDARELESF

SEQ ID NO: 170256 - protein, 11 aa, Homo Sapiens
FNWYVDGVEVH

SEQ ID NO: 170257 - protein, 11 aa, Homo Sapiens
FSIDVGYERFL

SEQ ID NO: 170258 - protein, 11 aa, Homo Sapiens
FSSDKHAQLIL

SEQ ID NO: 170259 - protein, 11 aa, Homo Sapiens
FTSSMRGMDAV

SEQ ID NO: 170260 - protein, 11 aa, Homo Sapiens
FVAEPDNKNVY

SEQ ID NO: 170261 - protein, 11 aa, Homo Sapiens
FVAESHIILVL

SEQ ID NO: 170262 - protein, 11 aa, Homo Sapiens
GATNVGSIRIY

SEQ ID NO: 170263 - protein, 11 aa, Homo Sapiens
IASDGLKGRVF

SEQ ID NO: 170264 - protein, 11 aa, Homo Sapiens
IATPGRLIDFL

SEQ ID NO: 170265 - protein, 11 aa, Homo Sapiens
ISDPYKVYRIV

SEQ ID NO: 170266 - protein, 11 aa, Homo Sapiens
ITSSAKVDMTF

SEQ ID NO: 170267 - protein, 11 aa, Homo Sapiens
KASVMRLTISY

SEQ ID NO: 170268 - protein, 11 aa, Homo Sapiens
KATNVVRLLLG

SEQ ID NO: 170269 - protein, 11 aa, Homo Sapiens
KILTERGYSFT

SEQ ID NO: 170270 - protein, 11 aa, Homo Sapiens
KIREEYPDRIM

SEQ ID NO: 170271 - protein, 11 aa, Homo Sapiens
KLVAASQAALG

SEQ ID NO: 170272 - protein, 11 aa, Homo Sapiens
KLVNEVTEFAK

SEQ ID NO: 170273 - protein, 11 aa, Homo Sapiens
LALDPSLVPTF

SEQ ID NO: 170274 - protein, 11 aa, Homo Sapiens
LGEFVSETESR

SEQ ID NO: 170275 - protein, 11 aa, Homo Sapiens
LLSAARLLTSF

SEQ ID NO: 170276 - protein, 11 aa, Homo Sapiens
LSVAPSKAREY

SEQ ID NO: 170277 - protein, 11 aa, Homo Sapiens
LSVEIYDRREY

SEQ ID NO: 170278 - protein, 11 aa, Homo Sapiens
MAAEAAALRVY

SEQ ID NO: 170279 - protein, 11 aa, Homo Sapiens
MAPSETQFSHL

SEQ ID NO: 170280 - protein, 11 aa, Homo Sapiens
MAVEDEGLRVF

SEQ ID NO: 170281 - protein, 11 aa, Homo Sapiens
NTSEPQHLLVM

SEQ ID NO: 170282 - protein, 11 aa, Homo Sapiens
QAIEPDVLRQF

SEQ ID NO: 170283 - protein, 11 aa, Homo Sapiens
QVTHEGSTVEK

SEQ ID NO: 170284 - protein, 11 aa, Homo Sapiens
RVRPGETLLIH

SEQ ID NO: 170285 - protein, 11 aa, Homo Sapiens
SAAEVGFVRFF

SEQ ID NO: 170286 - protein, 11 aa, Homo Sapiens
SAFVPSSGRIY

SEQ ID NO: 170287 - protein, 11 aa, Homo Sapiens
SAINEVVTREY

SEQ ID NO: 170288 - protein, 11 aa, Homo Sapiens
SASDVHGNFAF

SEQ ID NO: 170289 - protein, 11 aa, Homo Sapiens
SAYDGKDYIAL

SEQ ID NO: 170290 - protein, 11 aa, Homo Sapiens
SITTDFIPSFR

SEQ ID NO: 170291 - protein, 11 aa, Homo Sapiens
SLSQARLLTSF

SEQ ID NO: 170292 - protein, 11 aa, Homo Sapiens
TTTEVNMARVY

SEQ ID NO: 170293 - protein, 11 aa, Homo Sapiens
TVLHQDWLNGK

SEQ ID NO: 170294 - protein, 11 aa, Homo Sapiens
TVVLPLDERAF

SEQ ID NO: 170295 - protein, 11 aa, Homo Sapiens
VAAAISHGRVF

SEQ ID NO: 170296 - protein, 11 aa, Homo Sapiens
VAAPPTAVGSL

SEQ ID NO: 170297 - protein, 11 aa, Homo Sapiens
VAIRPSSKKTY

SEQ ID NO: 170298 - protein, 11 aa, Homo Sapiens
VARDYESLIDL

SEQ ID NO: 170299 - protein, 11 aa, Homo Sapiens
VASEAKIQQLM

SEQ ID NO: 170300 - protein, 11 aa, Homo Sapiens
VASVAKESIPL

SEQ ID NO: 170301 - protein, 11 aa, Homo Sapiens
VATPHARIIEL

SEQ ID NO: 170302 - protein, 11 aa, Homo Sapiens
VATSFIRTIEL

SEQ ID NO: 170303 - protein, 11 aa, Homo Sapiens
VAVGQLGVRVF

SEQ ID NO: 170304 - protein, 11 aa, Homo Sapiens
VAYWRQAGLSY

SEQ ID NO: 170305 - protein, 11 aa, Homo Sapiens
VSSDVIDQKVY

SEQ ID NO: 170306 - protein, 11 aa, Homo Sapiens
VSTPTLVEVSR

SEQ ID NO: 170307 - protein, 11 aa, Homo Sapiens
YAFDEAFVREV

SEQ ID NO: 170308 - protein, 11 aa, Homo Sapiens
YAISPGLDITF

SEQ ID NO: 170309 - protein, 11 aa, Homo Sapiens
YANMYSSILTM

SEQ ID NO: 170310 - protein, 11 aa, Homo Sapiens
YASTEMSLHAL

SEQ ID NO: 170311 - protein, 11 aa, Homo Sapiens
YAVDAYFREAL

SEQ ID NO: 170312 - protein, 11 aa, Homo Sapiens
YAVPSAGLRLF

SEQ ID NO: 170313 - protein, 11 aa, Homo Sapiens
YAYDGKDYIAL

SEQ ID NO: 170314 - protein, 11 aa, Homo Sapiens
YAYDIEDGKFY

SEQ ID NO: 170315 - protein, 11 aa, Homo Sapiens
YIMEPSIFNTL

SEQ ID NO: 170316 - protein, 11 aa, Homo Sapiens
YSFDSRHKPAF

SEQ ID NO: 170317 - protein, 11 aa, Homo Sapiens
YTTDRVMTVSF

SEQ ID NO: 170318 - protein, 8 aa, Homo Sapiens
AAAAAMNL

SEQ ID NO: 170319 - protein, 8 aa, Homo Sapiens
AAAAPAFL

SEQ ID NO: 170320 - protein, 8 aa, Homo Sapiens
AAACAVFL

SEQ ID NO: 170321 - protein, 8 aa, Homo Sapiens
AAADILQL

SEQ ID NO: 170322 - protein, 8 aa, Homo Sapiens
AAAEAVKL

SEQ ID NO: 170323 - protein, 8 aa, Homo Sapiens
AAAHSVRL

SEQ ID NO: 170324 - protein, 8 aa, Homo Sapiens
AAAIFVII

SEQ ID NO: 170325 - protein, 8 aa, Homo Sapiens
AAAKALRI

SEQ ID NO: 170326 - protein, 8 aa, Homo Sapiens
AAAKHLIL

SEQ ID NO: 170327 - protein, 8 aa, Homo Sapiens
AAANPLAL

SEQ ID NO: 170328 - protein, 8 aa, Homo Sapiens
AAAPAVSL

SEQ ID NO: 170329 - protein, 8 aa, Homo Sapiens
AAAPHLLL

SEQ ID NO: 170330 - protein, 8 aa, Homo Sapiens
AAAPPALI

SEQ ID NO: 170331 - protein, 8 aa, Homo Sapiens
AAAPPLTL

SEQ ID NO: 170332 - protein, 8 aa, Homo Sapiens
AAARDVTL

SEQ ID NO: 170333 - protein, 8 aa, Homo Sapiens
AAASPVHL

SEQ ID NO: 170334 - protein, 8 aa, Homo Sapiens
AAASPVTL

SEQ ID NO: 170335 - protein, 8 aa, Homo Sapiens
AAAWPLLL

SEQ ID NO: 170336 - protein, 8 aa, Homo Sapiens
AAGKEVML

SEQ ID NO: 170337 - protein, 8 aa, Homo Sapiens
AAGLPVCL

SEQ ID NO: 170338 - protein, 8 aa, Homo Sapiens
AAGPPLLL

SEQ ID NO: 170339 - protein, 8 aa, Homo Sapiens
AAGPVGSL

SEQ ID NO: 170340 - protein, 8 aa, Homo Sapiens
AAGSPLSL

SEQ ID NO: 170341 - protein, 8 aa, Homo Sapiens
AAGSPVFL

SEQ ID NO: 170342 - protein, 8 aa, Homo Sapiens
AAHIPLFL

SEQ ID NO: 170343 - protein, 8 aa, Homo Sapiens
AASDFIFL

SEQ ID NO: 170344 - protein, 8 aa, Homo Sapiens
AASEPVVL

SEQ ID NO: 170345 - protein, 8 aa, Homo Sapiens
AASHPLLL

SEQ ID NO: 170346 - protein, 8 aa, Homo Sapiens
AIGPCVSL

SEQ ID NO: 170347 - protein, 8 aa, Homo Sapiens
ALGPILRL

SEQ ID NO: 170348 - protein, 8 aa, Homo Sapiens
AVALPVYL

SEQ ID NO: 170349 - protein, 8 aa, Homo Sapiens
AVGPDLYL

SEQ ID NO: 170350 - protein, 8 aa, Homo Sapiens
ESLIACKA

SEQ ID NO: 170351 - protein, 8 aa, Homo Sapiens
FAAEAIAM

SEQ ID NO: 170352 - protein, 8 aa, Homo Sapiens
FAAEAQKL

SEQ ID NO: 170353 - protein, 8 aa, Homo Sapiens
FAAETLVL

SEQ ID NO: 170354 - protein, 8 aa, Homo Sapiens
FAAGETFL

SEQ ID NO: 170355 - protein, 8 aa, Homo Sapiens
FAAKVLYL

SEQ ID NO: 170356 - protein, 8 aa, Homo Sapiens
FAARPVLL

SEQ ID NO: 170357 - protein, 8 aa, Homo Sapiens
FAAVKLFL

SEQ ID NO: 170358 - protein, 8 aa, Homo Sapiens
FADGVILL

SEQ ID NO: 170359 - protein, 8 aa, Homo Sapiens
FAGKVLRL

SEQ ID NO: 170360 - protein, 8 aa, Homo Sapiens
FAGMPITL

SEQ ID NO: 170361 - protein, 8 aa, Homo Sapiens
FAGPHSTL

SEQ ID NO: 170362 - protein, 8 aa, Homo Sapiens
FAIRPMYL

SEQ ID NO: 170363 - protein, 8 aa, Homo Sapiens
FASADISL

SEQ ID NO: 170364 - protein, 8 aa, Homo Sapiens
FASFPEYL

SEQ ID NO: 170365 - protein, 8 aa, Homo Sapiens
FASGAVEL

SEQ ID NO: 170366 - protein, 8 aa, Homo Sapiens
FASGVVKL

SEQ ID NO: 170367 - protein, 8 aa, Homo Sapiens
FASTILHL

SEQ ID NO: 170368 - protein, 8 aa, Homo Sapiens
FGSKIILL

SEQ ID NO: 170369 - protein, 8 aa, Homo Sapiens
FIGYPITL

SEQ ID NO: 170370 - protein, 8 aa, Homo Sapiens
FITDPVVL

SEQ ID NO: 170371 - protein, 8 aa, Homo Sapiens
FLGGVVHL

SEQ ID NO: 170372 - protein, 8 aa, Homo Sapiens
FLGKPLFL

SEQ ID NO: 170373 - protein, 8 aa, Homo Sapiens
FLGNVLFL

SEQ ID NO: 170374 - protein, 8 aa, Homo Sapiens
FLGPEIFF

SEQ ID NO: 170375 - protein, 8 aa, Homo Sapiens
FLGPIVNL

SEQ ID NO: 170376 - protein, 8 aa, Homo Sapiens
FLSQPILL

SEQ ID NO: 170377 - protein, 8 aa, Homo Sapiens
FSAPKINL

SEQ ID NO: 170378 - protein, 8 aa, Homo Sapiens
FSGPAITL

SEQ ID NO: 170379 - protein, 8 aa, Homo Sapiens
FSSPPVIL

SEQ ID NO: 170380 - protein, 8 aa, Homo Sapiens
FTADPLSL

SEQ ID NO: 170381 - protein, 8 aa, Homo Sapiens
FTAQVIIL

SEQ ID NO: 170382 - protein, 8 aa, Homo Sapiens
FTSTPVSL

SEQ ID NO: 170383 - protein, 8 aa, Homo Sapiens
FTTDAIAL

SEQ ID NO: 170384 - protein, 8 aa, Homo Sapiens
FVSFPLYL

SEQ ID NO: 170385 - protein, 8 aa, Homo Sapiens
FVSPEVFL

SEQ ID NO: 170386 - protein, 8 aa, Homo Sapiens
GAAPFIWL

SEQ ID NO: 170387 - protein, 8 aa, Homo Sapiens
GAARPVSL

SEQ ID NO: 170388 - protein, 8 aa, Homo Sapiens
GAAVPVEL

SEQ ID NO: 170389 - protein, 8 aa, Homo Sapiens
GAGAPVYL

SEQ ID NO: 170390 - protein, 8 aa, Homo Sapiens
GAGAPVYM

SEQ ID NO: 170391 - protein, 8 aa, Homo Sapiens
GAGPTMLL

SEQ ID NO: 170392 - protein, 8 aa, Homo Sapiens
GAGPYVDL

SEQ ID NO: 170393 - protein, 8 aa, Homo Sapiens
GASKAVFL

SEQ ID NO: 170394 - protein, 8 aa, Homo Sapiens
GASKPNAL

SEQ ID NO: 170395 - protein, 8 aa, Homo Sapiens
GASLFLLL

SEQ ID NO: 170396 - protein, 8 aa, Homo Sapiens
GATVEIHL

SEQ ID NO: 170397 - protein, 8 aa, Homo Sapiens
GIANPLLL

SEQ ID NO: 170398 - protein, 8 aa, Homo Sapiens
GIGVPIML

SEQ ID NO: 170399 - protein, 8 aa, Homo Sapiens
GISQPIWL

SEQ ID NO: 170400 - protein, 8 aa, Homo Sapiens
GLGPVEYL

SEQ ID NO: 170401 - protein, 8 aa, Homo Sapiens
GQALPIHL

SEQ ID NO: 170402 - protein, 8 aa, Homo Sapiens
GVGPLLYL

SEQ ID NO: 170403 - protein, 8 aa, Homo Sapiens
HAAEALLL

SEQ ID NO: 170404 - protein, 8 aa, Homo Sapiens
HAAIVIFL

SEQ ID NO: 170405 - protein, 8 aa, Homo Sapiens
HATVPIRL

SEQ ID NO: 170406 - protein, 8 aa, Homo Sapiens
HRGFSGLQ

SEQ ID NO: 170407 - protein, 8 aa, Homo Sapiens
HTGPITCL

SEQ ID NO: 170408 - protein, 8 aa, Homo Sapiens
IADRPLYL

SEQ ID NO: 170409 - protein, 8 aa, Homo Sapiens
IAGPVVEI

SEQ ID NO: 170410 - protein, 8 aa, Homo Sapiens
ITKSIPIL

SEQ ID NO: 170411 - protein, 8 aa, Homo Sapiens
IVAKQVLL

SEQ ID NO: 170412 - protein, 8 aa, Homo Sapiens
IVGPVVGL

SEQ ID NO: 170413 - protein, 8 aa, Homo Sapiens
KAAKELRL

SEQ ID NO: 170414 - protein, 8 aa, Homo Sapiens
KAAQEVKL

SEQ ID NO: 170415 - protein, 8 aa, Homo Sapiens
KIHEPIML

SEQ ID NO: 170416 - protein, 8 aa, Homo Sapiens
KLSKPVYL

SEQ ID NO: 170417 - protein, 8 aa, Homo Sapiens
KSGPVVSL

SEQ ID NO: 170418 - protein, 8 aa, Homo Sapiens
LAAGAVFL

SEQ ID NO: 170419 - protein, 8 aa, Homo Sapiens
LAGPALEL

SEQ ID NO: 170420 - protein, 8 aa, Homo Sapiens
LAGPASNL

SEQ ID NO: 170421 - protein, 8 aa, Homo Sapiens
LAGPVLGL

SEQ ID NO: 170422 - protein, 8 aa, Homo Sapiens
LFGMIITI

SEQ ID NO: 170423 - protein, 8 aa, Homo Sapiens
LIGPPLLI

SEQ ID NO: 170424 - protein, 8 aa, Homo Sapiens
LLGPTVML

SEQ ID NO: 170425 - protein, 8 aa, Homo Sapiens
LQGPILRL

SEQ ID NO: 170426 - protein, 8 aa, Homo Sapiens
LSSDPIAL

SEQ ID NO: 170427 - protein, 8 aa, Homo Sapiens
LTAPEIIL

SEQ ID NO: 170428 - protein, 8 aa, Homo Sapiens
LTGPVLEL

SEQ ID NO: 170429 - protein, 8 aa, Homo Sapiens
LVGPQIYL

SEQ ID NO: 170430 - protein, 8 aa, Homo Sapiens
MAGDIILL

SEQ ID NO: 170431 - protein, 8 aa, Homo Sapiens
MAGSPVFL

SEQ ID NO: 170432 - protein, 8 aa, Homo Sapiens
NAAEAMLL

SEQ ID NO: 170433 - protein, 8 aa, Homo Sapiens
NAGPAIVI

SEQ ID NO: 170434 - protein, 8 aa, Homo Sapiens
PPAPPVFL

SEQ ID NO: 170435 - protein, 8 aa, Homo Sapiens
QAAPPIEL

SEQ ID NO: 170436 - protein, 8 aa, Homo Sapiens
QAGPVIKV

SEQ ID NO: 170437 - protein, 8 aa, Homo Sapiens
RAAEKLYL

SEQ ID NO: 170438 - protein, 8 aa, Homo Sapiens
RAFREIQL

SEQ ID NO: 170439 - protein, 8 aa, Homo Sapiens
RAVFPIYL

SEQ ID NO: 170440 - protein, 8 aa, Homo Sapiens
SAAAELYL

SEQ ID NO: 170441 - protein, 8 aa, Homo Sapiens
SAAAPQLL

SEQ ID NO: 170442 - protein, 8 aa, Homo Sapiens
SAAAVSML

SEQ ID NO: 170443 - protein, 8 aa, Homo Sapiens
SAAFAVKL

SEQ ID NO: 170444 - protein, 8 aa, Homo Sapiens
SAAHEVEL

SEQ ID NO: 170445 - protein, 8 aa, Homo Sapiens
SAAPAIQL

SEQ ID NO: 170446 - protein, 8 aa, Homo Sapiens
SAAPAIYL

SEQ ID NO: 170447 - protein, 8 aa, Homo Sapiens
SAAPPLDL

SEQ ID NO: 170448 - protein, 8 aa, Homo Sapiens
SAAPVAHL

SEQ ID NO: 170449 - protein, 8 aa, Homo Sapiens
SAAQPLNL

SEQ ID NO: 170450 - protein, 8 aa, Homo Sapiens
SAASRVFL

SEQ ID NO: 170451 - protein, 8 aa, Homo Sapiens
SAATATWL

SEQ ID NO: 170452 - protein, 8 aa, Homo Sapiens
SAGPLLRL

SEQ ID NO: 170453 - protein, 8 aa, Homo Sapiens
SAPAGVQL

SEQ ID NO: 170454 - protein, 8 aa, Homo Sapiens
SATGEIYL

SEQ ID NO: 170455 - protein, 8 aa, Homo Sapiens
SATLPNYL

SEQ ID NO: 170456 - protein, 8 aa, Homo Sapiens
SAYEVIKL

SEQ ID NO: 170457 - protein, 8 aa, Homo Sapiens
SIAGPVLL

SEQ ID NO: 170458 - protein, 8 aa, Homo Sapiens
SLAPPLCL

SEQ ID NO: 170459 - protein, 8 aa, Homo Sapiens
SSGGVIRL

SEQ ID NO: 170460 - protein, 8 aa, Homo Sapiens
SSGREIYL

SEQ ID NO: 170461 - protein, 8 aa, Homo Sapiens
SSSDAIYL

SEQ ID NO: 170462 - protein, 8 aa, Homo Sapiens
STARHLYL

SEQ ID NO: 170463 - protein, 8 aa, Homo Sapiens
STGPIVDL

SEQ ID NO: 170464 - protein, 8 aa, Homo Sapiens
STTRELYL

SEQ ID NO: 170465 - protein, 8 aa, Homo Sapiens
SVAQPIHL

SEQ ID NO: 170466 - protein, 8 aa, Homo Sapiens
SVATVVYL

SEQ ID NO: 170467 - protein, 8 aa, Homo Sapiens
SVGPVSNL

SEQ ID NO: 170468 - protein, 8 aa, Homo Sapiens
SVGQPVFL

SEQ ID NO: 170469 - protein, 8 aa, Homo Sapiens
SVSKEVFL

SEQ ID NO: 170470 - protein, 8 aa, Homo Sapiens
TAAGAVFL

SEQ ID NO: 170471 - protein, 8 aa, Homo Sapiens
TAAKEIEV

SEQ ID NO: 170472 - protein, 8 aa, Homo Sapiens
TAAPTVCL

SEQ ID NO: 170473 - protein, 8 aa, Homo Sapiens
TAAVHIIL

SEQ ID NO: 170474 - protein, 8 aa, Homo Sapiens
TAGPAVHL

SEQ ID NO: 170475 - protein, 8 aa, Homo Sapiens
TASEPLTL

SEQ ID NO: 170476 - protein, 8 aa, Homo Sapiens
TISPIIKL

SEQ ID NO: 170477 - protein, 8 aa, Homo Sapiens
TTAAPLLL

SEQ ID NO: 170478 - protein, 8 aa, Homo Sapiens
VAAAVSYL

SEQ ID NO: 170479 - protein, 8 aa, Homo Sapiens
VAAKETLL

SEQ ID NO: 170480 - protein, 8 aa, Homo Sapiens
VAAKEVVL

SEQ ID NO: 170481 - protein, 8 aa, Homo Sapiens
VAAKSVKL

SEQ ID NO: 170482 - protein, 8 aa, Homo Sapiens
VAAPILCL

SEQ ID NO: 170483 - protein, 8 aa, Homo Sapiens
VAATVVYL

SEQ ID NO: 170484 - protein, 8 aa, Homo Sapiens
VAGGAVYL

SEQ ID NO: 170485 - protein, 8 aa, Homo Sapiens
VAGPSVTL

SEQ ID NO: 170486 - protein, 8 aa, Homo Sapiens
VAGQVVEL

SEQ ID NO: 170487 - protein, 8 aa, Homo Sapiens
VAHKEIKL

SEQ ID NO: 170488 - protein, 8 aa, Homo Sapiens
VASKFITL

SEQ ID NO: 170489 - protein, 8 aa, Homo Sapiens
VATGPLSL

SEQ ID NO: 170490 - protein, 8 aa, Homo Sapiens
VGGPEIEL

SEQ ID NO: 170491 - protein, 8 aa, Homo Sapiens
VGSRPIKL

SEQ ID NO: 170492 - protein, 8 aa, Homo Sapiens
VIGPPVVL

SEQ ID NO: 170493 - protein, 8 aa, Homo Sapiens
VLAPVIDL

SEQ ID NO: 170494 - protein, 8 aa, Homo Sapiens
VSGPRLFL

SEQ ID NO: 170495 - protein, 8 aa, Homo Sapiens
VSSHEVFL

SEQ ID NO: 170496 - protein, 8 aa, Homo Sapiens
VTAKATIL

SEQ ID NO: 170497 - protein, 8 aa, Homo Sapiens
VVGPKICL

SEQ ID NO: 170498 - protein, 8 aa, Homo Sapiens
YAACEQRL

SEQ ID NO: 170499 - protein, 8 aa, Homo Sapiens
YAAEGQKL

SEQ ID NO: 170500 - protein, 8 aa, Homo Sapiens
YAAGENIR

SEQ ID NO: 170501 - protein, 8 aa, Homo Sapiens
YAAIPIKF

SEQ ID NO: 170502 - protein, 8 aa, Homo Sapiens
YAAQPELL

SEQ ID NO: 170503 - protein, 8 aa, Homo Sapiens
YAATFLHL

SEQ ID NO: 170504 - protein, 8 aa, Homo Sapiens
YAIEAIKL

SEQ ID NO: 170505 - protein, 8 aa, Homo Sapiens
YASKEVIL

SEQ ID NO: 170506 - protein, 8 aa, Homo Sapiens
YGSDRILL

SEQ ID NO: 170507 - protein, 8 aa, Homo Sapiens
YGSVPVLL

SEQ ID NO: 170508 - protein, 8 aa, Homo Sapiens
YIALPLTL

SEQ ID NO: 170509 - protein, 8 aa, Homo Sapiens
YIDKVRFL

SEQ ID NO: 170510 - protein, 8 aa, Homo Sapiens
YLAKVLWL

SEQ ID NO: 170511 - protein, 8 aa, Homo Sapiens
YLGKVLEL

SEQ ID NO: 170512 - protein, 8 aa, Homo Sapiens
YSNKEIFL

SEQ ID NO: 170513 - protein, 8 aa, Homo Sapiens
YSTEPNNL

SEQ ID NO: 170514 - protein, 8 aa, Homo Sapiens
YTAEPVTL

SEQ ID NO: 170515 - protein, 9 aa, Homo Sapiens
AAAAAIVFL

SEQ ID NO: 170516 - protein, 9 aa, Homo Sapiens
AAAAGMLLL

SEQ ID NO: 170517 - protein, 9 aa, Homo Sapiens
AAAASYPAL

SEQ ID NO: 170518 - protein, 9 aa, Homo Sapiens
AAADIVNFL

SEQ ID NO: 170519 - protein, 9 aa, Homo Sapiens
AAADSAVRL

SEQ ID NO: 170520 - protein, 9 aa, Homo Sapiens
AAAERPPRL

SEQ ID NO: 170521 - protein, 9 aa, Homo Sapiens
AAAGAPALL

SEQ ID NO: 170522 - protein, 9 aa, Homo Sapiens
AAAGSPLSL

SEQ ID NO: 170523 - protein, 9 aa, Homo Sapiens
AAAGSPVFL

SEQ ID NO: 170524 - protein, 9 aa, Homo Sapiens
AAAPHLLLL

SEQ ID NO: 170525 - protein, 9 aa, Homo Sapiens
AAAPSLLIL

SEQ ID NO: 170526 - protein, 9 aa, Homo Sapiens
AAAPTANLL

SEQ ID NO: 170527 - protein, 9 aa, Homo Sapiens
AAAQEPLQL

SEQ ID NO: 170528 - protein, 9 aa, Homo Sapiens
AAASHPLLL

SEQ ID NO: 170529 - protein, 9 aa, Homo Sapiens
AAASKVLNL

SEQ ID NO: 170530 - protein, 9 aa, Homo Sapiens
AAASQFTLL

SEQ ID NO: 170531 - protein, 9 aa, Homo Sapiens
AAATLTSKL

SEQ ID NO: 170532 - protein, 9 aa, Homo Sapiens
AAATSALLL

SEQ ID NO: 170533 - protein, 9 aa, Homo Sapiens
AAAVQAFYL

SEQ ID NO: 170534 - protein, 9 aa, Homo Sapiens
AACGGHVEL

SEQ ID NO: 170535 - protein, 9 aa, Homo Sapiens
AACRVIARL

SEQ ID NO: 170536 - protein, 9 aa, Homo Sapiens
AACSFFILL

SEQ ID NO: 170537 - protein, 9 aa, Homo Sapiens
AADPSVVNL

SEQ ID NO: 170538 - protein, 9 aa, Homo Sapiens
AADPVSPLL

SEQ ID NO: 170539 - protein, 9 aa, Homo Sapiens
AAFGRDLFL

SEQ ID NO: 170540 - protein, 9 aa, Homo Sapiens
AAFPSSLRL

SEQ ID NO: 170541 - protein, 9 aa, Homo Sapiens
AAFSLTSHL

SEQ ID NO: 170542 - protein, 9 aa, Homo Sapiens
AAGSHVIIL

SEQ ID NO: 170543 - protein, 9 aa, Homo Sapiens
AAIAPPTSL

SEQ ID NO: 170544 - protein, 9 aa, Homo Sapiens
AAIASLLYL

SEQ ID NO: 170545 - protein, 9 aa, Homo Sapiens
AAIGEATRL

SEQ ID NO: 170546 - protein, 9 aa, Homo Sapiens
AAIMQALWL

SEQ ID NO: 170547 - protein, 9 aa, Homo Sapiens
AAINRQINL

SEQ ID NO: 170548 - protein, 9 aa, Homo Sapiens
AAINRYSRL

SEQ ID NO: 170549 - protein, 9 aa, Homo Sapiens
AAIPPDYLL

SEQ ID NO: 170550 - protein, 9 aa, Homo Sapiens
AAIQGATLL

SEQ ID NO: 170551 - protein, 9 aa, Homo Sapiens
AAIQQRTLL

SEQ ID NO: 170552 - protein, 9 aa, Homo Sapiens
AAIWFRTYL

SEQ ID NO: 170553 - protein, 9 aa, Homo Sapiens
AAIYLVTSL

SEQ ID NO: 170554 - protein, 9 aa, Homo Sapiens
AALDKATVL

SEQ ID NO: 170555 - protein, 9 aa, Homo Sapiens
AALPKATIL

SEQ ID NO: 170556 - protein, 9 aa, Homo Sapiens
AALPRLIYL

SEQ ID NO: 170557 - protein, 9 aa, Homo Sapiens
AALPVYQEL

SEQ ID NO: 170558 - protein, 9 aa, Homo Sapiens
AALRLLTYL

SEQ ID NO: 170559 - protein, 9 aa, Homo Sapiens
AALSQVTLL

SEQ ID NO: 170560 - protein, 9 aa, Homo Sapiens
AANKTIIYL

SEQ ID NO: 170561 - protein, 9 aa, Homo Sapiens
AAQTKATFL

SEQ ID NO: 170562 - protein, 9 aa, Homo Sapiens
AASAQLLRL

SEQ ID NO: 170563 - protein, 9 aa, Homo Sapiens
AASPQAPTL

SEQ ID NO: 170564 - protein, 9 aa, Homo Sapiens
AASPSELHL

SEQ ID NO: 170565 - protein, 9 aa, Homo Sapiens
AASSSVCKL

SEQ ID NO: 170566 - protein, 9 aa, Homo Sapiens
AASTLVTWL

SEQ ID NO: 170567 - protein, 9 aa, Homo Sapiens
AATAQVSHL

SEQ ID NO: 170568 - protein, 9 aa, Homo Sapiens
AATDIFSYL

SEQ ID NO: 170569 - protein, 9 aa, Homo Sapiens
AATDITSSL

SEQ ID NO: 170570 - protein, 9 aa, Homo Sapiens
AATEREISL

SEQ ID NO: 170571 - protein, 9 aa, Homo Sapiens
AATHLTSKL

SEQ ID NO: 170572 - protein, 9 aa, Homo Sapiens
AATHRVVEL

SEQ ID NO: 170573 - protein, 9 aa, Homo Sapiens
AATKILTEL

SEQ ID NO: 170574 - protein, 9 aa, Homo Sapiens
AATKVTTVL

SEQ ID NO: 170575 - protein, 9 aa, Homo Sapiens
AATSLITTL

SEQ ID NO: 170576 - protein, 9 aa, Homo Sapiens
AATSRIAEL

SEQ ID NO: 170577 - protein, 9 aa, Homo Sapiens
AATVTITHL

SEQ ID NO: 170578 - protein, 9 aa, Homo Sapiens
AAVAPVLSI

SEQ ID NO: 170579 - protein, 9 aa, Homo Sapiens
AAVDRTTEL

SEQ ID NO: 170580 - protein, 9 aa, Homo Sapiens
AAVFGVTRL

SEQ ID NO: 170581 - protein, 9 aa, Homo Sapiens
AAVGEPAFL

SEQ ID NO: 170582 - protein, 9 aa, Homo Sapiens
AAVGFLSSL

SEQ ID NO: 170583 - protein, 9 aa, Homo Sapiens
AAVGFPTHL

SEQ ID NO: 170584 - protein, 9 aa, Homo Sapiens
AAVHGTTKL

SEQ ID NO: 170585 - protein, 9 aa, Homo Sapiens
AAVNHISQL

SEQ ID NO: 170586 - protein, 9 aa, Homo Sapiens
AAVPRAAFL

SEQ ID NO: 170587 - protein, 9 aa, Homo Sapiens
AAVRETVML

SEQ ID NO: 170588 - protein, 9 aa, Homo Sapiens
AAVRKPIVL

SEQ ID NO: 170589 - protein, 9 aa, Homo Sapiens
AAVSLITCL

SEQ ID NO: 170590 - protein, 9 aa, Homo Sapiens
AAYAGGLVL

SEQ ID NO: 170591 - protein, 9 aa, Homo Sapiens
AAYALVSNL

SEQ ID NO: 170592 - protein, 9 aa, Homo Sapiens
AAYCTGLLL

SEQ ID NO: 170593 - protein, 9 aa, Homo Sapiens
AAYDRYLKL

SEQ ID NO: 170594 - protein, 9 aa, Homo Sapiens
AAYGHRLCL

SEQ ID NO: 170595 - protein, 9 aa, Homo Sapiens
AAYGNRQNL

SEQ ID NO: 170596 - protein, 9 aa, Homo Sapiens
AAYHLIIEL

SEQ ID NO: 170597 - protein, 9 aa, Homo Sapiens
AAYLRALSL

SEQ ID NO: 170598 - protein, 9 aa, Homo Sapiens
AAYPRPGML

SEQ ID NO: 170599 - protein, 9 aa, Homo Sapiens
AAYRRALEL

SEQ ID NO: 170600 - protein, 9 aa, Homo Sapiens
AAYYHPSYL

SEQ ID NO: 170601 - protein, 9 aa, Homo Sapiens
AFLIPLLVW

SEQ ID NO: 170602 - protein, 9 aa, Homo Sapiens
AGIAHPSAL

SEQ ID NO: 170603 - protein, 9 aa, Homo Sapiens
AGVNTVTTL

SEQ ID NO: 170604 - protein, 9 aa, Homo Sapiens
AGVPLFLLE

SEQ ID NO: 170605 - protein, 9 aa, Homo Sapiens
AIIDKYIKL

SEQ ID NO: 170606 - protein, 9 aa, Homo Sapiens
AILMTVALL

SEQ ID NO: 170607 - protein, 9 aa, Homo Sapiens
AIMDLLLRL

SEQ ID NO: 170608 - protein, 9 aa, Homo Sapiens
AIVFIITRL

SEQ ID NO: 170609 - protein, 9 aa, Homo Sapiens
ALDVFALWL

SEQ ID NO: 170610 - protein, 9 aa, Homo Sapiens
ALPKLPISL

SEQ ID NO: 170611 - protein, 9 aa, Homo Sapiens
ALYSKGILL

SEQ ID NO: 170612 - protein, 9 aa, Homo Sapiens
ANSHQGQML

SEQ ID NO: 170613 - protein, 9 aa, Homo Sapiens
AQFEHTILL

SEQ ID NO: 170614 - protein, 9 aa, Homo Sapiens
AQLELISRI

SEQ ID NO: 170615 - protein, 9 aa, Homo Sapiens
AQYDRQIRL

SEQ ID NO: 170616 - protein, 9 aa, Homo Sapiens
ASDPRIIRL

SEQ ID NO: 170617 - protein, 9 aa, Homo Sapiens
ASIGSTIFL

SEQ ID NO: 170618 - protein, 9 aa, Homo Sapiens
ASINSTVRL

SEQ ID NO: 170619 - protein, 9 aa, Homo Sapiens
ASIWFISCL

SEQ ID NO: 170620 - protein, 9 aa, Homo Sapiens
ASTARHLYL

SEQ ID NO: 170621 - protein, 9 aa, Homo Sapiens
ASTCVIIKL

SEQ ID NO: 170622 - protein, 9 aa, Homo Sapiens
ASVDKVLEL

SEQ ID NO: 170623 - protein, 9 aa, Homo Sapiens
ASVDKVTRL

SEQ ID NO: 170624 - protein, 9 aa, Homo Sapiens
ASVGKTSIL

SEQ ID NO: 170625 - protein, 9 aa, Homo Sapiens
ATPVDPLFL

SEQ ID NO: 170626 - protein, 9 aa, Homo Sapiens
ATYHRAIKV

SEQ ID NO: 170627 - protein, 9 aa, Homo Sapiens
AVIESVTFL

SEQ ID NO: 170628 - protein, 9 aa, Homo Sapiens
AVIKGLTYL

SEQ ID NO: 170629 - protein, 9 aa, Homo Sapiens
AVVPLVGKL

SEQ ID NO: 170630 - protein, 9 aa, Homo Sapiens
EAVDLITRL

SEQ ID NO: 170631 - protein, 9 aa, Homo Sapiens
FAADIISVL

SEQ ID NO: 170632 - protein, 9 aa, Homo Sapiens
FAAGIIAHL

SEQ ID NO: 170633 - protein, 9 aa, Homo Sapiens
FAAGSATRL

SEQ ID NO: 170634 - protein, 9 aa, Homo Sapiens
FAAQSLVQL

SEQ ID NO: 170635 - protein, 9 aa, Homo Sapiens
FADAHRPKL

SEQ ID NO: 170636 - protein, 9 aa, Homo Sapiens
FADDGVKYL

SEQ ID NO: 170637 - protein, 9 aa, Homo Sapiens
FADFERHFL

SEQ ID NO: 170638 - protein, 9 aa, Homo Sapiens
FADGHVLEL

SEQ ID NO: 170639 - protein, 9 aa, Homo Sapiens
FADGVILLL

SEQ ID NO: 170640 - protein, 9 aa, Homo Sapiens
FADKHIQVL

SEQ ID NO: 170641 - protein, 9 aa, Homo Sapiens
FADQAEILL

SEQ ID NO: 170642 - protein, 9 aa, Homo Sapiens
FADQEVRSL

SEQ ID NO: 170643 - protein, 9 aa, Homo Sapiens
FADSHLWKL

SEQ ID NO: 170644 - protein, 9 aa, Homo Sapiens
FAERSVAKL

SEQ ID NO: 170645 - protein, 9 aa, Homo Sapiens
FAFRHVLKL

SEQ ID NO: 170646 - protein, 9 aa, Homo Sapiens
FAFRNFLYL

SEQ ID NO: 170647 - protein, 9 aa, Homo Sapiens
FAGNTPLHL

SEQ ID NO: 170648 - protein, 9 aa, Homo Sapiens
FAHHLPVWL

SEQ ID NO: 170649 - protein, 9 aa, Homo Sapiens
FAHLINVEF

SEQ ID NO: 170650 - protein, 9 aa, Homo Sapiens
FAIDPHLLL

SEQ ID NO: 170651 - protein, 9 aa, Homo Sapiens
FAILSFLHI

SEQ ID NO: 170652 - protein, 9 aa, Homo Sapiens
FAIPGSIFL

SEQ ID NO: 170653 - protein, 9 aa, Homo Sapiens
FAIPGSSFL

SEQ ID NO: 170654 - protein, 9 aa, Homo Sapiens
FAIPLIEKL

SEQ ID NO: 170655 - protein, 9 aa, Homo Sapiens
FAISILQQI

SEQ ID NO: 170656 - protein, 9 aa, Homo Sapiens
FALPSPQHI

SEQ ID NO: 170657 - protein, 9 aa, Homo Sapiens
FALRIASRL

SEQ ID NO: 170658 - protein, 9 aa, Homo Sapiens
FALSGPLFL

SEQ ID NO: 170659 - protein, 9 aa, Homo Sapiens
FAMPYFIQV

SEQ ID NO: 170660 - protein, 9 aa, Homo Sapiens
FANERCLQL

SEQ ID NO: 170661 - protein, 9 aa, Homo Sapiens
FASEYPLIL

SEQ ID NO: 170662 - protein, 9 aa, Homo Sapiens
FASFKPTYL

SEQ ID NO: 170663 - protein, 9 aa, Homo Sapiens
FASHVSPEV

SEQ ID NO: 170664 - protein, 9 aa, Homo Sapiens
FASKHAVKL

SEQ ID NO: 170665 - protein, 9 aa, Homo Sapiens
FASTYLLLL

SEQ ID NO: 170666 - protein, 9 aa, Homo Sapiens
FATKTVIYL

SEQ ID NO: 170667 - protein, 9 aa, Homo Sapiens
FATKVVHLL

SEQ ID NO: 170668 - protein, 9 aa, Homo Sapiens
FAVALPQLL

SEQ ID NO: 170669 - protein, 9 aa, Homo Sapiens
FAVDREARL

SEQ ID NO: 170670 - protein, 9 aa, Homo Sapiens
FAVEYFTRL

SEQ ID NO: 170671 - protein, 9 aa, Homo Sapiens
FAVNSVLRL

SEQ ID NO: 170672 - protein, 9 aa, Homo Sapiens
FAVTLETVL

SEQ ID NO: 170673 - protein, 9 aa, Homo Sapiens
FAVYIHALL

SEQ ID NO: 170674 - protein, 9 aa, Homo Sapiens
FAYEGPMYL

SEQ ID NO: 170675 - protein, 9 aa, Homo Sapiens
FAYGLLMEL

SEQ ID NO: 170676 - protein, 9 aa, Homo Sapiens
FAYLRDLLI

SEQ ID NO: 170677 - protein, 9 aa, Homo Sapiens
FAYNFREEL

SEQ ID NO: 170678 - protein, 9 aa, Homo Sapiens
FAYPAIRYL

SEQ ID NO: 170679 - protein, 9 aa, Homo Sapiens
FAYPAPLEV

SEQ ID NO: 170680 - protein, 9 aa, Homo Sapiens
FAYTRLQLL

SEQ ID NO: 170681 - protein, 9 aa, Homo Sapiens
FGCSAVVRL

SEQ ID NO: 170682 - protein, 9 aa, Homo Sapiens
FGIDRPAEL

SEQ ID NO: 170683 - protein, 9 aa, Homo Sapiens
FGLDLVTEL

SEQ ID NO: 170684 - protein, 9 aa, Homo Sapiens
FGYIHAIKL

SEQ ID NO: 170685 - protein, 9 aa, Homo Sapiens
FGYKHVLTL

SEQ ID NO: 170686 - protein, 9 aa, Homo Sapiens
FGYPDPTYL

SEQ ID NO: 170687 - protein, 9 aa, Homo Sapiens
FIGKIPIML

SEQ ID NO: 170688 - protein, 9 aa, Homo Sapiens
FIGKLRSNL

SEQ ID NO: 170689 - protein, 9 aa, Homo Sapiens
FIPKFITHL

SEQ ID NO: 170690 - protein, 9 aa, Homo Sapiens
FITEFPLFL

SEQ ID NO: 170691 - protein, 9 aa, Homo Sapiens
FIYKHGLKL

SEQ ID NO: 170692 - protein, 9 aa, Homo Sapiens
FLAHIYTEL

SEQ ID NO: 170693 - protein, 9 aa, Homo Sapiens
FLANVSTVL

SEQ ID NO: 170694 - protein, 9 aa, Homo Sapiens
FLCDVDIRL

SEQ ID NO: 170695 - protein, 9 aa, Homo Sapiens
FLFELPSRL

SEQ ID NO: 170696 - protein, 9 aa, Homo Sapiens
FLFSKFIEL

SEQ ID NO: 170697 - protein, 9 aa, Homo Sapiens
FLLQHQTFL

SEQ ID NO: 170698 - protein, 9 aa, Homo Sapiens
FLPDHPIVL

SEQ ID NO: 170699 - protein, 9 aa, Homo Sapiens
FLPQKIIYL

SEQ ID NO: 170700 - protein, 9 aa, Homo Sapiens
FLPSSVLWL

SEQ ID NO: 170701 - protein, 9 aa, Homo Sapiens
FLSHIPITL

SEQ ID NO: 170702 - protein, 9 aa, Homo Sapiens
FLSSVIQNL

SEQ ID NO: 170703 - protein, 9 aa, Homo Sapiens
FLTRIISQL

SEQ ID NO: 170704 - protein, 9 aa, Homo Sapiens
FLWERPTLL

SEQ ID NO: 170705 - protein, 9 aa, Homo Sapiens
FLYAGHIFL

SEQ ID NO: 170706 - protein, 9 aa, Homo Sapiens
FLYPFPLAL

SEQ ID NO: 170707 - protein, 9 aa, Homo Sapiens
FLYQYSTRL

SEQ ID NO: 170708 - protein, 9 aa, Homo Sapiens
FMVDRVVDL

SEQ ID NO: 170709 - protein, 9 aa, Homo Sapiens
FQNIRPLFI

SEQ ID NO: 170710 - protein, 9 aa, Homo Sapiens
FQSSAVMAL

SEQ ID NO: 170711 - protein, 9 aa, Homo Sapiens
FQYSKSPSL

SEQ ID NO: 170712 - protein, 9 aa, Homo Sapiens
FSCGVISTL

SEQ ID NO: 170713 - protein, 9 aa, Homo Sapiens
FSHAQTVVL

SEQ ID NO: 170714 - protein, 9 aa, Homo Sapiens
FSHSQITRL

SEQ ID NO: 170715 - protein, 9 aa, Homo Sapiens
FSIPCEPNL

SEQ ID NO: 170716 - protein, 9 aa, Homo Sapiens
FSLAPITKL

SEQ ID NO: 170717 - protein, 9 aa, Homo Sapiens
FSLMVVNRL

SEQ ID NO: 170718 - protein, 9 aa, Homo Sapiens
FSLPGATCL

SEQ ID NO: 170719 - protein, 9 aa, Homo Sapiens
FSLPHVGYL

SEQ ID NO: 170720 - protein, 9 aa, Homo Sapiens
FSNPRALYL

SEQ ID NO: 170721 - protein, 9 aa, Homo Sapiens
FSTFTITRL

SEQ ID NO: 170722 - protein, 9 aa, Homo Sapiens
FSVCHILLL

SEQ ID NO: 170723 - protein, 9 aa, Homo Sapiens
FSVPLPARL

SEQ ID NO: 170724 - protein, 9 aa, Homo Sapiens
FTCQRILFL

SEQ ID NO: 170725 - protein, 9 aa, Homo Sapiens
FTCRHVVHL

SEQ ID NO: 170726 - protein, 9 aa, Homo Sapiens
FTDVNKIYL

SEQ ID NO: 170727 - protein, 9 aa, Homo Sapiens
FTIGKAIWL

SEQ ID NO: 170728 - protein, 9 aa, Homo Sapiens
FTLSHITQL

SEQ ID NO: 170729 - protein, 9 aa, Homo Sapiens
FTMKTVLML

SEQ ID NO: 170730 - protein, 9 aa, Homo Sapiens
FTPDIPTML

SEQ ID NO: 170731 - protein, 9 aa, Homo Sapiens
FTSDIALRL

SEQ ID NO: 170732 - protein, 9 aa, Homo Sapiens
FTYKQVVDL

SEQ ID NO: 170733 - protein, 9 aa, Homo Sapiens
FTYNIPTCL

SEQ ID NO: 170734 - protein, 9 aa, Homo Sapiens
FVAESHIIL

SEQ ID NO: 170735 - protein, 9 aa, Homo Sapiens
FVANAIIHL

SEQ ID NO: 170736 - protein, 9 aa, Homo Sapiens
FVFPGELLL

SEQ ID NO: 170737 - protein, 9 aa, Homo Sapiens
FVHDLVLYL

SEQ ID NO: 170738 - protein, 9 aa, Homo Sapiens
FVIDLQTRL

SEQ ID NO: 170739 - protein, 9 aa, Homo Sapiens
FVLQRLVFL

SEQ ID NO: 170740 - protein, 9 aa, Homo Sapiens
FVLRVMTQL

SEQ ID NO: 170741 - protein, 9 aa, Homo Sapiens
FVMETFVHL

SEQ ID NO: 170742 - protein, 9 aa, Homo Sapiens
FVVDIESRL

SEQ ID NO: 170743 - protein, 9 aa, Homo Sapiens
FVYENPISL

SEQ ID NO: 170744 - protein, 9 aa, Homo Sapiens
GAADGVIRL

SEQ ID NO: 170745 - protein, 9 aa, Homo Sapiens
GAAPAPTAV

SEQ ID NO: 170746 - protein, 9 aa, Homo Sapiens
GADARALML

SEQ ID NO: 170747 - protein, 9 aa, Homo Sapiens
GADNSVVRF

SEQ ID NO: 170748 - protein, 9 aa, Homo Sapiens
GADPNATTL

SEQ ID NO: 170749 - protein, 9 aa, Homo Sapiens
GADPSTVEM

SEQ ID NO: 170750 - protein, 9 aa, Homo Sapiens
GAFFGPIRL

SEQ ID NO: 170751 - protein, 9 aa, Homo Sapiens
GAFGKETDL

SEQ ID NO: 170752 - protein, 9 aa, Homo Sapiens
GAHQGVAVL

SEQ ID NO: 170753 - protein, 9 aa, Homo Sapiens
GAIARPACL

SEQ ID NO: 170754 - protein, 9 aa, Homo Sapiens
GAIFVPIHL

SEQ ID NO: 170755 - protein, 9 aa, Homo Sapiens
GAILVVTKL

SEQ ID NO: 170756 - protein, 9 aa, Homo Sapiens
GAINHVLQL

SEQ ID NO: 170757 - protein, 9 aa, Homo Sapiens
GAISKIFVL

SEQ ID NO: 170758 - protein, 9 aa, Homo Sapiens
GAQLHVTYL

SEQ ID NO: 170759 - protein, 9 aa, Homo Sapiens
GASNSAPHL

SEQ ID NO: 170760 - protein, 9 aa, Homo Sapiens
GATLRTSRL

SEQ ID NO: 170761 - protein, 9 aa, Homo Sapiens
GATPTPLLL

SEQ ID NO: 170762 - protein, 9 aa, Homo Sapiens
GATSLVTLL

SEQ ID NO: 170763 - protein, 9 aa, Homo Sapiens
GATTTAPSL

SEQ ID NO: 170764 - protein, 9 aa, Homo Sapiens
GATVTVLRL

SEQ ID NO: 170765 - protein, 9 aa, Homo Sapiens
GAVERPLSL

SEQ ID NO: 170766 - protein, 9 aa, Homo Sapiens
GAVGSRVTL

SEQ ID NO: 170767 - protein, 9 aa, Homo Sapiens
GAVKKLTKL

SEQ ID NO: 170768 - protein, 9 aa, Homo Sapiens
GAVPGITKF

SEQ ID NO: 170769 - protein, 9 aa, Homo Sapiens
GAVPIFIEL

SEQ ID NO: 170770 - protein, 9 aa, Homo Sapiens
GAVPIFIKL

SEQ ID NO: 170771 - protein, 9 aa, Homo Sapiens
GAVSTASHL

SEQ ID NO: 170772 - protein, 9 aa, Homo Sapiens
GAYGGGAKL

SEQ ID NO: 170773 - protein, 9 aa, Homo Sapiens
GAYGKVFLV

SEQ ID NO: 170774 - protein, 9 aa, Homo Sapiens
GAYHAVVLL

SEQ ID NO: 170775 - protein, 9 aa, Homo Sapiens
GAYKYIQEL

SEQ ID NO: 170776 - protein, 9 aa, Homo Sapiens
GAYRGGERL

SEQ ID NO: 170777 - protein, 9 aa, Homo Sapiens
GAYSPIVLL

SEQ ID NO: 170778 - protein, 9 aa, Homo Sapiens
GAYTQVIFL

SEQ ID NO: 170779 - protein, 9 aa, Homo Sapiens
GAYVHMVTH

SEQ ID NO: 170780 - protein, 9 aa, Homo Sapiens
GGITSVIKL

SEQ ID NO: 170781 - protein, 9 aa, Homo Sapiens
GISPVPINL

SEQ ID NO: 170782 - protein, 9 aa, Homo Sapiens
GIVGVFVKL

SEQ ID NO: 170783 - protein, 9 aa, Homo Sapiens
GLIDHQTYL

SEQ ID NO: 170784 - protein, 9 aa, Homo Sapiens
GLIENPALL

SEQ ID NO: 170785 - protein, 9 aa, Homo Sapiens
GLPRWVTLL

SEQ ID NO: 170786 - protein, 9 aa, Homo Sapiens
GLYCGKTLL

SEQ ID NO: 170787 - protein, 9 aa, Homo Sapiens
GLYEGLTWL

SEQ ID NO: 170788 - protein, 9 aa, Homo Sapiens
GQTSVVSFL

SEQ ID NO: 170789 - protein, 9 aa, Homo Sapiens
GQVGHILEL

SEQ ID NO: 170790 - protein, 9 aa, Homo Sapiens
GQYPRALEL

SEQ ID NO: 170791 - protein, 9 aa, Homo Sapiens
GQYSHLVLL

SEQ ID NO: 170792 - protein, 9 aa, Homo Sapiens
GSDPRVTQL

SEQ ID NO: 170793 - protein, 9 aa, Homo Sapiens
GSDPSIISL

SEQ ID NO: 170794 - protein, 9 aa, Homo Sapiens
GSSGGVIRL

SEQ ID NO: 170795 - protein, 9 aa, Homo Sapiens
GSTGTVAHL

SEQ ID NO: 170796 - protein, 9 aa, Homo Sapiens
GSTRIITRL

SEQ ID NO: 170797 - protein, 9 aa, Homo Sapiens
GSVNRVTIL

SEQ ID NO: 170798 - protein, 9 aa, Homo Sapiens
GSVSDIIRL

SEQ ID NO: 170799 - protein, 9 aa, Homo Sapiens
GSVSNPLFL

SEQ ID NO: 170800 - protein, 9 aa, Homo Sapiens
GSYFRVTLL

SEQ ID NO: 170801 - protein, 9 aa, Homo Sapiens
GSYGRKTVL

SEQ ID NO: 170802 - protein, 9 aa, Homo Sapiens
GTMGKPIKL

SEQ ID NO: 170803 - protein, 9 aa, Homo Sapiens
GTVDDVPKL

SEQ ID NO: 170804 - protein, 9 aa, Homo Sapiens
GTVEQIVYL

SEQ ID NO: 170805 - protein, 9 aa, Homo Sapiens
GTYTLIIRL

SEQ ID NO: 170806 - protein, 9 aa, Homo Sapiens
GVIATIAFL

SEQ ID NO: 170807 - protein, 9 aa, Homo Sapiens
GVSPEPIHL

SEQ ID NO: 170808 - protein, 9 aa, Homo Sapiens
GVVDHQTEL

SEQ ID NO: 170809 - protein, 9 aa, Homo Sapiens
HAAPQPQKL

SEQ ID NO: 170810 - protein, 9 aa, Homo Sapiens
HAGPVINTL

SEQ ID NO: 170811 - protein, 9 aa, Homo Sapiens
HAIFKLTYL

SEQ ID NO: 170812 - protein, 9 aa, Homo Sapiens
HAIYWPAFL

SEQ ID NO: 170813 - protein, 9 aa, Homo Sapiens
HAMQFPAEL

SEQ ID NO: 170814 - protein, 9 aa, Homo Sapiens
HASDRIIAL

SEQ ID NO: 170815 - protein, 9 aa, Homo Sapiens
HASSSIVSL

SEQ ID NO: 170816 - protein, 9 aa, Homo Sapiens
HAVLLVTQL

SEQ ID NO: 170817 - protein, 9 aa, Homo Sapiens
HAVRQPVFL

SEQ ID NO: 170818 - protein, 9 aa, Homo Sapiens
HAYDREVHL

SEQ ID NO: 170819 - protein, 9 aa, Homo Sapiens
HIPDVITYL

SEQ ID NO: 170820 - protein, 9 aa, Homo Sapiens
HQAFSVVFL

SEQ ID NO: 170821 - protein, 9 aa, Homo Sapiens
HQYDGLVEL

SEQ ID NO: 170822 - protein, 9 aa, Homo Sapiens
HSISIPTKL

SEQ ID NO: 170823 - protein, 9 aa, Homo Sapiens
HSLSFETQL

SEQ ID NO: 170824 - protein, 9 aa, Homo Sapiens
HSPGAVSSL

SEQ ID NO: 170825 - protein, 9 aa, Homo Sapiens
HVYHHASML

SEQ ID NO: 170826 - protein, 9 aa, Homo Sapiens
HVYSGVVNL

SEQ ID NO: 170827 - protein, 9 aa, Homo Sapiens
IAAGIFNDL

SEQ ID NO: 170828 - protein, 9 aa, Homo Sapiens
IAAGLYLLL

SEQ ID NO: 170829 - protein, 9 aa, Homo Sapiens
IAAKKVLRL

SEQ ID NO: 170830 - protein, 9 aa, Homo Sapiens
IAAPFTSKL

SEQ ID NO: 170831 - protein, 9 aa, Homo Sapiens
IADPNIAKL

SEQ ID NO: 170832 - protein, 9 aa, Homo Sapiens
IAIGKVLKL

SEQ ID NO: 170833 - protein, 9 aa, Homo Sapiens
IALEATQLL

SEQ ID NO: 170834 - protein, 9 aa, Homo Sapiens
IANPTATLL

SEQ ID NO: 170835 - protein, 9 aa, Homo Sapiens
IAPGVTHEL

SEQ ID NO: 170836 - protein, 9 aa, Homo Sapiens
IAYSRPVYF

SEQ ID NO: 170837 - protein, 9 aa, Homo Sapiens
IGAGAPVYL

SEQ ID NO: 170838 - protein, 9 aa, Homo Sapiens
IGVGAVTML

SEQ ID NO: 170839 - protein, 9 aa, Homo Sapiens
IGYPITLYL

SEQ ID NO: 170840 - protein, 9 aa, Homo Sapiens
IIFATPTKL

SEQ ID NO: 170841 - protein, 9 aa, Homo Sapiens
IITRVETYL

SEQ ID NO: 170842 - protein, 9 aa, Homo Sapiens
ILDPHVVLL

SEQ ID NO: 170843 - protein, 9 aa, Homo Sapiens
ILYGKIIHL

SEQ ID NO: 170844 - protein, 9 aa, Homo Sapiens
ISTNSHPIL

SEQ ID NO: 170845 - protein, 9 aa, Homo Sapiens
ISVGVINLL

SEQ ID NO: 170846 - protein, 9 aa, Homo Sapiens
ITSDQPILL

SEQ ID NO: 170847 - protein, 9 aa, Homo Sapiens
IVMEHVVFL

SEQ ID NO: 170848 - protein, 9 aa, Homo Sapiens
IVYPKPTWL

SEQ ID NO: 170849 - protein, 9 aa, Homo Sapiens
KAAEVYTRL

SEQ ID NO: 170850 - protein, 9 aa, Homo Sapiens
KAASKVTLL

SEQ ID NO: 170851 - protein, 9 aa, Homo Sapiens
KADGVPVYL

SEQ ID NO: 170852 - protein, 9 aa, Homo Sapiens
KADSVVVLL

SEQ ID NO: 170853 - protein, 9 aa, Homo Sapiens
KAFAKKTYL

SEQ ID NO: 170854 - protein, 9 aa, Homo Sapiens
KAFNHRSYL

SEQ ID NO: 170855 - protein, 9 aa, Homo Sapiens
KAFNTSSHL

SEQ ID NO: 170856 - protein, 9 aa, Homo Sapiens
KAFPYSSHL

SEQ ID NO: 170857 - protein, 9 aa, Homo Sapiens
KAFQHPSHL

SEQ ID NO: 170858 - protein, 9 aa, Homo Sapiens
KAFQKIVVL

SEQ ID NO: 170859 - protein, 9 aa, Homo Sapiens
KAFSYPSKL

SEQ ID NO: 170860 - protein, 9 aa, Homo Sapiens
KALGHPAML

SEQ ID NO: 170861 - protein, 9 aa, Homo Sapiens
KAPGSTSNL

SEQ ID NO: 170862 - protein, 9 aa, Homo Sapiens
KAPVTKVAA

SEQ ID NO: 170863 - protein, 9 aa, Homo Sapiens
KATGKISKL

SEQ ID NO: 170864 - protein, 9 aa, Homo Sapiens
KAVASVARL

SEQ ID NO: 170865 - protein, 9 aa, Homo Sapiens
KAVGTITKL

SEQ ID NO: 170866 - protein, 9 aa, Homo Sapiens
KAYELALYL

SEQ ID NO: 170867 - protein, 9 aa, Homo Sapiens
KAYERGISL

SEQ ID NO: 170868 - protein, 9 aa, Homo Sapiens
KAYVRVLDL

SEQ ID NO: 170869 - protein, 9 aa, Homo Sapiens
KAYYKSSHL

SEQ ID NO: 170870 - protein, 9 aa, Homo Sapiens
KIPNFCVLL

SEQ ID NO: 170871 - protein, 9 aa, Homo Sapiens
KIYEEPIIL

SEQ ID NO: 170872 - protein, 9 aa, Homo Sapiens
KQYGNEVFL

SEQ ID NO: 170873 - protein, 9 aa, Homo Sapiens
KSDPSIVRL

SEQ ID NO: 170874 - protein, 9 aa, Homo Sapiens
KSIKNVTEL

SEQ ID NO: 170875 - protein, 9 aa, Homo Sapiens
KSTSNITKL

SEQ ID NO: 170876 - protein, 9 aa, Homo Sapiens
KTPNFSTLL

SEQ ID NO: 170877 - protein, 9 aa, Homo Sapiens
LAAFVPLLL

SEQ ID NO: 170878 - protein, 9 aa, Homo Sapiens
LAAGHLVQL

SEQ ID NO: 170879 - protein, 9 aa, Homo Sapiens
LAAHIPLFL

SEQ ID NO: 170880 - protein, 9 aa, Homo Sapiens
LAAKKAVWL

SEQ ID NO: 170881 - protein, 9 aa, Homo Sapiens
LAAPQLIML

SEQ ID NO: 170882 - protein, 9 aa, Homo Sapiens
LAAPVISVL

SEQ ID NO: 170883 - protein, 9 aa, Homo Sapiens
LAARLVTFL

SEQ ID NO: 170884 - protein, 9 aa, Homo Sapiens
LAASVFTCL

SEQ ID NO: 170885 - protein, 9 aa, Homo Sapiens
LADKNVPNL

SEQ ID NO: 170886 - protein, 9 aa, Homo Sapiens
LADSKEIFL

SEQ ID NO: 170887 - protein, 9 aa, Homo Sapiens
LAFEGPILL

SEQ ID NO: 170888 - protein, 9 aa, Homo Sapiens
LAFPGEMLL

SEQ ID NO: 170889 - protein, 9 aa, Homo Sapiens
LAFPSPEKL

SEQ ID NO: 170890 - protein, 9 aa, Homo Sapiens
LAFSRALEL

SEQ ID NO: 170891 - protein, 9 aa, Homo Sapiens
LAFSRPSQL

SEQ ID NO: 170892 - protein, 9 aa, Homo Sapiens
LAIASGIYL

SEQ ID NO: 170893 - protein, 9 aa, Homo Sapiens
LAIFVICQL

SEQ ID NO: 170894 - protein, 9 aa, Homo Sapiens
LAITDEILL

SEQ ID NO: 170895 - protein, 9 aa, Homo Sapiens
LALLHLLYL

SEQ ID NO: 170896 - protein, 9 aa, Homo Sapiens
LALLLPVFL

SEQ ID NO: 170897 - protein, 9 aa, Homo Sapiens
LASSYIAHL

SEQ ID NO: 170898 - protein, 9 aa, Homo Sapiens
LATASSPKF

SEQ ID NO: 170899 - protein, 9 aa, Homo Sapiens
LATRAIPEL

SEQ ID NO: 170900 - protein, 9 aa, Homo Sapiens
LATRSFPQL

SEQ ID NO: 170901 - protein, 9 aa, Homo Sapiens
LAVAHPLLL

SEQ ID NO: 170902 - protein, 9 aa, Homo Sapiens
LAVLHTVLL

SEQ ID NO: 170903 - protein, 9 aa, Homo Sapiens
LAVRVVTLL

SEQ ID NO: 170904 - protein, 9 aa, Homo Sapiens
LAYEKIAYL

SEQ ID NO: 170905 - protein, 9 aa, Homo Sapiens
LAYHLAVVL

SEQ ID NO: 170906 - protein, 9 aa, Homo Sapiens
LAYIHLIEF

SEQ ID NO: 170907 - protein, 9 aa, Homo Sapiens
LAYPFQSLL

SEQ ID NO: 170908 - protein, 9 aa, Homo Sapiens
LAYSEPCGL

SEQ ID NO: 170909 - protein, 9 aa, Homo Sapiens
LAYTGFVKL

SEQ ID NO: 170910 - protein, 9 aa, Homo Sapiens
LAYYGFTKL

SEQ ID NO: 170911 - protein, 9 aa, Homo Sapiens
LGTAFMLWL

SEQ ID NO: 170912 - protein, 9 aa, Homo Sapiens
LISKIPHIL

SEQ ID NO: 170913 - protein, 9 aa, Homo Sapiens
LIYGRPVYV

SEQ ID NO: 170914 - protein, 9 aa, Homo Sapiens
LQYSFPLQL

SEQ ID NO: 170915 - protein, 9 aa, Homo Sapiens
LSDTRTRYL

SEQ ID NO: 170916 - protein, 9 aa, Homo Sapiens
LTDQTLIYL

SEQ ID NO: 170917 - protein, 9 aa, Homo Sapiens
LTPYRVIFL

SEQ ID NO: 170918 - protein, 9 aa, Homo Sapiens
LVIGRVLEL

SEQ ID NO: 170919 - protein, 9 aa, Homo Sapiens
LVTHLVTKL

SEQ ID NO: 170920 - protein, 9 aa, Homo Sapiens
MADPNIRFL

SEQ ID NO: 170921 - protein, 9 aa, Homo Sapiens
MAINSISKL

SEQ ID NO: 170922 - protein, 9 aa, Homo Sapiens
MANGAVIHL

SEQ ID NO: 170923 - protein, 9 aa, Homo Sapiens
MAPHWAVWL

SEQ ID NO: 170924 - protein, 9 aa, Homo Sapiens
MAVRLVTEL

SEQ ID NO: 170925 - protein, 9 aa, Homo Sapiens
MAYARQIYI

SEQ ID NO: 170926 - protein, 9 aa, Homo Sapiens
NADPIAKYL

SEQ ID NO: 170927 - protein, 9 aa, Homo Sapiens
NAFSGVMML

SEQ ID NO: 170928 - protein, 9 aa, Homo Sapiens
NASEHIVYL

SEQ ID NO: 170929 - protein, 9 aa, Homo Sapiens
NATIRVTNL

SEQ ID NO: 170930 - protein, 9 aa, Homo Sapiens
NAVCKLTYL

SEQ ID NO: 170931 - protein, 9 aa, Homo Sapiens
NAVSQITRM

SEQ ID NO: 170932 - protein, 9 aa, Homo Sapiens
NAVSVHSNL

SEQ ID NO: 170933 - protein, 9 aa, Homo Sapiens
NAYTGIVLL

SEQ ID NO: 170934 - protein, 9 aa, Homo Sapiens
NSPEKACSL

SEQ ID NO: 170935 - protein, 9 aa, Homo Sapiens
NVPVRDIPA

SEQ ID NO: 170936 - protein, 9 aa, Homo Sapiens
PLYARPIFL

SEQ ID NO: 170937 - protein, 9 aa, Homo Sapiens
QAFPRITQL

SEQ ID NO: 170938 - protein, 9 aa, Homo Sapiens
QAITALAHL

SEQ ID NO: 170939 - protein, 9 aa, Homo Sapiens
QASHQPLYL

SEQ ID NO: 170940 - protein, 9 aa, Homo Sapiens
QIPEIKQTL

SEQ ID NO: 170941 - protein, 9 aa, Homo Sapiens
QSAPAPVML

SEQ ID NO: 170942 - protein, 9 aa, Homo Sapiens
QSIAFISRL

SEQ ID NO: 170943 - protein, 9 aa, Homo Sapiens
QSYGNVVEL

SEQ ID NO: 170944 - protein, 9 aa, Homo Sapiens
QTIALITYL

SEQ ID NO: 170945 - protein, 9 aa, Homo Sapiens
QTYFFPIHL

SEQ ID NO: 170946 - protein, 9 aa, Homo Sapiens
RAADVLVYL

SEQ ID NO: 170947 - protein, 9 aa, Homo Sapiens
RAAPHRISL

SEQ ID NO: 170948 - protein, 9 aa, Homo Sapiens
RAAPPPLFL

SEQ ID NO: 170949 - protein, 9 aa, Homo Sapiens
RAASKTVRL

SEQ ID NO: 170950 - protein, 9 aa, Homo Sapiens
RAFDHVLHL

SEQ ID NO: 170951 - protein, 9 aa, Homo Sapiens
RALDHYLTL

SEQ ID NO: 170952 - protein, 9 aa, Homo Sapiens
RALEHFTDL

SEQ ID NO: 170953 - protein, 9 aa, Homo Sapiens
RAMKHPLGL

SEQ ID NO: 170954 - protein, 9 aa, Homo Sapiens
RAQGRVLRL

SEQ ID NO: 170955 - protein, 9 aa, Homo Sapiens
RATPHPSEL

SEQ ID NO: 170956 - protein, 9 aa, Homo Sapiens
RAVGVQNYL

SEQ ID NO: 170957 - protein, 9 aa, Homo Sapiens
RAVHILTKL

SEQ ID NO: 170958 - protein, 9 aa, Homo Sapiens
RAVNDYPSL

SEQ ID NO: 170959 - protein, 9 aa, Homo Sapiens
RAYDGTTYL

SEQ ID NO: 170960 - protein, 9 aa, Homo Sapiens
RAYQCVVLL

SEQ ID NO: 170961 - protein, 9 aa, Homo Sapiens
RAYTSETYL

SEQ ID NO: 170962 - protein, 9 aa, Homo Sapiens
RIPSFVTEL

SEQ ID NO: 170963 - protein, 9 aa, Homo Sapiens
RISNPPILL

SEQ ID NO: 170964 - protein, 9 aa, Homo Sapiens
RIYGNKTEL

SEQ ID NO: 170965 - protein, 9 aa, Homo Sapiens
RIYQKKTQL

SEQ ID NO: 170966 - protein, 9 aa, Homo Sapiens
RSHYSPIYL

SEQ ID NO: 170967 - protein, 9 aa, Homo Sapiens
RSLPFPTVL

SEQ ID NO: 170968 - protein, 9 aa, Homo Sapiens
RSYWKEVLL

SEQ ID NO: 170969 - protein, 9 aa, Homo Sapiens
RTIGVITKL

SEQ ID NO: 170970 - protein, 9 aa, Homo Sapiens
RVVDLITNL

SEQ ID NO: 170971 - protein, 9 aa, Homo Sapiens
RVVDNPIYL

SEQ ID NO: 170972 - protein, 9 aa, Homo Sapiens
RVYPKCTWL

SEQ ID NO: 170973 - protein, 9 aa, Homo Sapiens
SAAASPVHL

SEQ ID NO: 170974 - protein, 9 aa, Homo Sapiens
SAAGLPVCL

SEQ ID NO: 170975 - protein, 9 aa, Homo Sapiens
SAAGVLIKL

SEQ ID NO: 170976 - protein, 9 aa, Homo Sapiens
SAALSCTFL

SEQ ID NO: 170977 - protein, 9 aa, Homo Sapiens
SAAMGGILL

SEQ ID NO: 170978 - protein, 9 aa, Homo Sapiens
SAAMVFSAL

SEQ ID NO: 170979 - protein, 9 aa, Homo Sapiens
SAAPGTASL

SEQ ID NO: 170980 - protein, 9 aa, Homo Sapiens
SAAPRTVAL

SEQ ID NO: 170981 - protein, 9 aa, Homo Sapiens
SAAPSPAAL

SEQ ID NO: 170982 - protein, 9 aa, Homo Sapiens
SAAPSPQKL

SEQ ID NO: 170983 - protein, 9 aa, Homo Sapiens
SAAPTFLLL

SEQ ID NO: 170984 - protein, 9 aa, Homo Sapiens
SAAPVAHLL

SEQ ID NO: 170985 - protein, 9 aa, Homo Sapiens
SAATKIVFL

SEQ ID NO: 170986 - protein, 9 aa, Homo Sapiens
SACDGIFHL

SEQ ID NO: 170987 - protein, 9 aa, Homo Sapiens
SACGHTAVL

SEQ ID NO: 170988 - protein, 9 aa, Homo Sapiens
SADKFQVLL

SEQ ID NO: 170989 - protein, 9 aa, Homo Sapiens
SADPEARRL

SEQ ID NO: 170990 - protein, 9 aa, Homo Sapiens
SADPNVVDL

SEQ ID NO: 170991 - protein, 9 aa, Homo Sapiens
SADPRHILL

SEQ ID NO: 170992 - protein, 9 aa, Homo Sapiens
SADSRIAEL

SEQ ID NO: 170993 - protein, 9 aa, Homo Sapiens
SAFGGAARL

SEQ ID NO: 170994 - protein, 9 aa, Homo Sapiens
SAFLHAIRL

SEQ ID NO: 170995 - protein, 9 aa, Homo Sapiens
SAFLSAIFL

SEQ ID NO: 170996 - protein, 9 aa, Homo Sapiens
SAFNEITKL

SEQ ID NO: 170997 - protein, 9 aa, Homo Sapiens
SAFRGVGLL

SEQ ID NO: 170998 - protein, 9 aa, Homo Sapiens
SAIDRIFTL

SEQ ID NO: 170999 - protein, 9 aa, Homo Sapiens
SAIGLPVCL

SEQ ID NO: 171000 - protein, 9 aa, Homo Sapiens
SAIGVLAFL

SEQ ID NO: 171001 - protein, 9 aa, Homo Sapiens
SAIGYIHSL

SEQ ID NO: 171002 - protein, 9 aa, Homo Sapiens
SAIHTIAHL

SEQ ID NO: 171003 - protein, 9 aa, Homo Sapiens
SAIIVASYL

SEQ ID NO: 171004 - protein, 9 aa, Homo Sapiens
SAIQGVALL

SEQ ID NO: 171005 - protein, 9 aa, Homo Sapiens
SAIQLVSCL

SEQ ID NO: 171006 - protein, 9 aa, Homo Sapiens
SAKERPIWL

SEQ ID NO: 171007 - protein, 9 aa, Homo Sapiens
SAKSWPIFL

SEQ ID NO: 171008 - protein, 9 aa, Homo Sapiens
SALEFLTQL

SEQ ID NO: 171009 - protein, 9 aa, Homo Sapiens
SALGHLSFL

SEQ ID NO: 171010 - protein, 9 aa, Homo Sapiens
SALGSQAHL

SEQ ID NO: 171011 - protein, 9 aa, Homo Sapiens
SALPFITYL

SEQ ID NO: 171012 - protein, 9 aa, Homo Sapiens
SALSAPTLL

SEQ ID NO: 171013 - protein, 9 aa, Homo Sapiens
SAMAVVSRL

SEQ ID NO: 171014 - protein, 9 aa, Homo Sapiens
SANDGFVRL

SEQ ID NO: 171015 - protein, 9 aa, Homo Sapiens
SAPTETHSL

SEQ ID NO: 171016 - protein, 9 aa, Homo Sapiens
SAQGKPLAL

SEQ ID NO: 171017 - protein, 9 aa, Homo Sapiens
SASAAEVLL

SEQ ID NO: 171018 - protein, 9 aa, Homo Sapiens
SASASSPKL

SEQ ID NO: 171019 - protein, 9 aa, Homo Sapiens
SASNSFSRL

SEQ ID NO: 171020 - protein, 9 aa, Homo Sapiens
SASPSVAQL

SEQ ID NO: 171021 - protein, 9 aa, Homo Sapiens
SATEALLWL

SEQ ID NO: 171022 - protein, 9 aa, Homo Sapiens
SATGTVSDL

SEQ ID NO: 171023 - protein, 9 aa, Homo Sapiens
SATICLAYL

SEQ ID NO: 171024 - protein, 9 aa, Homo Sapiens
SATIVIAYL

SEQ ID NO: 171025 - protein, 9 aa, Homo Sapiens
SATPRPLHL

SEQ ID NO: 171026 - protein, 9 aa, Homo Sapiens
SATQVFPRL

SEQ ID NO: 171027 - protein, 9 aa, Homo Sapiens
SATQVYTIL

SEQ ID NO: 171028 - protein, 9 aa, Homo Sapiens
SATRVYIVL

SEQ ID NO: 171029 - protein, 9 aa, Homo Sapiens
SAVAVCSFL

SEQ ID NO: 171030 - protein, 9 aa, Homo Sapiens
SAVENLLLL

SEQ ID NO: 171031 - protein, 9 aa, Homo Sapiens
SAVFMVTRL

SEQ ID NO: 171032 - protein, 9 aa, Homo Sapiens
SAVGKTSFL

SEQ ID NO: 171033 - protein, 9 aa, Homo Sapiens
SAVPCALLL

SEQ ID NO: 171034 - protein, 9 aa, Homo Sapiens
SAVTPVTIL

SEQ ID NO: 171035 - protein, 9 aa, Homo Sapiens
SAVTRLLIL

SEQ ID NO: 171036 - protein, 9 aa, Homo Sapiens
SAVTTTAHL

SEQ ID NO: 171037 - protein, 9 aa, Homo Sapiens
SAYEFVTWL

SEQ ID NO: 171038 - protein, 9 aa, Homo Sapiens
SAYGAAAHL

SEQ ID NO: 171039 - protein, 9 aa, Homo Sapiens
SAYKELTDL

SEQ ID NO: 171040 - protein, 9 aa, Homo Sapiens
SGAPHAILL

SEQ ID NO: 171041 - protein, 9 aa, Homo Sapiens
SGFGGITML

SEQ ID NO: 171042 - protein, 9 aa, Homo Sapiens
SGFSGVIRL

SEQ ID NO: 171043 - protein, 9 aa, Homo Sapiens
SGISRLTWL

SEQ ID NO: 171044 - protein, 9 aa, Homo Sapiens
SGLTHVTSL

SEQ ID NO: 171045 - protein, 9 aa, Homo Sapiens
SGPGPAAAL

SEQ ID NO: 171046 - protein, 9 aa, Homo Sapiens
SGVKKPIYL

SEQ ID NO: 171047 - protein, 9 aa, Homo Sapiens
SIADRPLYL

SEQ ID NO: 171048 - protein, 9 aa, Homo Sapiens
SIIALCTHL

SEQ ID NO: 171049 - protein, 9 aa, Homo Sapiens
SIPDFPMHL

SEQ ID NO: 171050 - protein, 9 aa, Homo Sapiens
SIYRVPLLL

SEQ ID NO: 171051 - protein, 9 aa, Homo Sapiens
SIYSRFVQL

SEQ ID NO: 171052 - protein, 9 aa, Homo Sapiens
SLAHRPVRL

SEQ ID NO: 171053 - protein, 9 aa, Homo Sapiens
SLYPHFTLL

SEQ ID NO: 171054 - protein, 9 aa, Homo Sapiens
SNYSHVIFL

SEQ ID NO: 171055 - protein, 9 aa, Homo Sapiens
SQVPFPSRL

SEQ ID NO: 171056 - protein, 9 aa, Homo Sapiens
SQYPFPVTL

SEQ ID NO: 171057 - protein, 9 aa, Homo Sapiens
SSHARPVSL

SEQ ID NO: 171058 - protein, 9 aa, Homo Sapiens
SSHGGEIFL

SEQ ID NO: 171059 - protein, 9 aa, Homo Sapiens
SSHGNPILL

SEQ ID NO: 171060 - protein, 9 aa, Homo Sapiens
SSIEHLTTL

SEQ ID NO: 171061 - protein, 9 aa, Homo Sapiens
SSSPNIMLL

SEQ ID NO: 171062 - protein, 9 aa, Homo Sapiens
SSVATITRL

SEQ ID NO: 171063 - protein, 9 aa, Homo Sapiens
SSVATVVYL

SEQ ID NO: 171064 - protein, 9 aa, Homo Sapiens
SSVGKVSVL

SEQ ID NO: 171065 - protein, 9 aa, Homo Sapiens
SSVTKVLLL

SEQ ID NO: 171066 - protein, 9 aa, Homo Sapiens
SSYKEVTEL

SEQ ID NO: 171067 - protein, 9 aa, Homo Sapiens
SSYPGKTAL

SEQ ID NO: 171068 - protein, 9 aa, Homo Sapiens
SSYYGVVRL

SEQ ID NO: 171069 - protein, 9 aa, Homo Sapiens
STIRLLTSL

SEQ ID NO: 171070 - protein, 9 aa, Homo Sapiens
STPQHPLLL

SEQ ID NO: 171071 - protein, 9 aa, Homo Sapiens
SVISVVSYL

SEQ ID NO: 171072 - protein, 9 aa, Homo Sapiens
SVYSGCLHL

SEQ ID NO: 171073 - protein, 9 aa, Homo Sapiens
TAAGGTVHL

SEQ ID NO: 171074 - protein, 9 aa, Homo Sapiens
TAAGKEVML

SEQ ID NO: 171075 - protein, 9 aa, Homo Sapiens
TAAPSASLL

SEQ ID NO: 171076 - protein, 9 aa, Homo Sapiens
TAAPSPLRL

SEQ ID NO: 171077 - protein, 9 aa, Homo Sapiens
TAAPSPSLL

SEQ ID NO: 171078 - protein, 9 aa, Homo Sapiens
TAAPTVCLL

SEQ ID NO: 171079 - protein, 9 aa, Homo Sapiens
TAAPVPTTL

SEQ ID NO: 171080 - protein, 9 aa, Homo Sapiens
TADAIARKL

SEQ ID NO: 171081 - protein, 9 aa, Homo Sapiens
TADGRVVKL

SEQ ID NO: 171082 - protein, 9 aa, Homo Sapiens
TAFPEASFL

SEQ ID NO: 171083 - protein, 9 aa, Homo Sapiens
TAIREISLL

SEQ ID NO: 171084 - protein, 9 aa, Homo Sapiens
TALENPVLL

SEQ ID NO: 171085 - protein, 9 aa, Homo Sapiens
TALERPSFL

SEQ ID NO: 171086 - protein, 9 aa, Homo Sapiens
TALGKLLYL

SEQ ID NO: 171087 - protein, 9 aa, Homo Sapiens
TALHIACYL

SEQ ID NO: 171088 - protein, 9 aa, Homo Sapiens
TAMEQPVFL

SEQ ID NO: 171089 - protein, 9 aa, Homo Sapiens
TAPQGNVDL

SEQ ID NO: 171090 - protein, 9 aa, Homo Sapiens
TATEQWIFL

SEQ ID NO: 171091 - protein, 9 aa, Homo Sapiens
TAVRWVVTL

SEQ ID NO: 171092 - protein, 9 aa, Homo Sapiens
TAYAYATVL

SEQ ID NO: 171093 - protein, 9 aa, Homo Sapiens
TAYRNITEL

SEQ ID NO: 171094 - protein, 9 aa, Homo Sapiens
TAYWKELSL

SEQ ID NO: 171095 - protein, 9 aa, Homo Sapiens
TITQAVIFI

SEQ ID NO: 171096 - protein, 9 aa, Homo Sapiens
TSIHHATHL

SEQ ID NO: 171097 - protein, 9 aa, Homo Sapiens
TSLSALTQL

SEQ ID NO: 171098 - protein, 9 aa, Homo Sapiens
TSYPDPILL

SEQ ID NO: 171099 - protein, 9 aa, Homo Sapiens
TTPDHPLFL

SEQ ID NO: 171100 - protein, 9 aa, Homo Sapiens
TVFERPTFL

SEQ ID NO: 171101 - protein, 9 aa, Homo Sapiens
VAAFVCTYL

SEQ ID NO: 171102 - protein, 9 aa, Homo Sapiens
VAAGVLCEL

SEQ ID NO: 171103 - protein, 9 aa, Homo Sapiens
VAANKAVHL

SEQ ID NO: 171104 - protein, 9 aa, Homo Sapiens
VAASNIVQM

SEQ ID NO: 171105 - protein, 9 aa, Homo Sapiens
VADEGICYL

SEQ ID NO: 171106 - protein, 9 aa, Homo Sapiens
VADGYPVRL

SEQ ID NO: 171107 - protein, 9 aa, Homo Sapiens
VADKKARLI

SEQ ID NO: 171108 - protein, 9 aa, Homo Sapiens
VADNLAIQL

SEQ ID NO: 171109 - protein, 9 aa, Homo Sapiens
VADPTPFHI

SEQ ID NO: 171110 - protein, 9 aa, Homo Sapiens
VADPYVVIM

SEQ ID NO: 171111 - protein, 9 aa, Homo Sapiens
VAFPLLTKL

SEQ ID NO: 171112 - protein, 9 aa, Homo Sapiens
VAFSPVTEL

SEQ ID NO: 171113 - protein, 9 aa, Homo Sapiens
VAHGGVQKL

SEQ ID NO: 171114 - protein, 9 aa, Homo Sapiens
VAHGKQLFL

SEQ ID NO: 171115 - protein, 9 aa, Homo Sapiens
VAHSPPEKL

SEQ ID NO: 171116 - protein, 9 aa, Homo Sapiens
VAHSPPSTL

SEQ ID NO: 171117 - protein, 9 aa, Homo Sapiens
VAIGFKTKL

SEQ ID NO: 171118 - protein, 9 aa, Homo Sapiens
VAIGNPVHL

SEQ ID NO: 171119 - protein, 9 aa, Homo Sapiens
VAISSLTYL

SEQ ID NO: 171120 - protein, 9 aa, Homo Sapiens
VAITRVANL

SEQ ID NO: 171121 - protein, 9 aa, Homo Sapiens
VALPASGWL

SEQ ID NO: 171122 - protein, 9 aa, Homo Sapiens
VALSQIVRL

SEQ ID NO: 171123 - protein, 9 aa, Homo Sapiens
VAPGKDLTK

SEQ ID NO: 171124 - protein, 9 aa, Homo Sapiens
VAQKKASFL

SEQ ID NO: 171125 - protein, 9 aa, Homo Sapiens
VASEYPVIL

SEQ ID NO: 171126 - protein, 9 aa, Homo Sapiens
VASVIVTKL

SEQ ID NO: 171127 - protein, 9 aa, Homo Sapiens
VATKIFQEL

SEQ ID NO: 171128 - protein, 9 aa, Homo Sapiens
VATSVLTQM

SEQ ID NO: 171129 - protein, 9 aa, Homo Sapiens
VATVVPTHL

SEQ ID NO: 171130 - protein, 9 aa, Homo Sapiens
VAVAEVIKL

SEQ ID NO: 171131 - protein, 9 aa, Homo Sapiens
VAVGHGSDL

SEQ ID NO: 171132 - protein, 9 aa, Homo Sapiens
VAVGVYARL

SEQ ID NO: 171133 - protein, 9 aa, Homo Sapiens
VAVKRAVML

SEQ ID NO: 171134 - protein, 9 aa, Homo Sapiens
VAVQHFSLL

SEQ ID NO: 171135 - protein, 9 aa, Homo Sapiens
VAYDNAVNL

SEQ ID NO: 171136 - protein, 9 aa, Homo Sapiens
VAYFGLTTL

SEQ ID NO: 171137 - protein, 9 aa, Homo Sapiens
VAYGKGTYF

SEQ ID NO: 171138 - protein, 9 aa, Homo Sapiens
VAYGLHELL

SEQ ID NO: 171139 - protein, 9 aa, Homo Sapiens
VAYKFPELL

SEQ ID NO: 171140 - protein, 9 aa, Homo Sapiens
VAYPGIPKL

SEQ ID NO: 171141 - protein, 9 aa, Homo Sapiens
VAYWRQAGL

SEQ ID NO: 171142 - protein, 9 aa, Homo Sapiens
VGAGAPVYL

SEQ ID NO: 171143 - protein, 9 aa, Homo Sapiens
VGAGAPVYM

SEQ ID NO: 171144 - protein, 9 aa, Homo Sapiens
VGVNNPVFL

SEQ ID NO: 171145 - protein, 9 aa, Homo Sapiens
VGYDGPIYM

SEQ ID NO: 171146 - protein, 9 aa, Homo Sapiens
VGYHKHITL

SEQ ID NO: 171147 - protein, 9 aa, Homo Sapiens
VIIERLLLL

SEQ ID NO: 171148 - protein, 9 aa, Homo Sapiens
VIPESVILL

SEQ ID NO: 171149 - protein, 9 aa, Homo Sapiens
VIPGHLIFL

SEQ ID NO: 171150 - protein, 9 aa, Homo Sapiens
VSIDTVTVL

SEQ ID NO: 171151 - protein, 9 aa, Homo Sapiens
VSLGHISML

SEQ ID NO: 171152 - protein, 9 aa, Homo Sapiens
VSYVRSVYL

SEQ ID NO: 171153 - protein, 9 aa, Homo Sapiens
VTIGHIALL

SEQ ID NO: 171154 - protein, 9 aa, Homo Sapiens
VTYGFPIML

SEQ ID NO: 171155 - protein, 9 aa, Homo Sapiens
VTYPGELLL

SEQ ID NO: 171156 - protein, 9 aa, Homo Sapiens
VVPDHPVLL

SEQ ID NO: 171157 - protein, 9 aa, Homo Sapiens
VVYGGISRL

SEQ ID NO: 171158 - protein, 9 aa, Homo Sapiens
WAVALPVYL

SEQ ID NO: 171159 - protein, 9 aa, Homo Sapiens
WAVPQPTRL

SEQ ID NO: 171160 - protein, 9 aa, Homo Sapiens
WAYPRQVFI

SEQ ID NO: 171161 - protein, 9 aa, Homo Sapiens
WGYPHPFLI

SEQ ID NO: 171162 - protein, 9 aa, Homo Sapiens
YAADNQIYI

SEQ ID NO: 171163 - protein, 9 aa, Homo Sapiens
YAAGVHSVL

SEQ ID NO: 171164 - protein, 9 aa, Homo Sapiens
YAAPHFFHL

SEQ ID NO: 171165 - protein, 9 aa, Homo Sapiens
YAAQAHLKL

SEQ ID NO: 171166 - protein, 9 aa, Homo Sapiens
YAASAIGYL

SEQ ID NO: 171167 - protein, 9 aa, Homo Sapiens
YACAQSSKL

SEQ ID NO: 171168 - protein, 9 aa, Homo Sapiens
YACEKEVFL

SEQ ID NO: 171169 - protein, 9 aa, Homo Sapiens
YACGFSVLL

SEQ ID NO: 171170 - protein, 9 aa, Homo Sapiens
YADPSILYI

SEQ ID NO: 171171 - protein, 9 aa, Homo Sapiens
YADSSIAEL

SEQ ID NO: 171172 - protein, 9 aa, Homo Sapiens
YAFGGGCEL

SEQ ID NO: 171173 - protein, 9 aa, Homo Sapiens
YAFPKAVSV

SEQ ID NO: 171174 - protein, 9 aa, Homo Sapiens
YAFPKSITV

SEQ ID NO: 171175 - protein, 9 aa, Homo Sapiens
YAFPLAHSL

SEQ ID NO: 171176 - protein, 9 aa, Homo Sapiens
YAFSGVEEL

SEQ ID NO: 171177 - protein, 9 aa, Homo Sapiens
YAFVRPVIL

SEQ ID NO: 171178 - protein, 9 aa, Homo Sapiens
YAIGLVMRL

SEQ ID NO: 171179 - protein, 9 aa, Homo Sapiens
YAISKPDIL

SEQ ID NO: 171180 - protein, 9 aa, Homo Sapiens
YAISKPEVL

SEQ ID NO: 171181 - protein, 9 aa, Homo Sapiens
YAITRVLRL

SEQ ID NO: 171182 - protein, 9 aa, Homo Sapiens
YALDLSTFL

SEQ ID NO: 171183 - protein, 9 aa, Homo Sapiens
YALGALNHL

SEQ ID NO: 171184 - protein, 9 aa, Homo Sapiens
YALLGRTLL

SEQ ID NO: 171185 - protein, 9 aa, Homo Sapiens
YANSKAVTL

SEQ ID NO: 171186 - protein, 9 aa, Homo Sapiens
YASPDLSKL

SEQ ID NO: 171187 - protein, 9 aa, Homo Sapiens
YATTGKCEL

SEQ ID NO: 171188 - protein, 9 aa, Homo Sapiens
YAVGGYTRL

SEQ ID NO: 171189 - protein, 9 aa, Homo Sapiens
YAYAAQNLL

SEQ ID NO: 171190 - protein, 9 aa, Homo Sapiens
YAYEAVEQL

SEQ ID NO: 171191 - protein, 9 aa, Homo Sapiens
YAYFNFPEL

SEQ ID NO: 171192 - protein, 9 aa, Homo Sapiens
YAYLKAIVL

SEQ ID NO: 171193 - protein, 9 aa, Homo Sapiens
YAYPGVLLI

SEQ ID NO: 171194 - protein, 9 aa, Homo Sapiens
YAYRDAVFL

SEQ ID NO: 171195 - protein, 9 aa, Homo Sapiens
YAYTGRLEL

SEQ ID NO: 171196 - protein, 9 aa, Homo Sapiens
YGAGIVLRL

SEQ ID NO: 171197 - protein, 9 aa, Homo Sapiens
YGAPTAVRL

SEQ ID NO: 171198 - protein, 9 aa, Homo Sapiens
YGIENEVFL

SEQ ID NO: 171199 - protein, 9 aa, Homo Sapiens
YGLPVVVKL

SEQ ID NO: 171200 - protein, 9 aa, Homo Sapiens
YGYEHILTL

SEQ ID NO: 171201 - protein, 9 aa, Homo Sapiens
YGYGHESEL

SEQ ID NO: 171202 - protein, 9 aa, Homo Sapiens
YGYGSTVRL

SEQ ID NO: 171203 - protein, 9 aa, Homo Sapiens
YGYSKLIEL

SEQ ID NO: 171204 - protein, 9 aa, Homo Sapiens
YIFSHILRL

SEQ ID NO: 171205 - protein, 9 aa, Homo Sapiens
YIIPVVLFL

SEQ ID NO: 171206 - protein, 9 aa, Homo Sapiens
YIPDFLTLL

SEQ ID NO: 171207 - protein, 9 aa, Homo Sapiens
YIPNKVLIL

SEQ ID NO: 171208 - protein, 9 aa, Homo Sapiens
YIVDLLTHL

SEQ ID NO: 171209 - protein, 9 aa, Homo Sapiens
YIYHGTVKL

SEQ ID NO: 171210 - protein, 9 aa, Homo Sapiens
YLADIFTKL

SEQ ID NO: 171211 - protein, 9 aa, Homo Sapiens
YLIARVMLL

SEQ ID NO: 171212 - protein, 9 aa, Homo Sapiens
YLLDLHSYL

SEQ ID NO: 171213 - protein, 9 aa, Homo Sapiens
YLPSFFTKL

SEQ ID NO: 171214 - protein, 9 aa, Homo Sapiens
YLVPRAVLL

SEQ ID NO: 171215 - protein, 9 aa, Homo Sapiens
YLYFSSTKL

SEQ ID NO: 171216 - protein, 9 aa, Homo Sapiens
YLYPDITRL

SEQ ID NO: 171217 - protein, 9 aa, Homo Sapiens
YMIAHITGL

SEQ ID NO: 171218 - protein, 9 aa, Homo Sapiens
YMIDNVILL

SEQ ID NO: 171219 - protein, 9 aa, Homo Sapiens
YQIDTVINL

SEQ ID NO: 171220 - protein, 9 aa, Homo Sapiens
YQILVVTRL

SEQ ID NO: 171221 - protein, 9 aa, Homo Sapiens
YQVDSRTYL

SEQ ID NO: 171222 - protein, 9 aa, Homo Sapiens
YQYGAVVTL

SEQ ID NO: 171223 - protein, 9 aa, Homo Sapiens
YQYLLVTAL

SEQ ID NO: 171224 - protein, 9 aa, Homo Sapiens
YQYPRPLLI

SEQ ID NO: 171225 - protein, 9 aa, Homo Sapiens
YQYPVIIHL

SEQ ID NO: 171226 - protein, 9 aa, Homo Sapiens
YSAPVIHVL

SEQ ID NO: 171227 - protein, 9 aa, Homo Sapiens
YSDPRFLNL

SEQ ID NO: 171228 - protein, 9 aa, Homo Sapiens
YSHPGVVFL

SEQ ID NO: 171229 - protein, 9 aa, Homo Sapiens
YSLDHISSL

SEQ ID NO: 171230 - protein, 9 aa, Homo Sapiens
YSLPNAPTL

SEQ ID NO: 171231 - protein, 9 aa, Homo Sapiens
YSSDTTPLL

SEQ ID NO: 171232 - protein, 9 aa, Homo Sapiens
YSVETVTLL

SEQ ID NO: 171233 - protein, 9 aa, Homo Sapiens
YSYSKGTYL

SEQ ID NO: 171234 - protein, 9 aa, Homo Sapiens
YSYYGPLNL

SEQ ID NO: 171235 - protein, 9 aa, Homo Sapiens
YTAPTAIRL

SEQ ID NO: 171236 - protein, 9 aa, Homo Sapiens
YTCPVITNL

SEQ ID NO: 171237 - protein, 9 aa, Homo Sapiens
YTIPLAIKL

SEQ ID NO: 171238 - protein, 9 aa, Homo Sapiens
YTSRIVVRL

SEQ ID NO: 171239 - protein, 9 aa, Homo Sapiens
YVAPKAVWL

SEQ ID NO: 171240 - protein, 9 aa, Homo Sapiens
YVAPRRILL

SEQ ID NO: 171241 - protein, 9 aa, Homo Sapiens
YVFPGVTRL

SEQ ID NO: 171242 - protein, 9 aa, Homo Sapiens
YVGSRPIKL

SEQ ID NO: 171243 - protein, 9 aa, Homo Sapiens
YVINVTTHL

SEQ ID NO: 171244 - protein, 9 aa, Homo Sapiens
YVVPYMIHL

SEQ ID NO: 171245 - protein, 9 aa, Homo Sapiens
YVVPYTIHL

SEQ ID NO: 171246 - protein, 9 aa, Homo Sapiens
YVYKNVSQL

SEQ ID NO: 171247 - protein, 10 aa, Homo Sapiens
AAAPVPTTTL

SEQ ID NO: 171248 - protein, 10 aa, Homo Sapiens
AAFPGASLYL

SEQ ID NO: 171249 - protein, 10 aa, Homo Sapiens
AAINPELLQL

SEQ ID NO: 171250 - protein, 10 aa, Homo Sapiens
DSYQKFIPFI

SEQ ID NO: 171251 - protein, 10 aa, Homo Sapiens
FAAPSPFAEL

SEQ ID NO: 171252 - protein, 10 aa, Homo Sapiens
FAAPTTGNQI

SEQ ID NO: 171253 - protein, 10 aa, Homo Sapiens
FADGHVLELL

SEQ ID NO: 171254 - protein, 10 aa, Homo Sapiens
FAFESDLHSL

SEQ ID NO: 171255 - protein, 10 aa, Homo Sapiens
FAIDSSHPWL

SEQ ID NO: 171256 - protein, 10 aa, Homo Sapiens
FAIVASDTRL

SEQ ID NO: 171257 - protein, 10 aa, Homo Sapiens
FASPTSPPVL

SEQ ID NO: 171258 - protein, 10 aa, Homo Sapiens
GALGGRALLL

SEQ ID NO: 171259 - protein, 10 aa, Homo Sapiens
GAYDHSYVEL

SEQ ID NO: 171260 - protein, 10 aa, Homo Sapiens
GPVYPHPVLL

SEQ ID NO: 171261 - protein, 10 aa, Homo Sapiens
KITPLEIEVL

SEQ ID NO: 171262 - protein, 10 aa, Homo Sapiens
SITDVYLLNL

SEQ ID NO: 171263 - protein, 10 aa, Homo Sapiens
SLYQSKYEEL

SEQ ID NO: 171264 - protein, 10 aa, Homo Sapiens
VAYHGSYLWL

SEQ ID NO: 171265 - protein, 10 aa, Homo Sapiens
VSAAGLVQGL

SEQ ID NO: 171266 - protein, 10 aa, Homo Sapiens
YAFGRVFSGL

SEQ ID NO: 171267 - protein, 10 aa, Homo Sapiens
YAIPTVCVGL

SEQ ID NO: 171268 - protein, 10 aa, Homo Sapiens
YALCGFGGVL

SEQ ID NO: 171269 - protein, 10 aa, Homo Sapiens
YAVDRAITHL

SEQ ID NO: 171270 - protein, 10 aa, Homo Sapiens
YAVPSAGLRL

SEQ ID NO: 171271 - protein, 10 aa, Homo Sapiens
YIADPNIAKL

SEQ ID NO: 171272 - protein, 10 aa, Homo Sapiens
YLYGQTTTYL

SEQ ID NO: 171273 - protein, 11 aa, Homo Sapiens
AAFTADPLSLL

SEQ ID NO: 171274 - protein, 11 aa, Homo Sapiens
AALAANSNGIA

SEQ ID NO: 171275 - protein, 11 aa, Homo Sapiens
AEQRGELAIKD

SEQ ID NO: 171276 - protein, 11 aa, Homo Sapiens
FAFEGIGDEDL

SEQ ID NO: 171277 - protein, 11 aa, Homo Sapiens
FAFESDLHSLL

SEQ ID NO: 171278 - protein, 11 aa, Homo Sapiens
FAYDGKDYIAL

SEQ ID NO: 171279 - protein, 11 aa, Homo Sapiens
FAYDGKDYLTL

SEQ ID NO: 171280 - protein, 11 aa, Homo Sapiens
FAYDPSNYEYL

SEQ ID NO: 171281 - protein, 11 aa, Homo Sapiens
YAYETKDALCL

SEQ ID NO: 171282 - protein, 8 aa, Homo Sapiens
AIASGIYL

SEQ ID NO: 171283 - protein, 8 aa, Homo Sapiens
AIIGPILL

SEQ ID NO: 171284 - protein, 8 aa, Homo Sapiens
ASPPPLLL

SEQ ID NO: 171285 - protein, 8 aa, Homo Sapiens
EEQLQQIR

SEQ ID NO: 171286 - protein, 8 aa, Homo Sapiens
EIADPIVL

SEQ ID NO: 171287 - protein, 8 aa, Homo Sapiens
HRPPPIKL

SEQ ID NO: 171288 - protein, 8 aa, Homo Sapiens
IIAKKIVL

SEQ ID NO: 171289 - protein, 8 aa, Homo Sapiens
IMPKDIQL

SEQ ID NO: 171290 - protein, 8 aa, Homo Sapiens
IQEAIALI

SEQ ID NO: 171291 - protein, 8 aa, Homo Sapiens
ITKTGAKL

SEQ ID NO: 171292 - protein, 8 aa, Homo Sapiens
KFIEGVVL

SEQ ID NO: 171293 - protein, 8 aa, Homo Sapiens
KIADPFVL

SEQ ID NO: 171294 - protein, 8 aa, Homo Sapiens
KIAEANKL

SEQ ID NO: 171295 - protein, 8 aa, Homo Sapiens
KIHEPIML

SEQ ID NO: 171296 - protein, 8 aa, Homo Sapiens
KIPSPVKL

SEQ ID NO: 171297 - protein, 8 aa, Homo Sapiens
KKPDSVSL

SEQ ID NO: 171298 - protein, 8 aa, Homo Sapiens
KKPTPIQL

SEQ ID NO: 171299 - protein, 8 aa, Homo Sapiens
KMPLPLKL

SEQ ID NO: 171300 - protein, 8 aa, Homo Sapiens
KQPTPVQL

SEQ ID NO: 171301 - protein, 8 aa, Homo Sapiens
KSPPPMNL

SEQ ID NO: 171302 - protein, 8 aa, Homo Sapiens
KTPSGIKL

SEQ ID NO: 171303 - protein, 8 aa, Homo Sapiens
KVPFPLTL

SEQ ID NO: 171304 - protein, 8 aa, Homo Sapiens
LKPPPIKL

SEQ ID NO: 171305 - protein, 8 aa, Homo Sapiens
LPKLYVKL

SEQ ID NO: 171306 - protein, 8 aa, Homo Sapiens
PLPPAVFL

SEQ ID NO: 171307 - protein, 8 aa, Homo Sapiens
QIAEAVRL

SEQ ID NO: 171308 - protein, 8 aa, Homo Sapiens
QIPAAVKL

SEQ ID NO: 171309 - protein, 8 aa, Homo Sapiens
RFPEALRL

SEQ ID NO: 171310 - protein, 8 aa, Homo Sapiens
RIIIPVLL

SEQ ID NO: 171311 - protein, 8 aa, Homo Sapiens
RIPEPVHL

SEQ ID NO: 171312 - protein, 8 aa, Homo Sapiens
RMPPPANL

SEQ ID NO: 171313 - protein, 8 aa, Homo Sapiens
SIAGPVLL

SEQ ID NO: 171314 - protein, 8 aa, Homo Sapiens
SIAVPIVL

SEQ ID NO: 171315 - protein, 8 aa, Homo Sapiens
SIPVGISL

SEQ ID NO: 171316 - protein, 8 aa, Homo Sapiens
TGPPPLLL

SEQ ID NO: 171317 - protein, 8 aa, Homo Sapiens
TIAEGLTL

SEQ ID NO: 171318 - protein, 8 aa, Homo Sapiens
TIPIAVAL

SEQ ID NO: 171319 - protein, 8 aa, Homo Sapiens
TIPLAVVL

SEQ ID NO: 171320 - protein, 8 aa, Homo Sapiens
TLIPAVVI

SEQ ID NO: 171321 - protein, 8 aa, Homo Sapiens
TLPTPMVL

SEQ ID NO: 171322 - protein, 8 aa, Homo Sapiens
VIGPPVVL

SEQ ID NO: 171323 - protein, 8 aa, Homo Sapiens
VRPKLPLL

SEQ ID NO: 171324 - protein, 9 aa, Homo Sapiens
AFPGASLYL

SEQ ID NO: 171325 - protein, 9 aa, Homo Sapiens
AFPKGSWTL

SEQ ID NO: 171326 - protein, 9 aa, Homo Sapiens
AGPDRFVVL

SEQ ID NO: 171327 - protein, 9 aa, Homo Sapiens
AGPPDTISL

SEQ ID NO: 171328 - protein, 9 aa, Homo Sapiens
AHPKAKLVL

SEQ ID NO: 171329 - protein, 9 aa, Homo Sapiens
AHPLETLIL

SEQ ID NO: 171330 - protein, 9 aa, Homo Sapiens
AIIKEPIDI

SEQ ID NO: 171331 - protein, 9 aa, Homo Sapiens
AIIRDRAAL

SEQ ID NO: 171332 - protein, 9 aa, Homo Sapiens
AIISQKPQL

SEQ ID NO: 171333 - protein, 9 aa, Homo Sapiens
AIPKKKMNL

SEQ ID NO: 171334 - protein, 9 aa, Homo Sapiens
AIPNARIEL

SEQ ID NO: 171335 - protein, 9 aa, Homo Sapiens
AITPAGINL

SEQ ID NO: 171336 - protein, 9 aa, Homo Sapiens
AIVAKQVLL

SEQ ID NO: 171337 - protein, 9 aa, Homo Sapiens
AIVGNKVDL

SEQ ID NO: 171338 - protein, 9 aa, Homo Sapiens
AIVNSALKL

SEQ ID NO: 171339 - protein, 9 aa, Homo Sapiens
ALIKDKILF

SEQ ID NO: 171340 - protein, 9 aa, Homo Sapiens
ALPKLPISL

SEQ ID NO: 171341 - protein, 9 aa, Homo Sapiens
ALVKEKLRL

SEQ ID NO: 171342 - protein, 9 aa, Homo Sapiens
ALVKHSVLL

SEQ ID NO: 171343 - protein, 9 aa, Homo Sapiens
ALVSGKLAL

SEQ ID NO: 171344 - protein, 9 aa, Homo Sapiens
AMILGKMVL

SEQ ID NO: 171345 - protein, 9 aa, Homo Sapiens
APLPPAVFL

SEQ ID NO: 171346 - protein, 9 aa, Homo Sapiens
AQPDGKIRL

SEQ ID NO: 171347 - protein, 9 aa, Homo Sapiens
AQPETPVTL

SEQ ID NO: 171348 - protein, 9 aa, Homo Sapiens
AQPVTAVAL

SEQ ID NO: 171349 - protein, 9 aa, Homo Sapiens
ARIAKGLRL

SEQ ID NO: 171350 - protein, 9 aa, Homo Sapiens
ARPMRAIFL

SEQ ID NO: 171351 - protein, 9 aa, Homo Sapiens
ASPTQPIQL

SEQ ID NO: 171352 - protein, 9 aa, Homo Sapiens
ATPKAKIYL

SEQ ID NO: 171353 - protein, 9 aa, Homo Sapiens
ATPLKKVIL

SEQ ID NO: 171354 - protein, 9 aa, Homo Sapiens
AVPTIYTKL

SEQ ID NO: 171355 - protein, 9 aa, Homo Sapiens
AVVHGKVAL

SEQ ID NO: 171356 - protein, 9 aa, Homo Sapiens
EIIDNHITL

SEQ ID NO: 171357 - protein, 9 aa, Homo Sapiens
EIIKQKLTL

SEQ ID NO: 171358 - protein, 9 aa, Homo Sapiens
EIISKGIKL

SEQ ID NO: 171359 - protein, 9 aa, Homo Sapiens
EIVPNGITL

SEQ ID NO: 171360 - protein, 9 aa, Homo Sapiens
GFPEGSVEL

SEQ ID NO: 171361 - protein, 9 aa, Homo Sapiens
GIPSNRIIL

SEQ ID NO: 171362 - protein, 9 aa, Homo Sapiens
GIVVSKPNL

SEQ ID NO: 171363 - protein, 9 aa, Homo Sapiens
GKLPKGILL

SEQ ID NO: 171364 - protein, 9 aa, Homo Sapiens
GQPRDGLKL

SEQ ID NO: 171365 - protein, 9 aa, Homo Sapiens
GVPKTHLEL

SEQ ID NO: 171366 - protein, 9 aa, Homo Sapiens
HAPRIPVTL

SEQ ID NO: 171367 - protein, 9 aa, Homo Sapiens
HFPGYVQDL

SEQ ID NO: 171368 - protein, 9 aa, Homo Sapiens
HFPHKPIIL

SEQ ID NO: 171369 - protein, 9 aa, Homo Sapiens
HGIQGKFSL

SEQ ID NO: 171370 - protein, 9 aa, Homo Sapiens
HGPAAKPTL

SEQ ID NO: 171371 - protein, 9 aa, Homo Sapiens
HGPNHPLVL

SEQ ID NO: 171372 - protein, 9 aa, Homo Sapiens
HGVKDKPVL

SEQ ID NO: 171373 - protein, 9 aa, Homo Sapiens
HHPDYNNEL

SEQ ID NO: 171374 - protein, 9 aa, Homo Sapiens
HIEPLKIQL

SEQ ID NO: 171375 - protein, 9 aa, Homo Sapiens
HINIGALEL

SEQ ID NO: 171376 - protein, 9 aa, Homo Sapiens
HITPDNFEL

SEQ ID NO: 171377 - protein, 9 aa, Homo Sapiens
HIVVNKAEL

SEQ ID NO: 171378 - protein, 9 aa, Homo Sapiens
HLIEESVKL

SEQ ID NO: 171379 - protein, 9 aa, Homo Sapiens
HLPDVCVNL

SEQ ID NO: 171380 - protein, 9 aa, Homo Sapiens
HLPNTYVDL

SEQ ID NO: 171381 - protein, 9 aa, Homo Sapiens
HLPPAKVLL

SEQ ID NO: 171382 - protein, 9 aa, Homo Sapiens
HQIDNHIHL

SEQ ID NO: 171383 - protein, 9 aa, Homo Sapiens
HQPTTWVSF

SEQ ID NO: 171384 - protein, 9 aa, Homo Sapiens
HSPGDYILL

SEQ ID NO: 171385 - protein, 9 aa, Homo Sapiens
HSPPNKPKL

SEQ ID NO: 171386 - protein, 9 aa, Homo Sapiens
HTPHQFLLL

SEQ ID NO: 171387 - protein, 9 aa, Homo Sapiens
HVPAVKLLL

SEQ ID NO: 171388 - protein, 9 aa, Homo Sapiens
HVPEHAVVL

SEQ ID NO: 171389 - protein, 9 aa, Homo Sapiens
HVPQQHFEL

SEQ ID NO: 171390 - protein, 9 aa, Homo Sapiens
HYPDFHQEL

SEQ ID NO: 171391 - protein, 9 aa, Homo Sapiens
IHPADSVYL

SEQ ID NO: 171392 - protein, 9 aa, Homo Sapiens
IIAENKIRL

SEQ ID NO: 171393 - protein, 9 aa, Homo Sapiens
ISPKEFVHL

SEQ ID NO: 171394 - protein, 9 aa, Homo Sapiens
ISPKHFVHL

SEQ ID NO: 171395 - protein, 9 aa, Homo Sapiens
ISPKVKMAL

SEQ ID NO: 171396 - protein, 9 aa, Homo Sapiens
ITPPEKFFL

SEQ ID NO: 171397 - protein, 9 aa, Homo Sapiens
IVPDGTLQL

SEQ ID NO: 171398 - protein, 9 aa, Homo Sapiens
IYPSIFHVL

SEQ ID NO: 171399 - protein, 9 aa, Homo Sapiens
KAPEMTNEL

SEQ ID NO: 171400 - protein, 9 aa, Homo Sapiens
KAPGFAQML

SEQ ID NO: 171401 - protein, 9 aa, Homo Sapiens
KAPGSTSNL

SEQ ID NO: 171402 - protein, 9 aa, Homo Sapiens
KAPLSKVRL

SEQ ID NO: 171403 - protein, 9 aa, Homo Sapiens
KAPPDGWEL

SEQ ID NO: 171404 - protein, 9 aa, Homo Sapiens
KAPPIPLKL

SEQ ID NO: 171405 - protein, 9 aa, Homo Sapiens
KAPVNTAEL

SEQ ID NO: 171406 - protein, 9 aa, Homo Sapiens
KAVGDGIVL

SEQ ID NO: 171407 - protein, 9 aa, Homo Sapiens
KEIEEKLRL

SEQ ID NO: 171408 - protein, 9 aa, Homo Sapiens
KEVQDGIEL

SEQ ID NO: 171409 - protein, 9 aa, Homo Sapiens
KFIDKQLEL

SEQ ID NO: 171410 - protein, 9 aa, Homo Sapiens
KFIPGKPVL

SEQ ID NO: 171411 - protein, 9 aa, Homo Sapiens
KFPAYERVL

SEQ ID NO: 171412 - protein, 9 aa, Homo Sapiens
KFPDSQNQL

SEQ ID NO: 171413 - protein, 9 aa, Homo Sapiens
KFPGIRPYL

SEQ ID NO: 171414 - protein, 9 aa, Homo Sapiens
KFPHESARL

SEQ ID NO: 171415 - protein, 9 aa, Homo Sapiens
KFPIVNAEL

SEQ ID NO: 171416 - protein, 9 aa, Homo Sapiens
KFPLMTLQL

SEQ ID NO: 171417 - protein, 9 aa, Homo Sapiens
KFPLTRPSL

SEQ ID NO: 171418 - protein, 9 aa, Homo Sapiens
KFPPKFVQL

SEQ ID NO: 171419 - protein, 9 aa, Homo Sapiens
KFPVKPADL

SEQ ID NO: 171420 - protein, 9 aa, Homo Sapiens
KFVNKSYLL

SEQ ID NO: 171421 - protein, 9 aa, Homo Sapiens
KFVVKKPEL

SEQ ID NO: 171422 - protein, 9 aa, Homo Sapiens
KGIGEFFRL

SEQ ID NO: 171423 - protein, 9 aa, Homo Sapiens
KGPAVGIDL

SEQ ID NO: 171424 - protein, 9 aa, Homo Sapiens
KGPDAASKL

SEQ ID NO: 171425 - protein, 9 aa, Homo Sapiens
KGPEDTAQL

SEQ ID NO: 171426 - protein, 9 aa, Homo Sapiens
KGPPAALTL

SEQ ID NO: 171427 - protein, 9 aa, Homo Sapiens
KGPYEYLTL

SEQ ID NO: 171428 - protein, 9 aa, Homo Sapiens
KGVAEKTVL

SEQ ID NO: 171429 - protein, 9 aa, Homo Sapiens
KGVIQRLTL

SEQ ID NO: 171430 - protein, 9 aa, Homo Sapiens
KHIRHKFFL

SEQ ID NO: 171431 - protein, 9 aa, Homo Sapiens
KHPATRTVL

SEQ ID NO: 171432 - protein, 9 aa, Homo Sapiens
KHPDASVNF

SEQ ID NO: 171433 - protein, 9 aa, Homo Sapiens
KHPDSSVNF

SEQ ID NO: 171434 - protein, 9 aa, Homo Sapiens
KHPKYCIEL

SEQ ID NO: 171435 - protein, 9 aa, Homo Sapiens
KHPVEVVYL

SEQ ID NO: 171436 - protein, 9 aa, Homo Sapiens
KIAGYVTHL

SEQ ID NO: 171437 - protein, 9 aa, Homo Sapiens
KIAIQKITL

SEQ ID NO: 171438 - protein, 9 aa, Homo Sapiens
KIAKESQFL

SEQ ID NO: 171439 - protein, 9 aa, Homo Sapiens
KIAKLGLKL

SEQ ID NO: 171440 - protein, 9 aa, Homo Sapiens
KIAKPLSSL

SEQ ID NO: 171441 - protein, 9 aa, Homo Sapiens
KIALEHPML

SEQ ID NO: 171442 - protein, 9 aa, Homo Sapiens
KIAPNTPQL

SEQ ID NO: 171443 - protein, 9 aa, Homo Sapiens
KIAPYSVEI

SEQ ID NO: 171444 - protein, 9 aa, Homo Sapiens
KIAQQAAKL

SEQ ID NO: 171445 - protein, 9 aa, Homo Sapiens
KIDDKPVKI

SEQ ID NO: 171446 - protein, 9 aa, Homo Sapiens
KIFQVAQEL

SEQ ID NO: 171447 - protein, 9 aa, Homo Sapiens
KIGNIKKTL

SEQ ID NO: 171448 - protein, 9 aa, Homo Sapiens
KIHAHKVVL

SEQ ID NO: 171449 - protein, 9 aa, Homo Sapiens
KIHPMAYQL

SEQ ID NO: 171450 - protein, 9 aa, Homo Sapiens
KIIASSPEM

SEQ ID NO: 171451 - protein, 9 aa, Homo Sapiens
KIIDGLLVM

SEQ ID NO: 171452 - protein, 9 aa, Homo Sapiens
KIIDSGPQL

SEQ ID NO: 171453 - protein, 9 aa, Homo Sapiens
KIIEARLKM

SEQ ID NO: 171454 - protein, 9 aa, Homo Sapiens
KIIEMMPEF

SEQ ID NO: 171455 - protein, 9 aa, Homo Sapiens
KIIHTRVNF

SEQ ID NO: 171456 - protein, 9 aa, Homo Sapiens
KIIKEKQAF

SEQ ID NO: 171457 - protein, 9 aa, Homo Sapiens
KIIKKPMDL

SEQ ID NO: 171458 - protein, 9 aa, Homo Sapiens
KIINGYIFL

SEQ ID NO: 171459 - protein, 9 aa, Homo Sapiens
KIIPTKIVY

SEQ ID NO: 171460 - protein, 9 aa, Homo Sapiens
KIISESAQM

SEQ ID NO: 171461 - protein, 9 aa, Homo Sapiens
KIITEGTKL

SEQ ID NO: 171462 - protein, 9 aa, Homo Sapiens
KIIYKLIRL

SEQ ID NO: 171463 - protein, 9 aa, Homo Sapiens
KILAEAAKL

SEQ ID NO: 171464 - protein, 9 aa, Homo Sapiens
KINEEKCNL

SEQ ID NO: 171465 - protein, 9 aa, Homo Sapiens
KINKKRIAL

SEQ ID NO: 171466 - protein, 9 aa, Homo Sapiens
KINSSAIKL

SEQ ID NO: 171467 - protein, 9 aa, Homo Sapiens
KIPAGAVSV

SEQ ID NO: 171468 - protein, 9 aa, Homo Sapiens
KIPAHRVVL

SEQ ID NO: 171469 - protein, 9 aa, Homo Sapiens
KIPALAVEM

SEQ ID NO: 171470 - protein, 9 aa, Homo Sapiens
KIPASAVEM

SEQ ID NO: 171471 - protein, 9 aa, Homo Sapiens
KIPDMSVQL

SEQ ID NO: 171472 - protein, 9 aa, Homo Sapiens
KIPEDILQL

SEQ ID NO: 171473 - protein, 9 aa, Homo Sapiens
KIPEYQQLL

SEQ ID NO: 171474 - protein, 9 aa, Homo Sapiens
KIPILGVHL

SEQ ID NO: 171475 - protein, 9 aa, Homo Sapiens
KIPKATPEL

SEQ ID NO: 171476 - protein, 9 aa, Homo Sapiens
KIPKAYIRF

SEQ ID NO: 171477 - protein, 9 aa, Homo Sapiens
KIPLVKVDM

SEQ ID NO: 171478 - protein, 9 aa, Homo Sapiens
KIPNFCVLL

SEQ ID NO: 171479 - protein, 9 aa, Homo Sapiens
KIPQVLVKL

SEQ ID NO: 171480 - protein, 9 aa, Homo Sapiens
KIPSENNKL

SEQ ID NO: 171481 - protein, 9 aa, Homo Sapiens
KIPTAKPEL

SEQ ID NO: 171482 - protein, 9 aa, Homo Sapiens
KIPTCKITL

SEQ ID NO: 171483 - protein, 9 aa, Homo Sapiens
KISKEKSFL

SEQ ID NO: 171484 - protein, 9 aa, Homo Sapiens
KISKSVTTL

SEQ ID NO: 171485 - protein, 9 aa, Homo Sapiens
KISSEKASL

SEQ ID NO: 171486 - protein, 9 aa, Homo Sapiens
KIVGNKWEA

SEQ ID NO: 171487 - protein, 9 aa, Homo Sapiens
KIVINKKQL

SEQ ID NO: 171488 - protein, 9 aa, Homo Sapiens
KIVKPGMKL

SEQ ID NO: 171489 - protein, 9 aa, Homo Sapiens
KIVPKSLLL

SEQ ID NO: 171490 - protein, 9 aa, Homo Sapiens
KIVQFIVTL

SEQ ID NO: 171491 - protein, 9 aa, Homo Sapiens
KIVSGKVRF

SEQ ID NO: 171492 - protein, 9 aa, Homo Sapiens
KKIPSPVKL

SEQ ID NO: 171493 - protein, 9 aa, Homo Sapiens
KKNPDSLEL

SEQ ID NO: 171494 - protein, 9 aa, Homo Sapiens
KKPEKPLIL

SEQ ID NO: 171495 - protein, 9 aa, Homo Sapiens
KKPPPVPAL

SEQ ID NO: 171496 - protein, 9 aa, Homo Sapiens
KKVKFQAKL

SEQ ID NO: 171497 - protein, 9 aa, Homo Sapiens
KKVSKAAIL

SEQ ID NO: 171498 - protein, 9 aa, Homo Sapiens
KLAPPLVTL

SEQ ID NO: 171499 - protein, 9 aa, Homo Sapiens
KLGISPLML

SEQ ID NO: 171500 - protein, 9 aa, Homo Sapiens
KLIAQNLEL

SEQ ID NO: 171501 - protein, 9 aa, Homo Sapiens
KLIEKNYFL

SEQ ID NO: 171502 - protein, 9 aa, Homo Sapiens
KLIHEKHLL

SEQ ID NO: 171503 - protein, 9 aa, Homo Sapiens
KLIKDGLII

SEQ ID NO: 171504 - protein, 9 aa, Homo Sapiens
KLILKGVIL

SEQ ID NO: 171505 - protein, 9 aa, Homo Sapiens
KLIPNAIQI

SEQ ID NO: 171506 - protein, 9 aa, Homo Sapiens
KLLKDKVKL

SEQ ID NO: 171507 - protein, 9 aa, Homo Sapiens
KLNATNIEL

SEQ ID NO: 171508 - protein, 9 aa, Homo Sapiens
KLNIPKVLL

SEQ ID NO: 171509 - protein, 9 aa, Homo Sapiens
KLPAFSPLM

SEQ ID NO: 171510 - protein, 9 aa, Homo Sapiens
KLPAGKNVL

SEQ ID NO: 171511 - protein, 9 aa, Homo Sapiens
KLPANHPLL

SEQ ID NO: 171512 - protein, 9 aa, Homo Sapiens
KLPDGTWNL

SEQ ID NO: 171513 - protein, 9 aa, Homo Sapiens
KLPDKTVEF

SEQ ID NO: 171514 - protein, 9 aa, Homo Sapiens
KLPEDIMKL

SEQ ID NO: 171515 - protein, 9 aa, Homo Sapiens
KLPKEREEL

SEQ ID NO: 171516 - protein, 9 aa, Homo Sapiens
KLPKGTVSF

SEQ ID NO: 171517 - protein, 9 aa, Homo Sapiens
KLPKKHMQL

SEQ ID NO: 171518 - protein, 9 aa, Homo Sapiens
KLPKQPVIV

SEQ ID NO: 171519 - protein, 9 aa, Homo Sapiens
KLPLMKINF

SEQ ID NO: 171520 - protein, 9 aa, Homo Sapiens
KLPPKRPEL

SEQ ID NO: 171521 - protein, 9 aa, Homo Sapiens
KLPPLPLTL

SEQ ID NO: 171522 - protein, 9 aa, Homo Sapiens
KLPQFCAHL

SEQ ID NO: 171523 - protein, 9 aa, Homo Sapiens
KLPQQREKL

SEQ ID NO: 171524 - protein, 9 aa, Homo Sapiens
KLPQRTAKL

SEQ ID NO: 171525 - protein, 9 aa, Homo Sapiens
KLPSGKLQV

SEQ ID NO: 171526 - protein, 9 aa, Homo Sapiens
KLPSPAHHL

SEQ ID NO: 171527 - protein, 9 aa, Homo Sapiens
KLPSVPTKL

SEQ ID NO: 171528 - protein, 9 aa, Homo Sapiens
KLPTEWNVL

SEQ ID NO: 171529 - protein, 9 aa, Homo Sapiens
KLPVESIQI

SEQ ID NO: 171530 - protein, 9 aa, Homo Sapiens
KLSVTKPVL

SEQ ID NO: 171531 - protein, 9 aa, Homo Sapiens
KLTELKAVL

SEQ ID NO: 171532 - protein, 9 aa, Homo Sapiens
KLVPRKDLL

SEQ ID NO: 171533 - protein, 9 aa, Homo Sapiens
KLVRDAFAL

SEQ ID NO: 171534 - protein, 9 aa, Homo Sapiens
KMAEIKVKL

SEQ ID NO: 171535 - protein, 9 aa, Homo Sapiens
KMASSRVTL

SEQ ID NO: 171536 - protein, 9 aa, Homo Sapiens
KMIGLKAKL

SEQ ID NO: 171537 - protein, 9 aa, Homo Sapiens
KMPACNIML

SEQ ID NO: 171538 - protein, 9 aa, Homo Sapiens
KMPDGSVAL

SEQ ID NO: 171539 - protein, 9 aa, Homo Sapiens
KMPDMHVNM

SEQ ID NO: 171540 - protein, 9 aa, Homo Sapiens
KMPFDANKL

SEQ ID NO: 171541 - protein, 9 aa, Homo Sapiens
KMPPLPVTL

SEQ ID NO: 171542 - protein, 9 aa, Homo Sapiens
KMPQYQKEL

SEQ ID NO: 171543 - protein, 9 aa, Homo Sapiens
KMSHKRIML

SEQ ID NO: 171544 - protein, 9 aa, Homo Sapiens
KMVRQILEL

SEQ ID NO: 171545 - protein, 9 aa, Homo Sapiens
KMVVDAVMM

SEQ ID NO: 171546 - protein, 9 aa, Homo Sapiens
KNIGNKVTL

SEQ ID NO: 171547 - protein, 9 aa, Homo Sapiens
KNIPMTLEL

SEQ ID NO: 171548 - protein, 9 aa, Homo Sapiens
KNPAFKPVL

SEQ ID NO: 171549 - protein, 9 aa, Homo Sapiens
KNPQKFTIL

SEQ ID NO: 171550 - protein, 9 aa, Homo Sapiens
KNTLNKVVL

SEQ ID NO: 171551 - protein, 9 aa, Homo Sapiens
KNVAKTIQL

SEQ ID NO: 171552 - protein, 9 aa, Homo Sapiens
KNVEKRALL

SEQ ID NO: 171553 - protein, 9 aa, Homo Sapiens
KNVTEHLKL

SEQ ID NO: 171554 - protein, 9 aa, Homo Sapiens
KQAAPPIEL

SEQ ID NO: 171555 - protein, 9 aa, Homo Sapiens
KQALDKLKL

SEQ ID NO: 171556 - protein, 9 aa, Homo Sapiens
KQAQEKFEL

SEQ ID NO: 171557 - protein, 9 aa, Homo Sapiens
KQIAEAVRL

SEQ ID NO: 171558 - protein, 9 aa, Homo Sapiens
KQMSEKIRL

SEQ ID NO: 171559 - protein, 9 aa, Homo Sapiens
KQPAEHLQL

SEQ ID NO: 171560 - protein, 9 aa, Homo Sapiens
KQPEDYFYL

SEQ ID NO: 171561 - protein, 9 aa, Homo Sapiens
KQPEEGLRL

SEQ ID NO: 171562 - protein, 9 aa, Homo Sapiens
KQPEEYHYL

SEQ ID NO: 171563 - protein, 9 aa, Homo Sapiens
KQPPPSIRL

SEQ ID NO: 171564 - protein, 9 aa, Homo Sapiens
KRPALPVQL

SEQ ID NO: 171565 - protein, 9 aa, Homo Sapiens
KRPDTTESL

SEQ ID NO: 171566 - protein, 9 aa, Homo Sapiens
KRPELGVTL

SEQ ID NO: 171567 - protein, 9 aa, Homo Sapiens
KRPFGVSLL

SEQ ID NO: 171568 - protein, 9 aa, Homo Sapiens
KRPGESLRI

SEQ ID NO: 171569 - protein, 9 aa, Homo Sapiens
KRPNAILKL

SEQ ID NO: 171570 - protein, 9 aa, Homo Sapiens
KRPVGGFLL

SEQ ID NO: 171571 - protein, 9 aa, Homo Sapiens
KSPAIFGVL

SEQ ID NO: 171572 - protein, 9 aa, Homo Sapiens
KSPAITATL

SEQ ID NO: 171573 - protein, 9 aa, Homo Sapiens
KSPATSCEL

SEQ ID NO: 171574 - protein, 9 aa, Homo Sapiens
KSPGFGLSL

SEQ ID NO: 171575 - protein, 9 aa, Homo Sapiens
KSPGHMVIL

SEQ ID NO: 171576 - protein, 9 aa, Homo Sapiens
KSPGTANVL

SEQ ID NO: 171577 - protein, 9 aa, Homo Sapiens
KSPKSYLEI

SEQ ID NO: 171578 - protein, 9 aa, Homo Sapiens
KSPNQSLRL

SEQ ID NO: 171579 - protein, 9 aa, Homo Sapiens
KSPQKSTVL

SEQ ID NO: 171580 - protein, 9 aa, Homo Sapiens
KSPSSKPSL

SEQ ID NO: 171581 - protein, 9 aa, Homo Sapiens
KSPTKSILL

SEQ ID NO: 171582 - protein, 9 aa, Homo Sapiens
KSSDFYITL

SEQ ID NO: 171583 - protein, 9 aa, Homo Sapiens
KSSVKAVIL

SEQ ID NO: 171584 - protein, 9 aa, Homo Sapiens
KSVKVKIKL

SEQ ID NO: 171585 - protein, 9 aa, Homo Sapiens
KTADKKLLL

SEQ ID NO: 171586 - protein, 9 aa, Homo Sapiens
KTADKKLNL

SEQ ID NO: 171587 - protein, 9 aa, Homo Sapiens
KTAQNHPML

SEQ ID NO: 171588 - protein, 9 aa, Homo Sapiens
KTIDGHINL

SEQ ID NO: 171589 - protein, 9 aa, Homo Sapiens
KTIHKYVHL

SEQ ID NO: 171590 - protein, 9 aa, Homo Sapiens
KTILDKVKL

SEQ ID NO: 171591 - protein, 9 aa, Homo Sapiens
KTLQKKCYL

SEQ ID NO: 171592 - protein, 9 aa, Homo Sapiens
KTPAEFAKL

SEQ ID NO: 171593 - protein, 9 aa, Homo Sapiens
KTPDSRPSL

SEQ ID NO: 171594 - protein, 9 aa, Homo Sapiens
KTPESKPTI

SEQ ID NO: 171595 - protein, 9 aa, Homo Sapiens
KTPESNIKM

SEQ ID NO: 171596 - protein, 9 aa, Homo Sapiens
KTPGDVLRL

SEQ ID NO: 171597 - protein, 9 aa, Homo Sapiens
KTPLKKFLL

SEQ ID NO: 171598 - protein, 9 aa, Homo Sapiens
KTPMENIGL

SEQ ID NO: 171599 - protein, 9 aa, Homo Sapiens
KTPNFSTLL

SEQ ID NO: 171600 - protein, 9 aa, Homo Sapiens
KTPPRVLTL

SEQ ID NO: 171601 - protein, 9 aa, Homo Sapiens
KTPQYKASL

SEQ ID NO: 171602 - protein, 9 aa, Homo Sapiens
KTSTQKFFL

SEQ ID NO: 171603 - protein, 9 aa, Homo Sapiens
KTTNAKVAL

SEQ ID NO: 171604 - protein, 9 aa, Homo Sapiens
KTVDQHMKL

SEQ ID NO: 171605 - protein, 9 aa, Homo Sapiens
KTVEQHLRL

SEQ ID NO: 171606 - protein, 9 aa, Homo Sapiens
KTVIGKARL

SEQ ID NO: 171607 - protein, 9 aa, Homo Sapiens
KTVNERITL

SEQ ID NO: 171608 - protein, 9 aa, Homo Sapiens
KTVPQKVTI

SEQ ID NO: 171609 - protein, 9 aa, Homo Sapiens
KTVQCKVTL

SEQ ID NO: 171610 - protein, 9 aa, Homo Sapiens
KVADSKTLL

SEQ ID NO: 171611 - protein, 9 aa, Homo Sapiens
KVAETAVQL

SEQ ID NO: 171612 - protein, 9 aa, Homo Sapiens
KVIAQQVQL

SEQ ID NO: 171613 - protein, 9 aa, Homo Sapiens
KVIDRKVEL

SEQ ID NO: 171614 - protein, 9 aa, Homo Sapiens
KVIEEAVYF

SEQ ID NO: 171615 - protein, 9 aa, Homo Sapiens
KVIEINPYL

SEQ ID NO: 171616 - protein, 9 aa, Homo Sapiens
KVIEKRYFL

SEQ ID NO: 171617 - protein, 9 aa, Homo Sapiens
KVISSNTSL

SEQ ID NO: 171618 - protein, 9 aa, Homo Sapiens
KVPAESPTL

SEQ ID NO: 171619 - protein, 9 aa, Homo Sapiens
KVPEKKLKL

SEQ ID NO: 171620 - protein, 9 aa, Homo Sapiens
KVPHDPVAL

SEQ ID NO: 171621 - protein, 9 aa, Homo Sapiens
KVPKERLAL

SEQ ID NO: 171622 - protein, 9 aa, Homo Sapiens
KVPKGALLL

SEQ ID NO: 171623 - protein, 9 aa, Homo Sapiens
KVPLQYNEL

SEQ ID NO: 171624 - protein, 9 aa, Homo Sapiens
KVPNQYTHL

SEQ ID NO: 171625 - protein, 9 aa, Homo Sapiens
KVPSTPVHL

SEQ ID NO: 171626 - protein, 9 aa, Homo Sapiens
KVPTFVRML

SEQ ID NO: 171627 - protein, 9 aa, Homo Sapiens
KVVAKGLGL

SEQ ID NO: 171628 - protein, 9 aa, Homo Sapiens
KVVDDTLEL

SEQ ID NO: 171629 - protein, 9 aa, Homo Sapiens
KVVGKDYLL

SEQ ID NO: 171630 - protein, 9 aa, Homo Sapiens
KVVKLHTKL

SEQ ID NO: 171631 - protein, 9 aa, Homo Sapiens
KVVSQYHEL

SEQ ID NO: 171632 - protein, 9 aa, Homo Sapiens
KVVSQYSSL

SEQ ID NO: 171633 - protein, 9 aa, Homo Sapiens
KVVTRHPDL

SEQ ID NO: 171634 - protein, 9 aa, Homo Sapiens
KVVVHPLVL

SEQ ID NO: 171635 - protein, 9 aa, Homo Sapiens
KWPETPLLL

SEQ ID NO: 171636 - protein, 9 aa, Homo Sapiens
KYIDKTIRV

SEQ ID NO: 171637 - protein, 9 aa, Homo Sapiens
KYIDQKFVL

SEQ ID NO: 171638 - protein, 9 aa, Homo Sapiens
KYIGENLQL

SEQ ID NO: 171639 - protein, 9 aa, Homo Sapiens
KYIHSANVL

SEQ ID NO: 171640 - protein, 9 aa, Homo Sapiens
KYIKEAVRL

SEQ ID NO: 171641 - protein, 9 aa, Homo Sapiens
KYPASTVQI

SEQ ID NO: 171642 - protein, 9 aa, Homo Sapiens
KYPDNQVKL

SEQ ID NO: 171643 - protein, 9 aa, Homo Sapiens
KYPENFFLL

SEQ ID NO: 171644 - protein, 9 aa, Homo Sapiens
KYPFIPLLL

SEQ ID NO: 171645 - protein, 9 aa, Homo Sapiens
KYPHYFPLL

SEQ ID NO: 171646 - protein, 9 aa, Homo Sapiens
KYPHYFPVM

SEQ ID NO: 171647 - protein, 9 aa, Homo Sapiens
KYPPSATTL

SEQ ID NO: 171648 - protein, 9 aa, Homo Sapiens
KYPQAIYTL

SEQ ID NO: 171649 - protein, 9 aa, Homo Sapiens
KYPTLPGKL

SEQ ID NO: 171650 - protein, 9 aa, Homo Sapiens
KYPVGVHFL

SEQ ID NO: 171651 - protein, 9 aa, Homo Sapiens
KYPVHIYRL

SEQ ID NO: 171652 - protein, 9 aa, Homo Sapiens
KYPYVAVML

SEQ ID NO: 171653 - protein, 9 aa, Homo Sapiens
KYVQDNIQL

SEQ ID NO: 171654 - protein, 9 aa, Homo Sapiens
LAPQNKPEL

SEQ ID NO: 171655 - protein, 9 aa, Homo Sapiens
LHKARHVLE

SEQ ID NO: 171656 - protein, 9 aa, Homo Sapiens
LIIGKKFKL

SEQ ID NO: 171657 - protein, 9 aa, Homo Sapiens
LIPCKKFDL

SEQ ID NO: 171658 - protein, 9 aa, Homo Sapiens
LIVDRPVTL

SEQ ID NO: 171659 - protein, 9 aa, Homo Sapiens
LLPNGKLIL

SEQ ID NO: 171660 - protein, 9 aa, Homo Sapiens
LMPGSTLVL

SEQ ID NO: 171661 - protein, 9 aa, Homo Sapiens
LMPPTKPFL

SEQ ID NO: 171662 - protein, 9 aa, Homo Sapiens
LQINDKIAL

SEQ ID NO: 171663 - protein, 9 aa, Homo Sapiens
LQPKQPLRL

SEQ ID NO: 171664 - protein, 9 aa, Homo Sapiens
LRRPLLHEL

SEQ ID NO: 171665 - protein, 9 aa, Homo Sapiens
LSLLKSHPK

SEQ ID NO: 171666 - protein, 9 aa, Homo Sapiens
LSPKEFYEL

SEQ ID NO: 171667 - protein, 9 aa, Homo Sapiens
LSPKSYYEL

SEQ ID NO: 171668 - protein, 9 aa, Homo Sapiens
LSPTNYHFL

SEQ ID NO: 171669 - protein, 9 aa, Homo Sapiens
LYPDHFHLL

SEQ ID NO: 171670 - protein, 9 aa, Homo Sapiens
LYPSGTLKL

SEQ ID NO: 171671 - protein, 9 aa, Homo Sapiens
MAPRTLFLL

SEQ ID NO: 171672 - protein, 9 aa, Homo Sapiens
MFPEMSIHL

SEQ ID NO: 171673 - protein, 9 aa, Homo Sapiens
MILNKALLL

SEQ ID NO: 171674 - protein, 9 aa, Homo Sapiens
MLPPKKFVL

SEQ ID NO: 171675 - protein, 9 aa, Homo Sapiens
MQIVHKITL

SEQ ID NO: 171676 - protein, 9 aa, Homo Sapiens
MQPFNYVTL

SEQ ID NO: 171677 - protein, 9 aa, Homo Sapiens
MQPTHPIRL

SEQ ID NO: 171678 - protein, 9 aa, Homo Sapiens
MRPRKAFLL

SEQ ID NO: 171679 - protein, 9 aa, Homo Sapiens
MSPNSYIKL

SEQ ID NO: 171680 - protein, 9 aa, Homo Sapiens
NIIAKKIVL

SEQ ID NO: 171681 - protein, 9 aa, Homo Sapiens
NIPAGKPSL

SEQ ID NO: 171682 - protein, 9 aa, Homo Sapiens
NIPEKKLIL

SEQ ID NO: 171683 - protein, 9 aa, Homo Sapiens
NQPKERLVL

SEQ ID NO: 171684 - protein, 9 aa, Homo Sapiens
NQVKGKPDL

SEQ ID NO: 171685 - protein, 9 aa, Homo Sapiens
NYPDEFTKL

SEQ ID NO: 171686 - protein, 9 aa, Homo Sapiens
PLAPAPVFI

SEQ ID NO: 171687 - protein, 9 aa, Homo Sapiens
QFPGGSIDL

SEQ ID NO: 171688 - protein, 9 aa, Homo Sapiens
QFVKDSIRL

SEQ ID NO: 171689 - protein, 9 aa, Homo Sapiens
QGPPERVVL

SEQ ID NO: 171690 - protein, 9 aa, Homo Sapiens
QGPSRHVYL

SEQ ID NO: 171691 - protein, 9 aa, Homo Sapiens
QIIHQKPKL

SEQ ID NO: 171692 - protein, 9 aa, Homo Sapiens
QIPENGLTL

SEQ ID NO: 171693 - protein, 9 aa, Homo Sapiens
QIPVSKMLL

SEQ ID NO: 171694 - protein, 9 aa, Homo Sapiens
QIVKEKVHL

SEQ ID NO: 171695 - protein, 9 aa, Homo Sapiens
QKPSYYVRL

SEQ ID NO: 171696 - protein, 9 aa, Homo Sapiens
QLIAKKIKL

SEQ ID NO: 171697 - protein, 9 aa, Homo Sapiens
QLIEKRLNL

SEQ ID NO: 171698 - protein, 9 aa, Homo Sapiens
QLISKAIHL

SEQ ID NO: 171699 - protein, 9 aa, Homo Sapiens
QLPLVKPYL

SEQ ID NO: 171700 - protein, 9 aa, Homo Sapiens
QLPYNGVVL

SEQ ID NO: 171701 - protein, 9 aa, Homo Sapiens
QMPKVHIEF

SEQ ID NO: 171702 - protein, 9 aa, Homo Sapiens
QRPETAATL

SEQ ID NO: 171703 - protein, 9 aa, Homo Sapiens
QSINKKLEL

SEQ ID NO: 171704 - protein, 9 aa, Homo Sapiens
QTIINKFEL

SEQ ID NO: 171705 - protein, 9 aa, Homo Sapiens
QVIKEKLRL

SEQ ID NO: 171706 - protein, 9 aa, Homo Sapiens
RAIQKKIDL

SEQ ID NO: 171707 - protein, 9 aa, Homo Sapiens
RAPAEFIRF

SEQ ID NO: 171708 - protein, 9 aa, Homo Sapiens
RAPAQNPEL

SEQ ID NO: 171709 - protein, 9 aa, Homo Sapiens
RAPPPPPLL

SEQ ID NO: 171710 - protein, 9 aa, Homo Sapiens
RCIKETLRL

SEQ ID NO: 171711 - protein, 9 aa, Homo Sapiens
RFPDENFKL

SEQ ID NO: 171712 - protein, 9 aa, Homo Sapiens
RFPDENFTL

SEQ ID NO: 171713 - protein, 9 aa, Homo Sapiens
RFPDGTNGL

SEQ ID NO: 171714 - protein, 9 aa, Homo Sapiens
RFPFSRPEL

SEQ ID NO: 171715 - protein, 9 aa, Homo Sapiens
RFPHDKLLL

SEQ ID NO: 171716 - protein, 9 aa, Homo Sapiens
RFPHHDNEL

SEQ ID NO: 171717 - protein, 9 aa, Homo Sapiens
RFPKAPSKL

SEQ ID NO: 171718 - protein, 9 aa, Homo Sapiens
RFPNFTNQL

SEQ ID NO: 171719 - protein, 9 aa, Homo Sapiens
RFPTQHQRL

SEQ ID NO: 171720 - protein, 9 aa, Homo Sapiens
RGPAHKLAL

SEQ ID NO: 171721 - protein, 9 aa, Homo Sapiens
RGPGWRPLL

SEQ ID NO: 171722 - protein, 9 aa, Homo Sapiens
RGPLAKIWL

SEQ ID NO: 171723 - protein, 9 aa, Homo Sapiens
RGPLKCVKL

SEQ ID NO: 171724 - protein, 9 aa, Homo Sapiens
RGPPARVTL

SEQ ID NO: 171725 - protein, 9 aa, Homo Sapiens
RGPPQRPKL

SEQ ID NO: 171726 - protein, 9 aa, Homo Sapiens
RGPRDCVVL

SEQ ID NO: 171727 - protein, 9 aa, Homo Sapiens
RGVDNKIRL

SEQ ID NO: 171728 - protein, 9 aa, Homo Sapiens
RHPAATAQL

SEQ ID NO: 171729 - protein, 9 aa, Homo Sapiens
RHPASSVAL

SEQ ID NO: 171730 - protein, 9 aa, Homo Sapiens
RHPKYKTEL

SEQ ID NO: 171731 - protein, 9 aa, Homo Sapiens
RHPREVVIL

SEQ ID NO: 171732 - protein, 9 aa, Homo Sapiens
RHPSQTVEL

SEQ ID NO: 171733 - protein, 9 aa, Homo Sapiens
RIAEFTTNL

SEQ ID NO: 171734 - protein, 9 aa, Homo Sapiens
RIAEYAFKL

SEQ ID NO: 171735 - protein, 9 aa, Homo Sapiens
RIAGEASRL

SEQ ID NO: 171736 - protein, 9 aa, Homo Sapiens
RIAPRPYRL

SEQ ID NO: 171737 - protein, 9 aa, Homo Sapiens
RIAQLRFLL

SEQ ID NO: 171738 - protein, 9 aa, Homo Sapiens
RIEKNPARL

SEQ ID NO: 171739 - protein, 9 aa, Homo Sapiens
RIHDKAVAL

SEQ ID NO: 171740 - protein, 9 aa, Homo Sapiens
RIIAHAQLL

SEQ ID NO: 171741 - protein, 9 aa, Homo Sapiens
RIIKETQRL

SEQ ID NO: 171742 - protein, 9 aa, Homo Sapiens
RIIPRHLQL

SEQ ID NO: 171743 - protein, 9 aa, Homo Sapiens
RIIQDRVSL

SEQ ID NO: 171744 - protein, 9 aa, Homo Sapiens
RIIRKVVKL

SEQ ID NO: 171745 - protein, 9 aa, Homo Sapiens
RIISGHIDL

SEQ ID NO: 171746 - protein, 9 aa, Homo Sapiens
RIMEFTTTL

SEQ ID NO: 171747 - protein, 9 aa, Homo Sapiens
RIPAHRFVL

SEQ ID NO: 171748 - protein, 9 aa, Homo Sapiens
RIPATPVVI

SEQ ID NO: 171749 - protein, 9 aa, Homo Sapiens
RIPDRPYSL

SEQ ID NO: 171750 - protein, 9 aa, Homo Sapiens
RIPKEQGVL

SEQ ID NO: 171751 - protein, 9 aa, Homo Sapiens
RIPNRGIDL

SEQ ID NO: 171752 - protein, 9 aa, Homo Sapiens
RIPPVAVRL

SEQ ID NO: 171753 - protein, 9 aa, Homo Sapiens
RIPQARALL

SEQ ID NO: 171754 - protein, 9 aa, Homo Sapiens
RIPQEKCIL

SEQ ID NO: 171755 - protein, 9 aa, Homo Sapiens
RIPSFVTEL

SEQ ID NO: 171756 - protein, 9 aa, Homo Sapiens
RIPTISTQL

SEQ ID NO: 171757 - protein, 9 aa, Homo Sapiens
RISNPPILL

SEQ ID NO: 171758 - protein, 9 aa, Homo Sapiens
RITPRHLQL

SEQ ID NO: 171759 - protein, 9 aa, Homo Sapiens
RITTEKMLL

SEQ ID NO: 171760 - protein, 9 aa, Homo Sapiens
RIVDVRPTL

SEQ ID NO: 171761 - protein, 9 aa, Homo Sapiens
RIVPEPVQF

SEQ ID NO: 171762 - protein, 9 aa, Homo Sapiens
RIVPGAVSV

SEQ ID NO: 171763 - protein, 9 aa, Homo Sapiens
RIVVEHIIM

SEQ ID NO: 171764 - protein, 9 aa, Homo Sapiens
RKIKGVIEL

SEQ ID NO: 171765 - protein, 9 aa, Homo Sapiens
RKPDNYMTL

SEQ ID NO: 171766 - protein, 9 aa, Homo Sapiens
RKPDSKIVL

SEQ ID NO: 171767 - protein, 9 aa, Homo Sapiens
RKPPEVVRL

SEQ ID NO: 171768 - protein, 9 aa, Homo Sapiens
RKPPTSIRL

SEQ ID NO: 171769 - protein, 9 aa, Homo Sapiens
RKVKGNLIL

SEQ ID NO: 171770 - protein, 9 aa, Homo Sapiens
RLAQEAVTL

SEQ ID NO: 171771 - protein, 9 aa, Homo Sapiens
RLHLPPVRL

SEQ ID NO: 171772 - protein, 9 aa, Homo Sapiens
RLIAQRYLL

SEQ ID NO: 171773 - protein, 9 aa, Homo Sapiens
RLIERKSDL

SEQ ID NO: 171774 - protein, 9 aa, Homo Sapiens
RLINQVLEL

SEQ ID NO: 171775 - protein, 9 aa, Homo Sapiens
RLLKSKLYL

SEQ ID NO: 171776 - protein, 9 aa, Homo Sapiens
RLPAWQPIL

SEQ ID NO: 171777 - protein, 9 aa, Homo Sapiens
RLPDEKVEL

SEQ ID NO: 171778 - protein, 9 aa, Homo Sapiens
RLPDGRVVL

SEQ ID NO: 171779 - protein, 9 aa, Homo Sapiens
RLPDQFSKL

SEQ ID NO: 171780 - protein, 9 aa, Homo Sapiens
RLPEIYIQL

SEQ ID NO: 171781 - protein, 9 aa, Homo Sapiens
RLPEPTTRL

SEQ ID NO: 171782 - protein, 9 aa, Homo Sapiens
RLPHSTAAL

SEQ ID NO: 171783 - protein, 9 aa, Homo Sapiens
RLPKDFVDL

SEQ ID NO: 171784 - protein, 9 aa, Homo Sapiens
RLPPHLIAL

SEQ ID NO: 171785 - protein, 9 aa, Homo Sapiens
RLPPPFPGL

SEQ ID NO: 171786 - protein, 9 aa, Homo Sapiens
RLPPYSSQL

SEQ ID NO: 171787 - protein, 9 aa, Homo Sapiens
RLPQYQTDL

SEQ ID NO: 171788 - protein, 9 aa, Homo Sapiens
RLPRETLAF

SEQ ID NO: 171789 - protein, 9 aa, Homo Sapiens
RLPSGKVGF

SEQ ID NO: 171790 - protein, 9 aa, Homo Sapiens
RLPSRVLEL

SEQ ID NO: 171791 - protein, 9 aa, Homo Sapiens
RLVAMAVKL

SEQ ID NO: 171792 - protein, 9 aa, Homo Sapiens
RLVESKVEL

SEQ ID NO: 171793 - protein, 9 aa, Homo Sapiens
RLVEVKPSL

SEQ ID NO: 171794 - protein, 9 aa, Homo Sapiens
RLVKEYTVL

SEQ ID NO: 171795 - protein, 9 aa, Homo Sapiens
RLVPFLVEL

SEQ ID NO: 171796 - protein, 9 aa, Homo Sapiens
RMIKPRIVL

SEQ ID NO: 171797 - protein, 9 aa, Homo Sapiens
RMPAEIVVL

SEQ ID NO: 171798 - protein, 9 aa, Homo Sapiens
RMPCHKPYL

SEQ ID NO: 171799 - protein, 9 aa, Homo Sapiens
RMPDCSVAL

SEQ ID NO: 171800 - protein, 9 aa, Homo Sapiens
RMPDGPVAL

SEQ ID NO: 171801 - protein, 9 aa, Homo Sapiens
RMPRCGIRL

SEQ ID NO: 171802 - protein, 9 aa, Homo Sapiens
RMTEDALRL

SEQ ID NO: 171803 - protein, 9 aa, Homo Sapiens
RMVASKMEL

SEQ ID NO: 171804 - protein, 9 aa, Homo Sapiens
RNIKNKVMV

SEQ ID NO: 171805 - protein, 9 aa, Homo Sapiens
RNIKNKVVV

SEQ ID NO: 171806 - protein, 9 aa, Homo Sapiens
RNIVKKFLM

SEQ ID NO: 171807 - protein, 9 aa, Homo Sapiens
RNPKNYLSL

SEQ ID NO: 171808 - protein, 9 aa, Homo Sapiens
RNPQSYLYL

SEQ ID NO: 171809 - protein, 9 aa, Homo Sapiens
RQIKDRVTM

SEQ ID NO: 171810 - protein, 9 aa, Homo Sapiens
RQIPWKLGL

SEQ ID NO: 171811 - protein, 9 aa, Homo Sapiens
RQPDLVLRL

SEQ ID NO: 171812 - protein, 9 aa, Homo Sapiens
RQPEFRAVL

SEQ ID NO: 171813 - protein, 9 aa, Homo Sapiens
RQPNPPLIL

SEQ ID NO: 171814 - protein, 9 aa, Homo Sapiens
RQPPESLKL

SEQ ID NO: 171815 - protein, 9 aa, Homo Sapiens
RQPPPRPFL

SEQ ID NO: 171816 - protein, 9 aa, Homo Sapiens
RQPYAVSEL

SEQ ID NO: 171817 - protein, 9 aa, Homo Sapiens
RQVDSHVEL

SEQ ID NO: 171818 - protein, 9 aa, Homo Sapiens
RQVPKCLVL

SEQ ID NO: 171819 - protein, 9 aa, Homo Sapiens
RRIQFPIEM

SEQ ID NO: 171820 - protein, 9 aa, Homo Sapiens
RRPNCGIRL

SEQ ID NO: 171821 - protein, 9 aa, Homo Sapiens
RRPYVRVEL

SEQ ID NO: 171822 - protein, 9 aa, Homo Sapiens
RRVEETLKL

SEQ ID NO: 171823 - protein, 9 aa, Homo Sapiens
RSIFDHIKL

SEQ ID NO: 171824 - protein, 9 aa, Homo Sapiens
RSPDRNLLL

SEQ ID NO: 171825 - protein, 9 aa, Homo Sapiens
RSPEEWPNL

SEQ ID NO: 171826 - protein, 9 aa, Homo Sapiens
RSPFSFVYL

SEQ ID NO: 171827 - protein, 9 aa, Homo Sapiens
RSPGRAYAL

SEQ ID NO: 171828 - protein, 9 aa, Homo Sapiens
RSPMHRVTL

SEQ ID NO: 171829 - protein, 9 aa, Homo Sapiens
RSPNHIVVL

SEQ ID NO: 171830 - protein, 9 aa, Homo Sapiens
RSPPIKPLL

SEQ ID NO: 171831 - protein, 9 aa, Homo Sapiens
RSPPQAICL

SEQ ID NO: 171832 - protein, 9 aa, Homo Sapiens
RSPPRALVL

SEQ ID NO: 171833 - protein, 9 aa, Homo Sapiens
RSPSKNIYL

SEQ ID NO: 171834 - protein, 9 aa, Homo Sapiens
RSPTAWHRL

SEQ ID NO: 171835 - protein, 9 aa, Homo Sapiens
RSPTKAPHL

SEQ ID NO: 171836 - protein, 9 aa, Homo Sapiens
RSPVTKIML

SEQ ID NO: 171837 - protein, 9 aa, Homo Sapiens
RSPVVHSVL

SEQ ID NO: 171838 - protein, 9 aa, Homo Sapiens
RSPVYLTVL

SEQ ID NO: 171839 - protein, 9 aa, Homo Sapiens
RSVKVKIKL

SEQ ID NO: 171840 - protein, 9 aa, Homo Sapiens
RTCAVHITL

SEQ ID NO: 171841 - protein, 9 aa, Homo Sapiens
RTIAKRLVL

SEQ ID NO: 171842 - protein, 9 aa, Homo Sapiens
RTIPGKQQL

SEQ ID NO: 171843 - protein, 9 aa, Homo Sapiens
RTPSGKLRL

SEQ ID NO: 171844 - protein, 9 aa, Homo Sapiens
RTPYHVNLL

SEQ ID NO: 171845 - protein, 9 aa, Homo Sapiens
RTVDARLKL

SEQ ID NO: 171846 - protein, 9 aa, Homo Sapiens
RVAIKKIVL

SEQ ID NO: 171847 - protein, 9 aa, Homo Sapiens
RVCDYHTKL

SEQ ID NO: 171848 - protein, 9 aa, Homo Sapiens
RVIDYILDL

SEQ ID NO: 171849 - protein, 9 aa, Homo Sapiens
RVIGPPVVL

SEQ ID NO: 171850 - protein, 9 aa, Homo Sapiens
RVIKNSIRL

SEQ ID NO: 171851 - protein, 9 aa, Homo Sapiens
RVPAHAVVV

SEQ ID NO: 171852 - protein, 9 aa, Homo Sapiens
RVPAHRNLL

SEQ ID NO: 171853 - protein, 9 aa, Homo Sapiens
RVPAKSTLL

SEQ ID NO: 171854 - protein, 9 aa, Homo Sapiens
RVPATNLIL

SEQ ID NO: 171855 - protein, 9 aa, Homo Sapiens
RVPIAKILL

SEQ ID NO: 171856 - protein, 9 aa, Homo Sapiens
RVPKDRPSL

SEQ ID NO: 171857 - protein, 9 aa, Homo Sapiens
RVPKSKLEV

SEQ ID NO: 171858 - protein, 9 aa, Homo Sapiens
RVPQEAVKL

SEQ ID NO: 171859 - protein, 9 aa, Homo Sapiens
RVPSPKVVL

SEQ ID NO: 171860 - protein, 9 aa, Homo Sapiens
RVPTASYDL

SEQ ID NO: 171861 - protein, 9 aa, Homo Sapiens
RVSSSKISL

SEQ ID NO: 171862 - protein, 9 aa, Homo Sapiens
RVVLKRVLL

SEQ ID NO: 171863 - protein, 9 aa, Homo Sapiens
RYPCFFNTL

SEQ ID NO: 171864 - protein, 9 aa, Homo Sapiens
RYPDPLIKV

SEQ ID NO: 171865 - protein, 9 aa, Homo Sapiens
RYPDSHQLF

SEQ ID NO: 171866 - protein, 9 aa, Homo Sapiens
RYPEGGQIL

SEQ ID NO: 171867 - protein, 9 aa, Homo Sapiens
RYPERITIL

SEQ ID NO: 171868 - protein, 9 aa, Homo Sapiens
RYPPAANEL

SEQ ID NO: 171869 - protein, 9 aa, Homo Sapiens
RYPPDSVRL

SEQ ID NO: 171870 - protein, 9 aa, Homo Sapiens
RYPRESNKL

SEQ ID NO: 171871 - protein, 9 aa, Homo Sapiens
RYPTSIASL

SEQ ID NO: 171872 - protein, 9 aa, Homo Sapiens
RYPTTFVMV

SEQ ID NO: 171873 - protein, 9 aa, Homo Sapiens
SAPAKKIKL

SEQ ID NO: 171874 - protein, 9 aa, Homo Sapiens
SFPCHQTKL

SEQ ID NO: 171875 - protein, 9 aa, Homo Sapiens
SFPEKKPRL

SEQ ID NO: 171876 - protein, 9 aa, Homo Sapiens
SFPHEKLLL

SEQ ID NO: 171877 - protein, 9 aa, Homo Sapiens
SFPLVTVHL

SEQ ID NO: 171878 - protein, 9 aa, Homo Sapiens
SFPNVYHEL

SEQ ID NO: 171879 - protein, 9 aa, Homo Sapiens
SFPSEPVKL

SEQ ID NO: 171880 - protein, 9 aa, Homo Sapiens
SFPTQPVNL

SEQ ID NO: 171881 - protein, 9 aa, Homo Sapiens
SGPKSKLKL

SEQ ID NO: 171882 - protein, 9 aa, Homo Sapiens
SHPSDHIAL

SEQ ID NO: 171883 - protein, 9 aa, Homo Sapiens
SIIADRIAL

SEQ ID NO: 171884 - protein, 9 aa, Homo Sapiens
SIPALTATL

SEQ ID NO: 171885 - protein, 9 aa, Homo Sapiens
SIPGARPVL

SEQ ID NO: 171886 - protein, 9 aa, Homo Sapiens
SIPKDKQML

SEQ ID NO: 171887 - protein, 9 aa, Homo Sapiens
SIPKGKISI

SEQ ID NO: 171888 - protein, 9 aa, Homo Sapiens
SIPTHKCGL

SEQ ID NO: 171889 - protein, 9 aa, Homo Sapiens
SIPTKALEL

SEQ ID NO: 171890 - protein, 9 aa, Homo Sapiens
SITKNTAKL

SEQ ID NO: 171891 - protein, 9 aa, Homo Sapiens
SIVDYKPNL

SEQ ID NO: 171892 - protein, 9 aa, Homo Sapiens
SKIKGKPVL

SEQ ID NO: 171893 - protein, 9 aa, Homo Sapiens
SLIGEKVCL

SEQ ID NO: 171894 - protein, 9 aa, Homo Sapiens
SLIKHKIML

SEQ ID NO: 171895 - protein, 9 aa, Homo Sapiens
SLITNKVIM

SEQ ID NO: 171896 - protein, 9 aa, Homo Sapiens
SLIVGGVDL

SEQ ID NO: 171897 - protein, 9 aa, Homo Sapiens
SLPASKQML

SEQ ID NO: 171898 - protein, 9 aa, Homo Sapiens
SLPDIKVYL

SEQ ID NO: 171899 - protein, 9 aa, Homo Sapiens
SLPRFQVTL

SEQ ID NO: 171900 - protein, 9 aa, Homo Sapiens
SLPSTKPQL

SEQ ID NO: 171901 - protein, 9 aa, Homo Sapiens
SLPSWKSLL

SEQ ID NO: 171902 - protein, 9 aa, Homo Sapiens
SLTPVTLVL

SEQ ID NO: 171903 - protein, 9 aa, Homo Sapiens
SMPDHSIHL

SEQ ID NO: 171904 - protein, 9 aa, Homo Sapiens
SMPSNSVQL

SEQ ID NO: 171905 - protein, 9 aa, Homo Sapiens
SMVHKRINL

SEQ ID NO: 171906 - protein, 9 aa, Homo Sapiens
SMVIQKIYL

SEQ ID NO: 171907 - protein, 9 aa, Homo Sapiens
SNIEEKIKL

SEQ ID NO: 171908 - protein, 9 aa, Homo Sapiens
SNIYSKFLL

SEQ ID NO: 171909 - protein, 9 aa, Homo Sapiens
SQPGVAIGL

SEQ ID NO: 171910 - protein, 9 aa, Homo Sapiens
SQPTSTIIL

SEQ ID NO: 171911 - protein, 9 aa, Homo Sapiens
SRPESSVDL

SEQ ID NO: 171912 - protein, 9 aa, Homo Sapiens
SRPGKNVQL

SEQ ID NO: 171913 - protein, 9 aa, Homo Sapiens
SRPKSNIVL

SEQ ID NO: 171914 - protein, 9 aa, Homo Sapiens
SRPLSAVVL

SEQ ID NO: 171915 - protein, 9 aa, Homo Sapiens
SSIKDKIVL

SEQ ID NO: 171916 - protein, 9 aa, Homo Sapiens
SSPGQAVEL

SEQ ID NO: 171917 - protein, 9 aa, Homo Sapiens
SSPKEAVGL

SEQ ID NO: 171918 - protein, 9 aa, Homo Sapiens
SSPKGKFSL

SEQ ID NO: 171919 - protein, 9 aa, Homo Sapiens
SSPKQYMQL

SEQ ID NO: 171920 - protein, 9 aa, Homo Sapiens
SSVISKIDL

SEQ ID NO: 171921 - protein, 9 aa, Homo Sapiens
STIGQKIAL

SEQ ID NO: 171922 - protein, 9 aa, Homo Sapiens
STITSKMNL

SEQ ID NO: 171923 - protein, 9 aa, Homo Sapiens
STPKHYIRF

SEQ ID NO: 171924 - protein, 9 aa, Homo Sapiens
STPSGYLEL

SEQ ID NO: 171925 - protein, 9 aa, Homo Sapiens
STPTEKPKL

SEQ ID NO: 171926 - protein, 9 aa, Homo Sapiens
STVTTKVTL

SEQ ID NO: 171927 - protein, 9 aa, Homo Sapiens
SVIDEPVRL

SEQ ID NO: 171928 - protein, 9 aa, Homo Sapiens
SVIPDKPSL

SEQ ID NO: 171929 - protein, 9 aa, Homo Sapiens
SVIYKKFQL

SEQ ID NO: 171930 - protein, 9 aa, Homo Sapiens
SVPKHKLTL

SEQ ID NO: 171931 - protein, 9 aa, Homo Sapiens
SVPNKALEL

SEQ ID NO: 171932 - protein, 9 aa, Homo Sapiens
SVPPYGVAL

SEQ ID NO: 171933 - protein, 9 aa, Homo Sapiens
SVPQIHVNL

SEQ ID NO: 171934 - protein, 9 aa, Homo Sapiens
SVPSAKVSL

SEQ ID NO: 171935 - protein, 9 aa, Homo Sapiens
SVPTDYSYL

SEQ ID NO: 171936 - protein, 9 aa, Homo Sapiens
SYPHHATQL

SEQ ID NO: 171937 - protein, 9 aa, Homo Sapiens
TFPNNPVEL

SEQ ID NO: 171938 - protein, 9 aa, Homo Sapiens
TFPQNPVEL

SEQ ID NO: 171939 - protein, 9 aa, Homo Sapiens
TFPVHRQKL

SEQ ID NO: 171940 - protein, 9 aa, Homo Sapiens
THPFKTIEL

SEQ ID NO: 171941 - protein, 9 aa, Homo Sapiens
TIILSKMML

SEQ ID NO: 171942 - protein, 9 aa, Homo Sapiens
TIPGGTVLL

SEQ ID NO: 171943 - protein, 9 aa, Homo Sapiens
TIPKHRHLL

SEQ ID NO: 171944 - protein, 9 aa, Homo Sapiens
TIVTDGIQL

SEQ ID NO: 171945 - protein, 9 aa, Homo Sapiens
TLIGSKFRL

SEQ ID NO: 171946 - protein, 9 aa, Homo Sapiens
TLPAQKCIL

SEQ ID NO: 171947 - protein, 9 aa, Homo Sapiens
TLPEGCVVL

SEQ ID NO: 171948 - protein, 9 aa, Homo Sapiens
TLPPGSVLL

SEQ ID NO: 171949 - protein, 9 aa, Homo Sapiens
TLPTQKCHL

SEQ ID NO: 171950 - protein, 9 aa, Homo Sapiens
TLVKNCIVL

SEQ ID NO: 171951 - protein, 9 aa, Homo Sapiens
TMPPTTVIL

SEQ ID NO: 171952 - protein, 9 aa, Homo Sapiens
TMVKKKVVF

SEQ ID NO: 171953 - protein, 9 aa, Homo Sapiens
TNVINKIIL

SEQ ID NO: 171954 - protein, 9 aa, Homo Sapiens
TQPLYNIRL

SEQ ID NO: 171955 - protein, 9 aa, Homo Sapiens
TRPEKALIL

SEQ ID NO: 171956 - protein, 9 aa, Homo Sapiens
TRPKMSIVL

SEQ ID NO: 171957 - protein, 9 aa, Homo Sapiens
TTILYKLKL

SEQ ID NO: 171958 - protein, 9 aa, Homo Sapiens
TTPKHYIRF

SEQ ID NO: 171959 - protein, 9 aa, Homo Sapiens
TTPQCKYLL

SEQ ID NO: 171960 - protein, 9 aa, Homo Sapiens
TVIATNILL

SEQ ID NO: 171961 - protein, 9 aa, Homo Sapiens
TVPKETIHL

SEQ ID NO: 171962 - protein, 9 aa, Homo Sapiens
TYPGPAVVL

SEQ ID NO: 171963 - protein, 9 aa, Homo Sapiens
VAPEEHPVL

SEQ ID NO: 171964 - protein, 9 aa, Homo Sapiens
VAPPGCSHL

SEQ ID NO: 171965 - protein, 9 aa, Homo Sapiens
VFPHLTVVL

SEQ ID NO: 171966 - protein, 9 aa, Homo Sapiens
VFPKEPVEL

SEQ ID NO: 171967 - protein, 9 aa, Homo Sapiens
VFPSMPIKL

SEQ ID NO: 171968 - protein, 9 aa, Homo Sapiens
VGPEEKIAL

SEQ ID NO: 171969 - protein, 9 aa, Homo Sapiens
VIAPNPAQL

SEQ ID NO: 171970 - protein, 9 aa, Homo Sapiens
VIAPPLIKF

SEQ ID NO: 171971 - protein, 9 aa, Homo Sapiens
VIIGKTVTL

SEQ ID NO: 171972 - protein, 9 aa, Homo Sapiens
VIIGTKTIL

SEQ ID NO: 171973 - protein, 9 aa, Homo Sapiens
VINPEPITL

SEQ ID NO: 171974 - protein, 9 aa, Homo Sapiens
VIPAEKFDL

SEQ ID NO: 171975 - protein, 9 aa, Homo Sapiens
VIPKSKFVL

SEQ ID NO: 171976 - protein, 9 aa, Homo Sapiens
VIPPCKSEL

SEQ ID NO: 171977 - protein, 9 aa, Homo Sapiens
VIPRITIEM

SEQ ID NO: 171978 - protein, 9 aa, Homo Sapiens
VIPSTGIKL

SEQ ID NO: 171979 - protein, 9 aa, Homo Sapiens
VIPTERNLL

SEQ ID NO: 171980 - protein, 9 aa, Homo Sapiens
VIPTNVPEL

SEQ ID NO: 171981 - protein, 9 aa, Homo Sapiens
VITKTGAKL

SEQ ID NO: 171982 - protein, 9 aa, Homo Sapiens
VKSGDKPSL

SEQ ID NO: 171983 - protein, 9 aa, Homo Sapiens
VLPKLYVKL

SEQ ID NO: 171984 - protein, 9 aa, Homo Sapiens
VLPKSRVEL

SEQ ID NO: 171985 - protein, 9 aa, Homo Sapiens
VLPNIHPEL

SEQ ID NO: 171986 - protein, 9 aa, Homo Sapiens
VLPNTALHL

SEQ ID NO: 171987 - protein, 9 aa, Homo Sapiens
VLPPTCIQL

SEQ ID NO: 171988 - protein, 9 aa, Homo Sapiens
VLPVKKPKM

SEQ ID NO: 171989 - protein, 9 aa, Homo Sapiens
VLPVPPIEF

SEQ ID NO: 171990 - protein, 9 aa, Homo Sapiens
VMAPRTLFL

SEQ ID NO: 171991 - protein, 9 aa, Homo Sapiens
VMPKKRQAL

SEQ ID NO: 171992 - protein, 9 aa, Homo Sapiens
VQPKSLVRL

SEQ ID NO: 171993 - protein, 9 aa, Homo Sapiens
VQPSKYHFL

SEQ ID NO: 171994 - protein, 9 aa, Homo Sapiens
VQPTHVIHL

SEQ ID NO: 171995 - protein, 9 aa, Homo Sapiens
VQPVVHPQL

SEQ ID NO: 171996 - protein, 9 aa, Homo Sapiens
VQVHSKFRL

SEQ ID NO: 171997 - protein, 9 aa, Homo Sapiens
VRPPPGPEL

SEQ ID NO: 171998 - protein, 9 aa, Homo Sapiens
VSPKKSTVL

SEQ ID NO: 171999 - protein, 9 aa, Homo Sapiens
VSPRQTLEL

SEQ ID NO: 172000 - protein, 9 aa, Homo Sapiens
VVAKDGLKL

SEQ ID NO: 172001 - protein, 9 aa, Homo Sapiens
VVAPAGITL

SEQ ID NO: 172002 - protein, 9 aa, Homo Sapiens
VVPDHPVLL

SEQ ID NO: 172003 - protein, 9 aa, Homo Sapiens
VVPKDRVAL

SEQ ID NO: 172004 - protein, 9 aa, Homo Sapiens
VVPQTTVIL

SEQ ID NO: 172005 - protein, 9 aa, Homo Sapiens
VYIKHPVSL

SEQ ID NO: 172006 - protein, 9 aa, Homo Sapiens
YIIKDKHIL

SEQ ID NO: 172007 - protein, 10 aa, Homo Sapiens
AGDALLSLLA

SEQ ID NO: 172008 - protein, 10 aa, Homo Sapiens
EESNYELEGK

SEQ ID NO: 172009 - protein, 10 aa, Homo Sapiens
HFKESIKFIH

SEQ ID NO: 172010 - protein, 10 aa, Homo Sapiens
KAPKPGGLSL

SEQ ID NO: 172011 - protein, 10 aa, Homo Sapiens
KFPAYERVLL

SEQ ID NO: 172012 - protein, 10 aa, Homo Sapiens
KFPYPTQAEL

SEQ ID NO: 172013 - protein, 10 aa, Homo Sapiens
KIIAENKIRL

SEQ ID NO: 172014 - protein, 10 aa, Homo Sapiens
KIIDRAITSL

SEQ ID NO: 172015 - protein, 10 aa, Homo Sapiens
KIIEARLKMY

SEQ ID NO: 172016 - protein, 10 aa, Homo Sapiens
KIIEDLGVHF

SEQ ID NO: 172017 - protein, 10 aa, Homo Sapiens
KIPSSHPVSL

SEQ ID NO: 172018 - protein, 10 aa, Homo Sapiens
KISSVQPICL

SEQ ID NO: 172019 - protein, 10 aa, Homo Sapiens
KLLKCSRLVL

SEQ ID NO: 172020 - protein, 10 aa, Homo Sapiens
KLPAEPPALL

SEQ ID NO: 172021 - protein, 10 aa, Homo Sapiens
KLPAGKNVLL

SEQ ID NO: 172022 - protein, 10 aa, Homo Sapiens
KLPATEKPVL

SEQ ID NO: 172023 - protein, 10 aa, Homo Sapiens
KLPGDKGLVL

SEQ ID NO: 172024 - protein, 10 aa, Homo Sapiens
KLPPGFPVKL

SEQ ID NO: 172025 - protein, 10 aa, Homo Sapiens
KLPSVPSTHL

SEQ ID NO: 172026 - protein, 10 aa, Homo Sapiens
KLWPLPKALL

SEQ ID NO: 172027 - protein, 10 aa, Homo Sapiens
KMPGPGCVFL

SEQ ID NO: 172028 - protein, 10 aa, Homo Sapiens
KMPSLQPVVM

SEQ ID NO: 172029 - protein, 10 aa, Homo Sapiens
KNPKNPGLWL

SEQ ID NO: 172030 - protein, 10 aa, Homo Sapiens
KQPVGGGQKL

SEQ ID NO: 172031 - protein, 10 aa, Homo Sapiens
KTLDQAKAVL

SEQ ID NO: 172032 - protein, 10 aa, Homo Sapiens
KVPKERLALL

SEQ ID NO: 172033 - protein, 10 aa, Homo Sapiens
KVPPPWLIAM

SEQ ID NO: 172034 - protein, 10 aa, Homo Sapiens
KYPASTVQIL

SEQ ID NO: 172035 - protein, 10 aa, Homo Sapiens
KYVGSRPIKL

SEQ ID NO: 172036 - protein, 10 aa, Homo Sapiens
PFADVAPLQL

SEQ ID NO: 172037 - protein, 10 aa, Homo Sapiens
PLSMAPPLSL

SEQ ID NO: 172038 - protein, 10 aa, Homo Sapiens
PPSKPPPVEL

SEQ ID NO: 172039 - protein, 10 aa, Homo Sapiens
PSFPVSTLKL

SEQ ID NO: 172040 - protein, 10 aa, Homo Sapiens
QSYPHHATQL

SEQ ID NO: 172041 - protein, 10 aa, Homo Sapiens
RFPNFTNQLL

SEQ ID NO: 172042 - protein, 10 aa, Homo Sapiens
RHPQPGAVEL

SEQ ID NO: 172043 - protein, 10 aa, Homo Sapiens
RIINLGPVML

SEQ ID NO: 172044 - protein, 10 aa, Homo Sapiens
RIPAEGRVAL

SEQ ID NO: 172045 - protein, 10 aa, Homo Sapiens
RISQLDALEL

SEQ ID NO: 172046 - protein, 10 aa, Homo Sapiens
RLPYKAGLSL

SEQ ID NO: 172047 - protein, 10 aa, Homo Sapiens
RLYPLRKYAV

SEQ ID NO: 172048 - protein, 10 aa, Homo Sapiens
RMDPLEAIQL

SEQ ID NO: 172049 - protein, 10 aa, Homo Sapiens
RRPKNVVLRL

SEQ ID NO: 172050 - protein, 10 aa, Homo Sapiens
RTPGNRIVYL

SEQ ID NO: 172051 - protein, 10 aa, Homo Sapiens
RYPVNSVNIL

SEQ ID NO: 172052 - protein, 10 aa, Homo Sapiens
SLPRGKGIRL

SEQ ID NO: 172053 - protein, 10 aa, Homo Sapiens
SVAQVAPVDL

SEQ ID NO: 172054 - protein, 10 aa, Homo Sapiens
THPPGPAVQL

SEQ ID NO: 172055 - protein, 10 aa, Homo Sapiens
TLDGLPPLRL

SEQ ID NO: 172056 - protein, 10 aa, Homo Sapiens
TYPKGAGEML

SEQ ID NO: 172057 - protein, 11 aa, Homo Sapiens
KFPGPLENQRL

SEQ ID NO: 172058 - protein, 11 aa, Homo Sapiens
KFPPKDGFVAL

SEQ ID NO: 172059 - protein, 11 aa, Homo Sapiens
KFPSEYVPTVF

SEQ ID NO: 172060 - protein, 11 aa, Homo Sapiens
KIVPAKDLVLL

SEQ ID NO: 172061 - protein, 11 aa, Homo Sapiens
KLPATEKPVLL

SEQ ID NO: 172062 - protein, 11 aa, Homo Sapiens
KLPPTDAYYKL

SEQ ID NO: 172063 - protein, 11 aa, Homo Sapiens
KLPSGKLQVHL

SEQ ID NO: 172064 - protein, 11 aa, Homo Sapiens
KLPVANEYLLL

SEQ ID NO: 172065 - protein, 11 aa, Homo Sapiens
KMPQSMPEYAL

SEQ ID NO: 172066 - protein, 11 aa, Homo Sapiens
KSPASDTYIVF

SEQ ID NO: 172067 - protein, 11 aa, Homo Sapiens
KVPTYKDYVDL

SEQ ID NO: 172068 - protein, 11 aa, Homo Sapiens
NSSIIADRIAL

SEQ ID NO: 172069 - protein, 11 aa, Homo Sapiens
PGSLIPEALRL

SEQ ID NO: 172070 - protein, 11 aa, Homo Sapiens
RIPHNNFYRKL

SEQ ID NO: 172071 - protein, 11 aa, Homo Sapiens
RLPEMGSNVEL

SEQ ID NO: 172072 - protein, 11 aa, Homo Sapiens
RPPSKPPPVEL

SEQ ID NO: 172073 - protein, 11 aa, Homo Sapiens
RVIGPPVVLNC

SEQ ID NO: 172074 - protein, 8 aa, Homo Sapiens
ASPPPLLL

SEQ ID NO: 172075 - protein, 8 aa, Homo Sapiens
GLPEPLML

SEQ ID NO: 172076 - protein, 8 aa, Homo Sapiens
HKPGPITL

SEQ ID NO: 172077 - protein, 8 aa, Homo Sapiens
HRPPPIKL

SEQ ID NO: 172078 - protein, 8 aa, Homo Sapiens
IGKKRELK

SEQ ID NO: 172079 - protein, 8 aa, Homo Sapiens
IMPKDIQL

SEQ ID NO: 172080 - protein, 8 aa, Homo Sapiens
IQEAIALI

SEQ ID NO: 172081 - protein, 8 aa, Homo Sapiens
ITKTGAKL

SEQ ID NO: 172082 - protein, 8 aa, Homo Sapiens
KFIEGVVL

SEQ ID NO: 172083 - protein, 8 aa, Homo Sapiens
KIADPFVL

SEQ ID NO: 172084 - protein, 8 aa, Homo Sapiens
KIIAAITL

SEQ ID NO: 172085 - protein, 8 aa, Homo Sapiens
KIPSPVKL

SEQ ID NO: 172086 - protein, 8 aa, Homo Sapiens
KKPTPIQL

SEQ ID NO: 172087 - protein, 8 aa, Homo Sapiens
KMPLPLKL

SEQ ID NO: 172088 - protein, 8 aa, Homo Sapiens
KSPPPMNL

SEQ ID NO: 172089 - protein, 8 aa, Homo Sapiens
KVPFPLTL

SEQ ID NO: 172090 - protein, 8 aa, Homo Sapiens
LPKLYVKL

SEQ ID NO: 172091 - protein, 8 aa, Homo Sapiens
PLPPAVFL

SEQ ID NO: 172092 - protein, 8 aa, Homo Sapiens
QIAEAVRL

SEQ ID NO: 172093 - protein, 8 aa, Homo Sapiens
QIPAAVKL

SEQ ID NO: 172094 - protein, 8 aa, Homo Sapiens
RFPEALRL

SEQ ID NO: 172095 - protein, 8 aa, Homo Sapiens
RIPEPVHL

SEQ ID NO: 172096 - protein, 8 aa, Homo Sapiens
SIAGPVLL

SEQ ID NO: 172097 - protein, 8 aa, Homo Sapiens
SIAVPIVL

SEQ ID NO: 172098 - protein, 8 aa, Homo Sapiens
SIPVGISL

SEQ ID NO: 172099 - protein, 8 aa, Homo Sapiens
TGPPPLLL

SEQ ID NO: 172100 - protein, 8 aa, Homo Sapiens
TIAEGLTL

SEQ ID NO: 172101 - protein, 8 aa, Homo Sapiens
TIPIAVAL

SEQ ID NO: 172102 - protein, 8 aa, Homo Sapiens
TIPLAVVL

SEQ ID NO: 172103 - protein, 8 aa, Homo Sapiens
TLPTPMVL

SEQ ID NO: 172104 - protein, 8 aa, Homo Sapiens
VAPAGITL

SEQ ID NO: 172105 - protein, 8 aa, Homo Sapiens
VIGPPVVL

SEQ ID NO: 172106 - protein, 9 aa, Homo Sapiens
AFPGASLYL

SEQ ID NO: 172107 - protein, 9 aa, Homo Sapiens
AGPDRFVVL

SEQ ID NO: 172108 - protein, 9 aa, Homo Sapiens
AGPPDTISL

SEQ ID NO: 172109 - protein, 9 aa, Homo Sapiens
AHPKAKLVL

SEQ ID NO: 172110 - protein, 9 aa, Homo Sapiens
AHPLETLIL

SEQ ID NO: 172111 - protein, 9 aa, Homo Sapiens
AIIEYMPLL

SEQ ID NO: 172112 - protein, 9 aa, Homo Sapiens
AIIKEPIDI

SEQ ID NO: 172113 - protein, 9 aa, Homo Sapiens
AIIRDRAAL

SEQ ID NO: 172114 - protein, 9 aa, Homo Sapiens
AIISQKPQL

SEQ ID NO: 172115 - protein, 9 aa, Homo Sapiens
AIPKKKMNL

SEQ ID NO: 172116 - protein, 9 aa, Homo Sapiens
AIPNARIEL

SEQ ID NO: 172117 - protein, 9 aa, Homo Sapiens
AITPAGINL

SEQ ID NO: 172118 - protein, 9 aa, Homo Sapiens
AIVAKQVLL

SEQ ID NO: 172119 - protein, 9 aa, Homo Sapiens
AIVGNKVDL

SEQ ID NO: 172120 - protein, 9 aa, Homo Sapiens
AIVNSALKL

SEQ ID NO: 172121 - protein, 9 aa, Homo Sapiens
ALIKDKILF

SEQ ID NO: 172122 - protein, 9 aa, Homo Sapiens
ALPKLPISL

SEQ ID NO: 172123 - protein, 9 aa, Homo Sapiens
ALVKEKLRL

SEQ ID NO: 172124 - protein, 9 aa, Homo Sapiens
APLPPAVFL

SEQ ID NO: 172125 - protein, 9 aa, Homo Sapiens
AQPDGKIRL

SEQ ID NO: 172126 - protein, 9 aa, Homo Sapiens
AQPETPVTL

SEQ ID NO: 172127 - protein, 9 aa, Homo Sapiens
ARPMRAIFL

SEQ ID NO: 172128 - protein, 9 aa, Homo Sapiens
ASPTQPIQL

SEQ ID NO: 172129 - protein, 9 aa, Homo Sapiens
ATPKAKIYL

SEQ ID NO: 172130 - protein, 9 aa, Homo Sapiens
ATPLKKVIL

SEQ ID NO: 172131 - protein, 9 aa, Homo Sapiens
AVPTIYTKL

SEQ ID NO: 172132 - protein, 9 aa, Homo Sapiens
AVVPGTLLL

SEQ ID NO: 172133 - protein, 9 aa, Homo Sapiens
EIIDNHITL

SEQ ID NO: 172134 - protein, 9 aa, Homo Sapiens
EIIKQKLTL

SEQ ID NO: 172135 - protein, 9 aa, Homo Sapiens
EIISKGIKL

SEQ ID NO: 172136 - protein, 9 aa, Homo Sapiens
EIVPNGITL

SEQ ID NO: 172137 - protein, 9 aa, Homo Sapiens
GFPEGSVEL

SEQ ID NO: 172138 - protein, 9 aa, Homo Sapiens
GKLPKGILL

SEQ ID NO: 172139 - protein, 9 aa, Homo Sapiens
GQPRDGLKL

SEQ ID NO: 172140 - protein, 9 aa, Homo Sapiens
GVPKTHLEL

SEQ ID NO: 172141 - protein, 9 aa, Homo Sapiens
HAPRIPVTL

SEQ ID NO: 172142 - protein, 9 aa, Homo Sapiens
HFPHKPIIL

SEQ ID NO: 172143 - protein, 9 aa, Homo Sapiens
HGIQGKFSL

SEQ ID NO: 172144 - protein, 9 aa, Homo Sapiens
HGPAAKPTL

SEQ ID NO: 172145 - protein, 9 aa, Homo Sapiens
HGPNHPLVL

SEQ ID NO: 172146 - protein, 9 aa, Homo Sapiens
HGVKDKPVL

SEQ ID NO: 172147 - protein, 9 aa, Homo Sapiens
HHPDYNNEL

SEQ ID NO: 172148 - protein, 9 aa, Homo Sapiens
HITPDNFEL

SEQ ID NO: 172149 - protein, 9 aa, Homo Sapiens
HIVVNKAEL

SEQ ID NO: 172150 - protein, 9 aa, Homo Sapiens
HLIEESVKL

SEQ ID NO: 172151 - protein, 9 aa, Homo Sapiens
HLPDVCVNL

SEQ ID NO: 172152 - protein, 9 aa, Homo Sapiens
HLPNTYVDL

SEQ ID NO: 172153 - protein, 9 aa, Homo Sapiens
HQPTTWVSF

SEQ ID NO: 172154 - protein, 9 aa, Homo Sapiens
HSPGDYILL

SEQ ID NO: 172155 - protein, 9 aa, Homo Sapiens
HSPPNKPKL

SEQ ID NO: 172156 - protein, 9 aa, Homo Sapiens
HVPAVKLLL

SEQ ID NO: 172157 - protein, 9 aa, Homo Sapiens
HVPEHAVVL

SEQ ID NO: 172158 - protein, 9 aa, Homo Sapiens
IHPADSVYL

SEQ ID NO: 172159 - protein, 9 aa, Homo Sapiens
IIAENKIRL

SEQ ID NO: 172160 - protein, 9 aa, Homo Sapiens
IINKDPTLL

SEQ ID NO: 172161 - protein, 9 aa, Homo Sapiens
IRPEHVLRL

SEQ ID NO: 172162 - protein, 9 aa, Homo Sapiens
ISPKEFVHL

SEQ ID NO: 172163 - protein, 9 aa, Homo Sapiens
ISPKHFVHL

SEQ ID NO: 172164 - protein, 9 aa, Homo Sapiens
IVPDGTLQL

SEQ ID NO: 172165 - protein, 9 aa, Homo Sapiens
IYPSIFHVL

SEQ ID NO: 172166 - protein, 9 aa, Homo Sapiens
KAPGFAQML

SEQ ID NO: 172167 - protein, 9 aa, Homo Sapiens
KAPGSTSNL

SEQ ID NO: 172168 - protein, 9 aa, Homo Sapiens
KAPLSKVRL

SEQ ID NO: 172169 - protein, 9 aa, Homo Sapiens
KAPPIPLKL

SEQ ID NO: 172170 - protein, 9 aa, Homo Sapiens
KAPVNTAEL

SEQ ID NO: 172171 - protein, 9 aa, Homo Sapiens
KAVGDGIVL

SEQ ID NO: 172172 - protein, 9 aa, Homo Sapiens
KEIEEKLRL

SEQ ID NO: 172173 - protein, 9 aa, Homo Sapiens
KFIDKQLEL

SEQ ID NO: 172174 - protein, 9 aa, Homo Sapiens
KFIPGKPVL

SEQ ID NO: 172175 - protein, 9 aa, Homo Sapiens
KFPAYERVL

SEQ ID NO: 172176 - protein, 9 aa, Homo Sapiens
KFPDSQNQL

SEQ ID NO: 172177 - protein, 9 aa, Homo Sapiens
KFPGIRPYL

SEQ ID NO: 172178 - protein, 9 aa, Homo Sapiens
KFPHESARL

SEQ ID NO: 172179 - protein, 9 aa, Homo Sapiens
KFPIVNAEL

SEQ ID NO: 172180 - protein, 9 aa, Homo Sapiens
KFPLMTLQL

SEQ ID NO: 172181 - protein, 9 aa, Homo Sapiens
KFPLTRPSL

SEQ ID NO: 172182 - protein, 9 aa, Homo Sapiens
KFPPKFVQL

SEQ ID NO: 172183 - protein, 9 aa, Homo Sapiens
KFPSEPNRL

SEQ ID NO: 172184 - protein, 9 aa, Homo Sapiens
KFPVKPADL

SEQ ID NO: 172185 - protein, 9 aa, Homo Sapiens
KFVNKSYLL

SEQ ID NO: 172186 - protein, 9 aa, Homo Sapiens
KFVVKKPEL

SEQ ID NO: 172187 - protein, 9 aa, Homo Sapiens
KGIGEFFRL

SEQ ID NO: 172188 - protein, 9 aa, Homo Sapiens
KGPDAASKL

SEQ ID NO: 172189 - protein, 9 aa, Homo Sapiens
KGPEDTAQL

SEQ ID NO: 172190 - protein, 9 aa, Homo Sapiens
KGPPAALTL

SEQ ID NO: 172191 - protein, 9 aa, Homo Sapiens
KHPATRTVL

SEQ ID NO: 172192 - protein, 9 aa, Homo Sapiens
KHPDASVNF

SEQ ID NO: 172193 - protein, 9 aa, Homo Sapiens
KHPDSSVNF

SEQ ID NO: 172194 - protein, 9 aa, Homo Sapiens
KHPKYCIEL

SEQ ID NO: 172195 - protein, 9 aa, Homo Sapiens
KIAEIKSLL

SEQ ID NO: 172196 - protein, 9 aa, Homo Sapiens
KIAGYVTHL

SEQ ID NO: 172197 - protein, 9 aa, Homo Sapiens
KIAIQKITL

SEQ ID NO: 172198 - protein, 9 aa, Homo Sapiens
KIAKPLSSL

SEQ ID NO: 172199 - protein, 9 aa, Homo Sapiens
KIAPNTPQL

SEQ ID NO: 172200 - protein, 9 aa, Homo Sapiens
KIAPYSVEI

SEQ ID NO: 172201 - protein, 9 aa, Homo Sapiens
KIFQVAQEL

SEQ ID NO: 172202 - protein, 9 aa, Homo Sapiens
KIGNIKKTL

SEQ ID NO: 172203 - protein, 9 aa, Homo Sapiens
KIHAHKVVL

SEQ ID NO: 172204 - protein, 9 aa, Homo Sapiens
KIHPMAYQL

SEQ ID NO: 172205 - protein, 9 aa, Homo Sapiens
KIIASSPEM

SEQ ID NO: 172206 - protein, 9 aa, Homo Sapiens
KIIDGLLVM

SEQ ID NO: 172207 - protein, 9 aa, Homo Sapiens
KIIEARLKM

SEQ ID NO: 172208 - protein, 9 aa, Homo Sapiens
KIIKEKQAF

SEQ ID NO: 172209 - protein, 9 aa, Homo Sapiens
KIIKKPMDL

SEQ ID NO: 172210 - protein, 9 aa, Homo Sapiens
KIIKNPMDL

SEQ ID NO: 172211 - protein, 9 aa, Homo Sapiens
KIISESAQM

SEQ ID NO: 172212 - protein, 9 aa, Homo Sapiens
KIITAKAVL

SEQ ID NO: 172213 - protein, 9 aa, Homo Sapiens
KIITEGTKL

SEQ ID NO: 172214 - protein, 9 aa, Homo Sapiens
KIIYKLIRL

SEQ ID NO: 172215 - protein, 9 aa, Homo Sapiens
KILAEAAKL

SEQ ID NO: 172216 - protein, 9 aa, Homo Sapiens
KILQERAVL

SEQ ID NO: 172217 - protein, 9 aa, Homo Sapiens
KINEEKCNL

SEQ ID NO: 172218 - protein, 9 aa, Homo Sapiens
KINKKRIAL

SEQ ID NO: 172219 - protein, 9 aa, Homo Sapiens
KINPETVNL

SEQ ID NO: 172220 - protein, 9 aa, Homo Sapiens
KIPAHRVVL

SEQ ID NO: 172221 - protein, 9 aa, Homo Sapiens
KIPALAVEM

SEQ ID NO: 172222 - protein, 9 aa, Homo Sapiens
KIPASAVEM

SEQ ID NO: 172223 - protein, 9 aa, Homo Sapiens
KIPDTKGCL

SEQ ID NO: 172224 - protein, 9 aa, Homo Sapiens
KIPILGVHL

SEQ ID NO: 172225 - protein, 9 aa, Homo Sapiens
KIPKATPEL

SEQ ID NO: 172226 - protein, 9 aa, Homo Sapiens
KIPKAYIRF

SEQ ID NO: 172227 - protein, 9 aa, Homo Sapiens
KIPLVKVDM

SEQ ID NO: 172228 - protein, 9 aa, Homo Sapiens
KIPNFCVLL

SEQ ID NO: 172229 - protein, 9 aa, Homo Sapiens
KIPQVLVKL

SEQ ID NO: 172230 - protein, 9 aa, Homo Sapiens
KIPSYITDL

SEQ ID NO: 172231 - protein, 9 aa, Homo Sapiens
KIPTAKPEL

SEQ ID NO: 172232 - protein, 9 aa, Homo Sapiens
KIPTCKITL

SEQ ID NO: 172233 - protein, 9 aa, Homo Sapiens
KISKEKSFL

SEQ ID NO: 172234 - protein, 9 aa, Homo Sapiens
KISKSVTTL

SEQ ID NO: 172235 - protein, 9 aa, Homo Sapiens
KIVGNKWEA

SEQ ID NO: 172236 - protein, 9 aa, Homo Sapiens
KIVKPGMKL

SEQ ID NO: 172237 - protein, 9 aa, Homo Sapiens
KIVSGKVRF

SEQ ID NO: 172238 - protein, 9 aa, Homo Sapiens
KKIPSPVKL

SEQ ID NO: 172239 - protein, 9 aa, Homo Sapiens
KKNPDSLEL

SEQ ID NO: 172240 - protein, 9 aa, Homo Sapiens
KKPEKPLIL

SEQ ID NO: 172241 - protein, 9 aa, Homo Sapiens
KKPPPVPAL

SEQ ID NO: 172242 - protein, 9 aa, Homo Sapiens
KKVKFQAKL

SEQ ID NO: 172243 - protein, 9 aa, Homo Sapiens
KLAPIPVEL

SEQ ID NO: 172244 - protein, 9 aa, Homo Sapiens
KLAPPLVTL

SEQ ID NO: 172245 - protein, 9 aa, Homo Sapiens
KLIFPYVEL

SEQ ID NO: 172246 - protein, 9 aa, Homo Sapiens
KLIHEKHLL

SEQ ID NO: 172247 - protein, 9 aa, Homo Sapiens
KLIKDGLII

SEQ ID NO: 172248 - protein, 9 aa, Homo Sapiens
KLILKGVIL

SEQ ID NO: 172249 - protein, 9 aa, Homo Sapiens
KLIPNAIQI

SEQ ID NO: 172250 - protein, 9 aa, Homo Sapiens
KLLRDRIVL

SEQ ID NO: 172251 - protein, 9 aa, Homo Sapiens
KLNATNIEL

SEQ ID NO: 172252 - protein, 9 aa, Homo Sapiens
KLNIPKVLL

SEQ ID NO: 172253 - protein, 9 aa, Homo Sapiens
KLPAFSPLM

SEQ ID NO: 172254 - protein, 9 aa, Homo Sapiens
KLPAGKNVL

SEQ ID NO: 172255 - protein, 9 aa, Homo Sapiens
KLPANHPLL

SEQ ID NO: 172256 - protein, 9 aa, Homo Sapiens
KLPAPLPGL

SEQ ID NO: 172257 - protein, 9 aa, Homo Sapiens
KLPDCSLRL

SEQ ID NO: 172258 - protein, 9 aa, Homo Sapiens
KLPDGTWNL

SEQ ID NO: 172259 - protein, 9 aa, Homo Sapiens
KLPDKTVEF

SEQ ID NO: 172260 - protein, 9 aa, Homo Sapiens
KLPEDIMKL

SEQ ID NO: 172261 - protein, 9 aa, Homo Sapiens
KLPKEREEL

SEQ ID NO: 172262 - protein, 9 aa, Homo Sapiens
KLPKKHMQL

SEQ ID NO: 172263 - protein, 9 aa, Homo Sapiens
KLPLMKINF

SEQ ID NO: 172264 - protein, 9 aa, Homo Sapiens
KLPPKRPEL

SEQ ID NO: 172265 - protein, 9 aa, Homo Sapiens
KLPPLPLTL

SEQ ID NO: 172266 - protein, 9 aa, Homo Sapiens
KLPQFCAHL

SEQ ID NO: 172267 - protein, 9 aa, Homo Sapiens
KLPQQREKL

SEQ ID NO: 172268 - protein, 9 aa, Homo Sapiens
KLPQRTAKL

SEQ ID NO: 172269 - protein, 9 aa, Homo Sapiens
KLPSGKLQV

SEQ ID NO: 172270 - protein, 9 aa, Homo Sapiens
KLPSPAHHL

SEQ ID NO: 172271 - protein, 9 aa, Homo Sapiens
KLPSVPTKL

SEQ ID NO: 172272 - protein, 9 aa, Homo Sapiens
KLPTEWNVL

SEQ ID NO: 172273 - protein, 9 aa, Homo Sapiens
KLSVTKPVL

SEQ ID NO: 172274 - protein, 9 aa, Homo Sapiens
KLTELKAVL

SEQ ID NO: 172275 - protein, 9 aa, Homo Sapiens
KLVPRKDLL

SEQ ID NO: 172276 - protein, 9 aa, Homo Sapiens
KLVRDAFAL

SEQ ID NO: 172277 - protein, 9 aa, Homo Sapiens
KMAEIKVKL

SEQ ID NO: 172278 - protein, 9 aa, Homo Sapiens
KMIGLKAKL

SEQ ID NO: 172279 - protein, 9 aa, Homo Sapiens
KMPACNIML

SEQ ID NO: 172280 - protein, 9 aa, Homo Sapiens
KMPDGSVAL

SEQ ID NO: 172281 - protein, 9 aa, Homo Sapiens
KMPFDANKL

SEQ ID NO: 172282 - protein, 9 aa, Homo Sapiens
KMPQYQKEL

SEQ ID NO: 172283 - protein, 9 aa, Homo Sapiens
KMSHKRIML

SEQ ID NO: 172284 - protein, 9 aa, Homo Sapiens
KMVRQILEL

SEQ ID NO: 172285 - protein, 9 aa, Homo Sapiens
KMVVDAVMM

SEQ ID NO: 172286 - protein, 9 aa, Homo Sapiens
KNIPMTLEL

SEQ ID NO: 172287 - protein, 9 aa, Homo Sapiens
KNPAFKPVL

SEQ ID NO: 172288 - protein, 9 aa, Homo Sapiens
KNPQKFTIL

SEQ ID NO: 172289 - protein, 9 aa, Homo Sapiens
KNTLNKVVL

SEQ ID NO: 172290 - protein, 9 aa, Homo Sapiens
KNTYNKPKL

SEQ ID NO: 172291 - protein, 9 aa, Homo Sapiens
KNVAKTIQL

SEQ ID NO: 172292 - protein, 9 aa, Homo Sapiens
KNVEKRALL

SEQ ID NO: 172293 - protein, 9 aa, Homo Sapiens
KNVGGHVRL

SEQ ID NO: 172294 - protein, 9 aa, Homo Sapiens
KNVTEHLKL

SEQ ID NO: 172295 - protein, 9 aa, Homo Sapiens
KQALDKLKL

SEQ ID NO: 172296 - protein, 9 aa, Homo Sapiens
KQAQEKFEL

SEQ ID NO: 172297 - protein, 9 aa, Homo Sapiens
KQIAEAVRL

SEQ ID NO: 172298 - protein, 9 aa, Homo Sapiens
KQPAEHLQL

SEQ ID NO: 172299 - protein, 9 aa, Homo Sapiens
KQPEEGLRL

SEQ ID NO: 172300 - protein, 9 aa, Homo Sapiens
KQPLTATTL

SEQ ID NO: 172301 - protein, 9 aa, Homo Sapiens
KQPPPSIRL

SEQ ID NO: 172302 - protein, 9 aa, Homo Sapiens
KRPGESLRI

SEQ ID NO: 172303 - protein, 9 aa, Homo Sapiens
KRPVGGFLL

SEQ ID NO: 172304 - protein, 9 aa, Homo Sapiens
KSPAITATL

SEQ ID NO: 172305 - protein, 9 aa, Homo Sapiens
KSPATSCEL

SEQ ID NO: 172306 - protein, 9 aa, Homo Sapiens
KSPGFGLSL

SEQ ID NO: 172307 - protein, 9 aa, Homo Sapiens
KSPGTANVL

SEQ ID NO: 172308 - protein, 9 aa, Homo Sapiens
KSPNQSLRL

SEQ ID NO: 172309 - protein, 9 aa, Homo Sapiens
KSPQKSTVL

SEQ ID NO: 172310 - protein, 9 aa, Homo Sapiens
KSPSSKPSL

SEQ ID NO: 172311 - protein, 9 aa, Homo Sapiens
KSSDFYITL

SEQ ID NO: 172312 - protein, 9 aa, Homo Sapiens
KSSVKAVIL

SEQ ID NO: 172313 - protein, 9 aa, Homo Sapiens
KSVKVKIKL

SEQ ID NO: 172314 - protein, 9 aa, Homo Sapiens
KTADKKLLL

SEQ ID NO: 172315 - protein, 9 aa, Homo Sapiens
KTADKKLNL

SEQ ID NO: 172316 - protein, 9 aa, Homo Sapiens
KTAQNHPML

SEQ ID NO: 172317 - protein, 9 aa, Homo Sapiens
KTIDGHINL

SEQ ID NO: 172318 - protein, 9 aa, Homo Sapiens
KTIHKYVHL

SEQ ID NO: 172319 - protein, 9 aa, Homo Sapiens
KTILDKVKL

SEQ ID NO: 172320 - protein, 9 aa, Homo Sapiens
KTLQKKCYL

SEQ ID NO: 172321 - protein, 9 aa, Homo Sapiens
KTPAEFAKL

SEQ ID NO: 172322 - protein, 9 aa, Homo Sapiens
KTPDSRPSL

SEQ ID NO: 172323 - protein, 9 aa, Homo Sapiens
KTPESKPTI

SEQ ID NO: 172324 - protein, 9 aa, Homo Sapiens
KTPESNIKM

SEQ ID NO: 172325 - protein, 9 aa, Homo Sapiens
KTPKCALKM

SEQ ID NO: 172326 - protein, 9 aa, Homo Sapiens
KTPLKKFLL

SEQ ID NO: 172327 - protein, 9 aa, Homo Sapiens
KTPMENIGL

SEQ ID NO: 172328 - protein, 9 aa, Homo Sapiens
KTPNFSTLL

SEQ ID NO: 172329 - protein, 9 aa, Homo Sapiens
KTPPRVLTL

SEQ ID NO: 172330 - protein, 9 aa, Homo Sapiens
KTPQYKASL

SEQ ID NO: 172331 - protein, 9 aa, Homo Sapiens
KTSTQKFFL

SEQ ID NO: 172332 - protein, 9 aa, Homo Sapiens
KTTNAKVAL

SEQ ID NO: 172333 - protein, 9 aa, Homo Sapiens
KTVDQHMKL

SEQ ID NO: 172334 - protein, 9 aa, Homo Sapiens
KTVEQHLRL

SEQ ID NO: 172335 - protein, 9 aa, Homo Sapiens
KTVIGKARL

SEQ ID NO: 172336 - protein, 9 aa, Homo Sapiens
KTVNERITL

SEQ ID NO: 172337 - protein, 9 aa, Homo Sapiens
KVADHRVKL

SEQ ID NO: 172338 - protein, 9 aa, Homo Sapiens
KVADSKTLL

SEQ ID NO: 172339 - protein, 9 aa, Homo Sapiens
KVIAQQVQL

SEQ ID NO: 172340 - protein, 9 aa, Homo Sapiens
KVIDRKVEL

SEQ ID NO: 172341 - protein, 9 aa, Homo Sapiens
KVIEEAVYF

SEQ ID NO: 172342 - protein, 9 aa, Homo Sapiens
KVIEEKHQL

SEQ ID NO: 172343 - protein, 9 aa, Homo Sapiens
KVIEINPYL

SEQ ID NO: 172344 - protein, 9 aa, Homo Sapiens
KVIKSNIRL

SEQ ID NO: 172345 - protein, 9 aa, Homo Sapiens
KVISSNTSL

SEQ ID NO: 172346 - protein, 9 aa, Homo Sapiens
KVPAELICL

SEQ ID NO: 172347 - protein, 9 aa, Homo Sapiens
KVPAESPTL

SEQ ID NO: 172348 - protein, 9 aa, Homo Sapiens
KVPEKKLKL

SEQ ID NO: 172349 - protein, 9 aa, Homo Sapiens
KVPHDPVAL

SEQ ID NO: 172350 - protein, 9 aa, Homo Sapiens
KVPKERLAL

SEQ ID NO: 172351 - protein, 9 aa, Homo Sapiens
KVPLQYNEL

SEQ ID NO: 172352 - protein, 9 aa, Homo Sapiens
KVPNQYTHL

SEQ ID NO: 172353 - protein, 9 aa, Homo Sapiens
KVPSTPVHL

SEQ ID NO: 172354 - protein, 9 aa, Homo Sapiens
KVPTFVRML

SEQ ID NO: 172355 - protein, 9 aa, Homo Sapiens
KVPTTKSTL

SEQ ID NO: 172356 - protein, 9 aa, Homo Sapiens
KVPVHVIRM

SEQ ID NO: 172357 - protein, 9 aa, Homo Sapiens
KVVAKGLGL

SEQ ID NO: 172358 - protein, 9 aa, Homo Sapiens
KVVDDTLEL

SEQ ID NO: 172359 - protein, 9 aa, Homo Sapiens
KVVGKDYLL

SEQ ID NO: 172360 - protein, 9 aa, Homo Sapiens
KVVKLHTKL

SEQ ID NO: 172361 - protein, 9 aa, Homo Sapiens
KVVSQYHEL

SEQ ID NO: 172362 - protein, 9 aa, Homo Sapiens
KVVSQYSSL

SEQ ID NO: 172363 - protein, 9 aa, Homo Sapiens
KVVTRHPDL

SEQ ID NO: 172364 - protein, 9 aa, Homo Sapiens
KVVVHPLVL

SEQ ID NO: 172365 - protein, 9 aa, Homo Sapiens
KWPETPLLL

SEQ ID NO: 172366 - protein, 9 aa, Homo Sapiens
KYIDKTIRV

SEQ ID NO: 172367 - protein, 9 aa, Homo Sapiens
KYIGENLQL

SEQ ID NO: 172368 - protein, 9 aa, Homo Sapiens
KYIHSANVL

SEQ ID NO: 172369 - protein, 9 aa, Homo Sapiens
KYPASTVQI

SEQ ID NO: 172370 - protein, 9 aa, Homo Sapiens
KYPDNQVKL

SEQ ID NO: 172371 - protein, 9 aa, Homo Sapiens
KYPENFFLL

SEQ ID NO: 172372 - protein, 9 aa, Homo Sapiens
KYPFIPLLL

SEQ ID NO: 172373 - protein, 9 aa, Homo Sapiens
KYPHYFPLL

SEQ ID NO: 172374 - protein, 9 aa, Homo Sapiens
KYPHYFPVM

SEQ ID NO: 172375 - protein, 9 aa, Homo Sapiens
KYPPSATTL

SEQ ID NO: 172376 - protein, 9 aa, Homo Sapiens
KYPQAIYTL

SEQ ID NO: 172377 - protein, 9 aa, Homo Sapiens
KYPTLPGKL

SEQ ID NO: 172378 - protein, 9 aa, Homo Sapiens
KYPVGVHFL

SEQ ID NO: 172379 - protein, 9 aa, Homo Sapiens
KYPVHIYRL

SEQ ID NO: 172380 - protein, 9 aa, Homo Sapiens
KYPYVAVML

SEQ ID NO: 172381 - protein, 9 aa, Homo Sapiens
KYVQDNIQL

SEQ ID NO: 172382 - protein, 9 aa, Homo Sapiens
LAPQNKPEL

SEQ ID NO: 172383 - protein, 9 aa, Homo Sapiens
LIIGKKFKL

SEQ ID NO: 172384 - protein, 9 aa, Homo Sapiens
LIVDRPVTL

SEQ ID NO: 172385 - protein, 9 aa, Homo Sapiens
LLPNGKLIL

SEQ ID NO: 172386 - protein, 9 aa, Homo Sapiens
LQINDKIAL

SEQ ID NO: 172387 - protein, 9 aa, Homo Sapiens
LQPKQPLRL

SEQ ID NO: 172388 - protein, 9 aa, Homo Sapiens
LRRPLLHEL

SEQ ID NO: 172389 - protein, 9 aa, Homo Sapiens
LSLLKSHPK

SEQ ID NO: 172390 - protein, 9 aa, Homo Sapiens
LSPHKYYFL

SEQ ID NO: 172391 - protein, 9 aa, Homo Sapiens
LSPKEFYEL

SEQ ID NO: 172392 - protein, 9 aa, Homo Sapiens
LSPKSYYEL

SEQ ID NO: 172393 - protein, 9 aa, Homo Sapiens
LYPDHFHLL

SEQ ID NO: 172394 - protein, 9 aa, Homo Sapiens
LYPSGTLKL

SEQ ID NO: 172395 - protein, 9 aa, Homo Sapiens
MAPRTLFLL

SEQ ID NO: 172396 - protein, 9 aa, Homo Sapiens
MFPEMSIHL

SEQ ID NO: 172397 - protein, 9 aa, Homo Sapiens
MLPGLALLL

SEQ ID NO: 172398 - protein, 9 aa, Homo Sapiens
MLPPKKFVL

SEQ ID NO: 172399 - protein, 9 aa, Homo Sapiens
MQPFNYVTL

SEQ ID NO: 172400 - protein, 9 aa, Homo Sapiens
MQPTHPIRL

SEQ ID NO: 172401 - protein, 9 aa, Homo Sapiens
MRPRKAFLL

SEQ ID NO: 172402 - protein, 9 aa, Homo Sapiens
MSPNSYIKL

SEQ ID NO: 172403 - protein, 9 aa, Homo Sapiens
NIIAKKIVL

SEQ ID NO: 172404 - protein, 9 aa, Homo Sapiens
NIPAGKPSL

SEQ ID NO: 172405 - protein, 9 aa, Homo Sapiens
NIPEKKLIL

SEQ ID NO: 172406 - protein, 9 aa, Homo Sapiens
NQVKGKPDL

SEQ ID NO: 172407 - protein, 9 aa, Homo Sapiens
NYPDEFTKL

SEQ ID NO: 172408 - protein, 9 aa, Homo Sapiens
PLAPAPVFI

SEQ ID NO: 172409 - protein, 9 aa, Homo Sapiens
QAPKDSFAL

SEQ ID NO: 172410 - protein, 9 aa, Homo Sapiens
QFPGGSIDL

SEQ ID NO: 172411 - protein, 9 aa, Homo Sapiens
QFVKDSIRL

SEQ ID NO: 172412 - protein, 9 aa, Homo Sapiens
QGPPERVVL

SEQ ID NO: 172413 - protein, 9 aa, Homo Sapiens
QIIHQKPKL

SEQ ID NO: 172414 - protein, 9 aa, Homo Sapiens
QIPENGLTL

SEQ ID NO: 172415 - protein, 9 aa, Homo Sapiens
QIVKEKVHL

SEQ ID NO: 172416 - protein, 9 aa, Homo Sapiens
QKPSYYVRL

SEQ ID NO: 172417 - protein, 9 aa, Homo Sapiens
QLIAKKIKL

SEQ ID NO: 172418 - protein, 9 aa, Homo Sapiens
QLIEKRLNL

SEQ ID NO: 172419 - protein, 9 aa, Homo Sapiens
QLPLVKPYL

SEQ ID NO: 172420 - protein, 9 aa, Homo Sapiens
QLPYNGVVL

SEQ ID NO: 172421 - protein, 9 aa, Homo Sapiens
QMPKVHIEF

SEQ ID NO: 172422 - protein, 9 aa, Homo Sapiens
QSINKKLEL

SEQ ID NO: 172423 - protein, 9 aa, Homo Sapiens
QVIKEKLRL

SEQ ID NO: 172424 - protein, 9 aa, Homo Sapiens
RAIQKKIDL

SEQ ID NO: 172425 - protein, 9 aa, Homo Sapiens
RAPAEFIRF

SEQ ID NO: 172426 - protein, 9 aa, Homo Sapiens
RAPAQNPEL

SEQ ID NO: 172427 - protein, 9 aa, Homo Sapiens
RCAPASIRL

SEQ ID NO: 172428 - protein, 9 aa, Homo Sapiens
RCIKETLRL

SEQ ID NO: 172429 - protein, 9 aa, Homo Sapiens
RFPDENFKL

SEQ ID NO: 172430 - protein, 9 aa, Homo Sapiens
RFPDENFTL

SEQ ID NO: 172431 - protein, 9 aa, Homo Sapiens
RFPDGTNGL

SEQ ID NO: 172432 - protein, 9 aa, Homo Sapiens
RFPFSRPEL

SEQ ID NO: 172433 - protein, 9 aa, Homo Sapiens
RFPHHDNEL

SEQ ID NO: 172434 - protein, 9 aa, Homo Sapiens
RFPKAPSKL

SEQ ID NO: 172435 - protein, 9 aa, Homo Sapiens
RFPNFTNQL

SEQ ID NO: 172436 - protein, 9 aa, Homo Sapiens
RFPQHYKSL

SEQ ID NO: 172437 - protein, 9 aa, Homo Sapiens
RFPTQHQRL

SEQ ID NO: 172438 - protein, 9 aa, Homo Sapiens
RGPAHKLAL

SEQ ID NO: 172439 - protein, 9 aa, Homo Sapiens
RGPGWRPLL

SEQ ID NO: 172440 - protein, 9 aa, Homo Sapiens
RGPLAKIWL

SEQ ID NO: 172441 - protein, 9 aa, Homo Sapiens
RGPLKCVKL

SEQ ID NO: 172442 - protein, 9 aa, Homo Sapiens
RGPPARVTL

SEQ ID NO: 172443 - protein, 9 aa, Homo Sapiens
RGPPQRPKL

SEQ ID NO: 172444 - protein, 9 aa, Homo Sapiens
RGPRDCVVL

SEQ ID NO: 172445 - protein, 9 aa, Homo Sapiens
RGVDNKIRL

SEQ ID NO: 172446 - protein, 9 aa, Homo Sapiens
RHPAATAQL

SEQ ID NO: 172447 - protein, 9 aa, Homo Sapiens
RHPASSVAL

SEQ ID NO: 172448 - protein, 9 aa, Homo Sapiens
RHPKYKTEL

SEQ ID NO: 172449 - protein, 9 aa, Homo Sapiens
RHPREVVIL

SEQ ID NO: 172450 - protein, 9 aa, Homo Sapiens
RHPSQTVEL

SEQ ID NO: 172451 - protein, 9 aa, Homo Sapiens
RHPSTNSLL

SEQ ID NO: 172452 - protein, 9 aa, Homo Sapiens
RIAEFTTNL

SEQ ID NO: 172453 - protein, 9 aa, Homo Sapiens
RIAGEASRL

SEQ ID NO: 172454 - protein, 9 aa, Homo Sapiens
RIAPAFSSM

SEQ ID NO: 172455 - protein, 9 aa, Homo Sapiens
RIAPRPYRL

SEQ ID NO: 172456 - protein, 9 aa, Homo Sapiens
RIAQLRFLL

SEQ ID NO: 172457 - protein, 9 aa, Homo Sapiens
RIEKNPARL

SEQ ID NO: 172458 - protein, 9 aa, Homo Sapiens
RIHDKAVAL

SEQ ID NO: 172459 - protein, 9 aa, Homo Sapiens
RIIAHAQLL

SEQ ID NO: 172460 - protein, 9 aa, Homo Sapiens
RIIKETQRL

SEQ ID NO: 172461 - protein, 9 aa, Homo Sapiens
RIIPRHLQL

SEQ ID NO: 172462 - protein, 9 aa, Homo Sapiens
RIIQDRVSL

SEQ ID NO: 172463 - protein, 9 aa, Homo Sapiens
RIIRKVVKL

SEQ ID NO: 172464 - protein, 9 aa, Homo Sapiens
RINHYQQRL

SEQ ID NO: 172465 - protein, 9 aa, Homo Sapiens
RIPAHRFVL

SEQ ID NO: 172466 - protein, 9 aa, Homo Sapiens
RIPATPVVI

SEQ ID NO: 172467 - protein, 9 aa, Homo Sapiens
RIPDQLGYL

SEQ ID NO: 172468 - protein, 9 aa, Homo Sapiens
RIPDRPYSL

SEQ ID NO: 172469 - protein, 9 aa, Homo Sapiens
RIPKEQGVL

SEQ ID NO: 172470 - protein, 9 aa, Homo Sapiens
RIPNRGIDL

SEQ ID NO: 172471 - protein, 9 aa, Homo Sapiens
RIPPVAVRL

SEQ ID NO: 172472 - protein, 9 aa, Homo Sapiens
RIPQEKCIL

SEQ ID NO: 172473 - protein, 9 aa, Homo Sapiens
RIPSFVTEL

SEQ ID NO: 172474 - protein, 9 aa, Homo Sapiens
RISNPPILL

SEQ ID NO: 172475 - protein, 9 aa, Homo Sapiens
RITPRHLQL

SEQ ID NO: 172476 - protein, 9 aa, Homo Sapiens
RITTEKMLL

SEQ ID NO: 172477 - protein, 9 aa, Homo Sapiens
RIVAHAVEV

SEQ ID NO: 172478 - protein, 9 aa, Homo Sapiens
RIVDVRPTL

SEQ ID NO: 172479 - protein, 9 aa, Homo Sapiens
RIVPEPVQF

SEQ ID NO: 172480 - protein, 9 aa, Homo Sapiens
RIVVEHIIM

SEQ ID NO: 172481 - protein, 9 aa, Homo Sapiens
RKIKGVIEL

SEQ ID NO: 172482 - protein, 9 aa, Homo Sapiens
RKPDNYMTL

SEQ ID NO: 172483 - protein, 9 aa, Homo Sapiens
RKPPEVVRL

SEQ ID NO: 172484 - protein, 9 aa, Homo Sapiens
RKPPTSIRL

SEQ ID NO: 172485 - protein, 9 aa, Homo Sapiens
RLAQEAVTL

SEQ ID NO: 172486 - protein, 9 aa, Homo Sapiens
RLHLPPVRL

SEQ ID NO: 172487 - protein, 9 aa, Homo Sapiens
RLIAQRYLL

SEQ ID NO: 172488 - protein, 9 aa, Homo Sapiens
RLIERKSDL

SEQ ID NO: 172489 - protein, 9 aa, Homo Sapiens
RLINQVLEL

SEQ ID NO: 172490 - protein, 9 aa, Homo Sapiens
RLLKSKLYL

SEQ ID NO: 172491 - protein, 9 aa, Homo Sapiens
RLPAWQPIL

SEQ ID NO: 172492 - protein, 9 aa, Homo Sapiens
RLPDEKVEL

SEQ ID NO: 172493 - protein, 9 aa, Homo Sapiens
RLPDGRVVL

SEQ ID NO: 172494 - protein, 9 aa, Homo Sapiens
RLPDQFSKL

SEQ ID NO: 172495 - protein, 9 aa, Homo Sapiens
RLPEIYIQL

SEQ ID NO: 172496 - protein, 9 aa, Homo Sapiens
RLPHHSAIL

SEQ ID NO: 172497 - protein, 9 aa, Homo Sapiens
RLPKDFVDL

SEQ ID NO: 172498 - protein, 9 aa, Homo Sapiens
RLPPPFPGL

SEQ ID NO: 172499 - protein, 9 aa, Homo Sapiens
RLPPYSSQL

SEQ ID NO: 172500 - protein, 9 aa, Homo Sapiens
RLPQYQTDL

SEQ ID NO: 172501 - protein, 9 aa, Homo Sapiens
RLPSGKVGF

SEQ ID NO: 172502 - protein, 9 aa, Homo Sapiens
RLVAMAVKL

SEQ ID NO: 172503 - protein, 9 aa, Homo Sapiens
RLVESKVEL

SEQ ID NO: 172504 - protein, 9 aa, Homo Sapiens
RLVKEYTVL

SEQ ID NO: 172505 - protein, 9 aa, Homo Sapiens
RMAGRALEL

SEQ ID NO: 172506 - protein, 9 aa, Homo Sapiens
RMIKPRIVL

SEQ ID NO: 172507 - protein, 9 aa, Homo Sapiens
RMPAEIVVL

SEQ ID NO: 172508 - protein, 9 aa, Homo Sapiens
RMPCHKPYL

SEQ ID NO: 172509 - protein, 9 aa, Homo Sapiens
RMPDGPVAL

SEQ ID NO: 172510 - protein, 9 aa, Homo Sapiens
RMPRCGIRL

SEQ ID NO: 172511 - protein, 9 aa, Homo Sapiens
RMVASKMEL

SEQ ID NO: 172512 - protein, 9 aa, Homo Sapiens
RNIVKKFLM

SEQ ID NO: 172513 - protein, 9 aa, Homo Sapiens
RNPKNYLSL

SEQ ID NO: 172514 - protein, 9 aa, Homo Sapiens
RNPQSYLYL

SEQ ID NO: 172515 - protein, 9 aa, Homo Sapiens
RQIKDRVTM

SEQ ID NO: 172516 - protein, 9 aa, Homo Sapiens
RQIPWKLGL

SEQ ID NO: 172517 - protein, 9 aa, Homo Sapiens
RQPDLVLRL

SEQ ID NO: 172518 - protein, 9 aa, Homo Sapiens
RQPDTPTEL

SEQ ID NO: 172519 - protein, 9 aa, Homo Sapiens
RQPEFRAVL

SEQ ID NO: 172520 - protein, 9 aa, Homo Sapiens
RQPNPPLIL

SEQ ID NO: 172521 - protein, 9 aa, Homo Sapiens
RQPPESLKL

SEQ ID NO: 172522 - protein, 9 aa, Homo Sapiens
RQPPPRPFL

SEQ ID NO: 172523 - protein, 9 aa, Homo Sapiens
RQPYAVSEL

SEQ ID NO: 172524 - protein, 9 aa, Homo Sapiens
RQVDSHVEL

SEQ ID NO: 172525 - protein, 9 aa, Homo Sapiens
RRIEVNVEL

SEQ ID NO: 172526 - protein, 9 aa, Homo Sapiens
RRPNCGIRL

SEQ ID NO: 172527 - protein, 9 aa, Homo Sapiens
RRPYVRVEL

SEQ ID NO: 172528 - protein, 9 aa, Homo Sapiens
RSIEQKYKL

SEQ ID NO: 172529 - protein, 9 aa, Homo Sapiens
RSPAKRLQL

SEQ ID NO: 172530 - protein, 9 aa, Homo Sapiens
RSPDRNLLL

SEQ ID NO: 172531 - protein, 9 aa, Homo Sapiens
RSPEEWPNL

SEQ ID NO: 172532 - protein, 9 aa, Homo Sapiens
RSPFSFVYL

SEQ ID NO: 172533 - protein, 9 aa, Homo Sapiens
RSPGRAYAL

SEQ ID NO: 172534 - protein, 9 aa, Homo Sapiens
RSPMHRVTL

SEQ ID NO: 172535 - protein, 9 aa, Homo Sapiens
RSPPIKPLL

SEQ ID NO: 172536 - protein, 9 aa, Homo Sapiens
RSPPRALVL

SEQ ID NO: 172537 - protein, 9 aa, Homo Sapiens
RSPSKNIYL

SEQ ID NO: 172538 - protein, 9 aa, Homo Sapiens
RSPTAWHRL

SEQ ID NO: 172539 - protein, 9 aa, Homo Sapiens
RSPTKAPHL

SEQ ID NO: 172540 - protein, 9 aa, Homo Sapiens
RSPVTKIML

SEQ ID NO: 172541 - protein, 9 aa, Homo Sapiens
RSPVVHSVL

SEQ ID NO: 172542 - protein, 9 aa, Homo Sapiens
RSPVYLTVL

SEQ ID NO: 172543 - protein, 9 aa, Homo Sapiens
RSVKVKIKL

SEQ ID NO: 172544 - protein, 9 aa, Homo Sapiens
RTCAVHITL

SEQ ID NO: 172545 - protein, 9 aa, Homo Sapiens
RTIAKRLVL

SEQ ID NO: 172546 - protein, 9 aa, Homo Sapiens
RTIPGKQQL

SEQ ID NO: 172547 - protein, 9 aa, Homo Sapiens
RTPSGKLRL

SEQ ID NO: 172548 - protein, 9 aa, Homo Sapiens
RTPYHVNLL

SEQ ID NO: 172549 - protein, 9 aa, Homo Sapiens
RTVDARLKL

SEQ ID NO: 172550 - protein, 9 aa, Homo Sapiens
RVAIKKIVL

SEQ ID NO: 172551 - protein, 9 aa, Homo Sapiens
RVCDYHTKL

SEQ ID NO: 172552 - protein, 9 aa, Homo Sapiens
RVIDYILDL

SEQ ID NO: 172553 - protein, 9 aa, Homo Sapiens
RVIKNSIRL

SEQ ID NO: 172554 - protein, 9 aa, Homo Sapiens
RVPAHAVVV

SEQ ID NO: 172555 - protein, 9 aa, Homo Sapiens
RVPAHRNLL

SEQ ID NO: 172556 - protein, 9 aa, Homo Sapiens
RVPAKSTLL

SEQ ID NO: 172557 - protein, 9 aa, Homo Sapiens
RVPIAKILL

SEQ ID NO: 172558 - protein, 9 aa, Homo Sapiens
RVPKDRPSL

SEQ ID NO: 172559 - protein, 9 aa, Homo Sapiens
RVPKSKLEV

SEQ ID NO: 172560 - protein, 9 aa, Homo Sapiens
RVPQEAVKL

SEQ ID NO: 172561 - protein, 9 aa, Homo Sapiens
RVPSPKVVL

SEQ ID NO: 172562 - protein, 9 aa, Homo Sapiens
RVPTASYDL

SEQ ID NO: 172563 - protein, 9 aa, Homo Sapiens
RVSSSKISL

SEQ ID NO: 172564 - protein, 9 aa, Homo Sapiens
RVTDRNITL

SEQ ID NO: 172565 - protein, 9 aa, Homo Sapiens
RVVLKRVLL

SEQ ID NO: 172566 - protein, 9 aa, Homo Sapiens
RVVPVRLDL

SEQ ID NO: 172567 - protein, 9 aa, Homo Sapiens
RYPCFFNTL

SEQ ID NO: 172568 - protein, 9 aa, Homo Sapiens
RYPDPLIKV

SEQ ID NO: 172569 - protein, 9 aa, Homo Sapiens
RYPDSHQLF

SEQ ID NO: 172570 - protein, 9 aa, Homo Sapiens
RYPEGGQIL

SEQ ID NO: 172571 - protein, 9 aa, Homo Sapiens
RYPPAANEL

SEQ ID NO: 172572 - protein, 9 aa, Homo Sapiens
RYPRESNKL

SEQ ID NO: 172573 - protein, 9 aa, Homo Sapiens
RYPTSIASL

SEQ ID NO: 172574 - protein, 9 aa, Homo Sapiens
RYPTTFVMV

SEQ ID NO: 172575 - protein, 9 aa, Homo Sapiens
SAPAKKIKL

SEQ ID NO: 172576 - protein, 9 aa, Homo Sapiens
SFPCHQTKL

SEQ ID NO: 172577 - protein, 9 aa, Homo Sapiens
SFPEKKPRL

SEQ ID NO: 172578 - protein, 9 aa, Homo Sapiens
SFPLVTVHL

SEQ ID NO: 172579 - protein, 9 aa, Homo Sapiens
SFPPPGVKL

SEQ ID NO: 172580 - protein, 9 aa, Homo Sapiens
SFPSEPVKL

SEQ ID NO: 172581 - protein, 9 aa, Homo Sapiens
SGPKSKLKL

SEQ ID NO: 172582 - protein, 9 aa, Homo Sapiens
SIPALTATL

SEQ ID NO: 172583 - protein, 9 aa, Homo Sapiens
SIPKDKQML

SEQ ID NO: 172584 - protein, 9 aa, Homo Sapiens
SIPTKALEL

SEQ ID NO: 172585 - protein, 9 aa, Homo Sapiens
SITKNTAKL

SEQ ID NO: 172586 - protein, 9 aa, Homo Sapiens
SIVDYKPNL

SEQ ID NO: 172587 - protein, 9 aa, Homo Sapiens
SKIKGKPVL

SEQ ID NO: 172588 - protein, 9 aa, Homo Sapiens
SLIGEKVCL

SEQ ID NO: 172589 - protein, 9 aa, Homo Sapiens
SLIKHKIML

SEQ ID NO: 172590 - protein, 9 aa, Homo Sapiens
SLITNKVIM

SEQ ID NO: 172591 - protein, 9 aa, Homo Sapiens
SLIVGGVDL

SEQ ID NO: 172592 - protein, 9 aa, Homo Sapiens
SLPASKQML

SEQ ID NO: 172593 - protein, 9 aa, Homo Sapiens
SLPDIKVYL

SEQ ID NO: 172594 - protein, 9 aa, Homo Sapiens
SLPGVALTL

SEQ ID NO: 172595 - protein, 9 aa, Homo Sapiens
SLPKPTIIL

SEQ ID NO: 172596 - protein, 9 aa, Homo Sapiens
SLPRFQVTL

SEQ ID NO: 172597 - protein, 9 aa, Homo Sapiens
SLPSTKPQL

SEQ ID NO: 172598 - protein, 9 aa, Homo Sapiens
SLTPVTLVL

SEQ ID NO: 172599 - protein, 9 aa, Homo Sapiens
SLVEYKPEL

SEQ ID NO: 172600 - protein, 9 aa, Homo Sapiens
SMPDHSIHL

SEQ ID NO: 172601 - protein, 9 aa, Homo Sapiens
SMVHKRINL

SEQ ID NO: 172602 - protein, 9 aa, Homo Sapiens
SMVIQKIYL

SEQ ID NO: 172603 - protein, 9 aa, Homo Sapiens
SNIEEKIKL

SEQ ID NO: 172604 - protein, 9 aa, Homo Sapiens
SNIYSKFLL

SEQ ID NO: 172605 - protein, 9 aa, Homo Sapiens
SQPGVAIGL

SEQ ID NO: 172606 - protein, 9 aa, Homo Sapiens
SRPGKNVQL

SEQ ID NO: 172607 - protein, 9 aa, Homo Sapiens
SRPKSNIVL

SEQ ID NO: 172608 - protein, 9 aa, Homo Sapiens
SRPLSAVVL

SEQ ID NO: 172609 - protein, 9 aa, Homo Sapiens
SRPRVVIQL

SEQ ID NO: 172610 - protein, 9 aa, Homo Sapiens
SSIKDKIVL

SEQ ID NO: 172611 - protein, 9 aa, Homo Sapiens
SSPKGKFSL

SEQ ID NO: 172612 - protein, 9 aa, Homo Sapiens
SSPKQYMQL

SEQ ID NO: 172613 - protein, 9 aa, Homo Sapiens
SSVISKIDL

SEQ ID NO: 172614 - protein, 9 aa, Homo Sapiens
STIGQKIAL

SEQ ID NO: 172615 - protein, 9 aa, Homo Sapiens
STITSKMNL

SEQ ID NO: 172616 - protein, 9 aa, Homo Sapiens
STPKHYIRF

SEQ ID NO: 172617 - protein, 9 aa, Homo Sapiens
STPSGYLEL

SEQ ID NO: 172618 - protein, 9 aa, Homo Sapiens
STPTEKPKL

SEQ ID NO: 172619 - protein, 9 aa, Homo Sapiens
STVTTKVTL

SEQ ID NO: 172620 - protein, 9 aa, Homo Sapiens
SVIDEPVRL

SEQ ID NO: 172621 - protein, 9 aa, Homo Sapiens
SVIPDKPSL

SEQ ID NO: 172622 - protein, 9 aa, Homo Sapiens
SVIYKKFQL

SEQ ID NO: 172623 - protein, 9 aa, Homo Sapiens
SVPKHKLTL

SEQ ID NO: 172624 - protein, 9 aa, Homo Sapiens
SVPNKALEL

SEQ ID NO: 172625 - protein, 9 aa, Homo Sapiens
SVPQIHVNL

SEQ ID NO: 172626 - protein, 9 aa, Homo Sapiens
SVVKGRLHL

SEQ ID NO: 172627 - protein, 9 aa, Homo Sapiens
SYPHHATQL

SEQ ID NO: 172628 - protein, 9 aa, Homo Sapiens
TFPNNPVEL

SEQ ID NO: 172629 - protein, 9 aa, Homo Sapiens
TFPQNPVEL

SEQ ID NO: 172630 - protein, 9 aa, Homo Sapiens
TFPVHRQKL

SEQ ID NO: 172631 - protein, 9 aa, Homo Sapiens
THPFKTIEL

SEQ ID NO: 172632 - protein, 9 aa, Homo Sapiens
TIILSKMML

SEQ ID NO: 172633 - protein, 9 aa, Homo Sapiens
TIPKHRHLL

SEQ ID NO: 172634 - protein, 9 aa, Homo Sapiens
TIVTDGIQL

SEQ ID NO: 172635 - protein, 9 aa, Homo Sapiens
TLPEGCVVL

SEQ ID NO: 172636 - protein, 9 aa, Homo Sapiens
TLPPGSVLL

SEQ ID NO: 172637 - protein, 9 aa, Homo Sapiens
TLPPQKPEL

SEQ ID NO: 172638 - protein, 9 aa, Homo Sapiens
TLVKNCIVL

SEQ ID NO: 172639 - protein, 9 aa, Homo Sapiens
TMPPTTVIL

SEQ ID NO: 172640 - protein, 9 aa, Homo Sapiens
TMVKKKVVF

SEQ ID NO: 172641 - protein, 9 aa, Homo Sapiens
TNVINKIIL

SEQ ID NO: 172642 - protein, 9 aa, Homo Sapiens
TQPERYIHL

SEQ ID NO: 172643 - protein, 9 aa, Homo Sapiens
TRPEKALIL

SEQ ID NO: 172644 - protein, 9 aa, Homo Sapiens
TRPKMSIVL

SEQ ID NO: 172645 - protein, 9 aa, Homo Sapiens
TTILYKLKL

SEQ ID NO: 172646 - protein, 9 aa, Homo Sapiens
TTPKHYIRF

SEQ ID NO: 172647 - protein, 9 aa, Homo Sapiens
TTPQCKYLL

SEQ ID NO: 172648 - protein, 9 aa, Homo Sapiens
TVIATNILL

SEQ ID NO: 172649 - protein, 9 aa, Homo Sapiens
TYPGPAVVL

SEQ ID NO: 172650 - protein, 9 aa, Homo Sapiens
VAPEEHPVL

SEQ ID NO: 172651 - protein, 9 aa, Homo Sapiens
VAPPGCSHL

SEQ ID NO: 172652 - protein, 9 aa, Homo Sapiens
VFPHLTVVL

SEQ ID NO: 172653 - protein, 9 aa, Homo Sapiens
VFPKEPVEL

SEQ ID NO: 172654 - protein, 9 aa, Homo Sapiens
VFPSMPIKL

SEQ ID NO: 172655 - protein, 9 aa, Homo Sapiens
VIAPNPAQL

SEQ ID NO: 172656 - protein, 9 aa, Homo Sapiens
VIIGKTVTL

SEQ ID NO: 172657 - protein, 9 aa, Homo Sapiens
VIIGTKTIL

SEQ ID NO: 172658 - protein, 9 aa, Homo Sapiens
VINPEPITL

SEQ ID NO: 172659 - protein, 9 aa, Homo Sapiens
VIPESVILL

SEQ ID NO: 172660 - protein, 9 aa, Homo Sapiens
VIPKSKFVL

SEQ ID NO: 172661 - protein, 9 aa, Homo Sapiens
VIPPCKSEL

SEQ ID NO: 172662 - protein, 9 aa, Homo Sapiens
VIPRITIEM

SEQ ID NO: 172663 - protein, 9 aa, Homo Sapiens
VIPSTGIKL

SEQ ID NO: 172664 - protein, 9 aa, Homo Sapiens
VIPTNVPEL

SEQ ID NO: 172665 - protein, 9 aa, Homo Sapiens
VITKTGAKL

SEQ ID NO: 172666 - protein, 9 aa, Homo Sapiens
VLPKLYVKL

SEQ ID NO: 172667 - protein, 9 aa, Homo Sapiens
VLPKSRVEL

SEQ ID NO: 172668 - protein, 9 aa, Homo Sapiens
VLPNIHPEL

SEQ ID NO: 172669 - protein, 9 aa, Homo Sapiens
VLPNTALHL

SEQ ID NO: 172670 - protein, 9 aa, Homo Sapiens
VLPPEPVQL

SEQ ID NO: 172671 - protein, 9 aa, Homo Sapiens
VLPPTCIQL

SEQ ID NO: 172672 - protein, 9 aa, Homo Sapiens
VLPVKKPKM

SEQ ID NO: 172673 - protein, 9 aa, Homo Sapiens
VMAPRTLFL

SEQ ID NO: 172674 - protein, 9 aa, Homo Sapiens
VMPKKRQAL

SEQ ID NO: 172675 - protein, 9 aa, Homo Sapiens
VQPKSLVRL

SEQ ID NO: 172676 - protein, 9 aa, Homo Sapiens
VQPSKYHFL

SEQ ID NO: 172677 - protein, 9 aa, Homo Sapiens
VQPTHVIHL

SEQ ID NO: 172678 - protein, 9 aa, Homo Sapiens
VQPVVHPQL

SEQ ID NO: 172679 - protein, 9 aa, Homo Sapiens
VQVHSKFRL

SEQ ID NO: 172680 - protein, 9 aa, Homo Sapiens
VSPKKSTVL

SEQ ID NO: 172681 - protein, 9 aa, Homo Sapiens
VSPRQTLEL

SEQ ID NO: 172682 - protein, 9 aa, Homo Sapiens
VSTSHTTIS

SEQ ID NO: 172683 - protein, 9 aa, Homo Sapiens
VVAKDGLKL

SEQ ID NO: 172684 - protein, 9 aa, Homo Sapiens
VVAPAGITL

SEQ ID NO: 172685 - protein, 9 aa, Homo Sapiens
VVPDHPVLL

SEQ ID NO: 172686 - protein, 9 aa, Homo Sapiens
VVPKDRVAL

SEQ ID NO: 172687 - protein, 9 aa, Homo Sapiens
VYIKHPVSL

SEQ ID NO: 172688 - protein, 9 aa, Homo Sapiens
YIIKDKHIL

SEQ ID NO: 172689 - protein, 10 aa, Homo Sapiens
AGDALLSLLA

SEQ ID NO: 172690 - protein, 10 aa, Homo Sapiens
KAPKPGGLSL

SEQ ID NO: 172691 - protein, 10 aa, Homo Sapiens
KFPAYERVLL

SEQ ID NO: 172692 - protein, 10 aa, Homo Sapiens
KIIDRAITSL

SEQ ID NO: 172693 - protein, 10 aa, Homo Sapiens
KIIEARLKMY

SEQ ID NO: 172694 - protein, 10 aa, Homo Sapiens
KIIEDLGVHF

SEQ ID NO: 172695 - protein, 10 aa, Homo Sapiens
KIPSSHPVSL

SEQ ID NO: 172696 - protein, 10 aa, Homo Sapiens
KISSVQPICL

SEQ ID NO: 172697 - protein, 10 aa, Homo Sapiens
KLLKCSRLVL

SEQ ID NO: 172698 - protein, 10 aa, Homo Sapiens
KLPATEKPVL

SEQ ID NO: 172699 - protein, 10 aa, Homo Sapiens
KLPGDKGLVL

SEQ ID NO: 172700 - protein, 10 aa, Homo Sapiens
KLPPGFPVKL

SEQ ID NO: 172701 - protein, 10 aa, Homo Sapiens
KLPSVPSTHL

SEQ ID NO: 172702 - protein, 10 aa, Homo Sapiens
KLWPLPKALL

SEQ ID NO: 172703 - protein, 10 aa, Homo Sapiens
KMPGPGCVFL

SEQ ID NO: 172704 - protein, 10 aa, Homo Sapiens
KMPSLQPVVM

SEQ ID NO: 172705 - protein, 10 aa, Homo Sapiens
KQPVGGGQKL

SEQ ID NO: 172706 - protein, 10 aa, Homo Sapiens
KTLDQAKAVL

SEQ ID NO: 172707 - protein, 10 aa, Homo Sapiens
KYPASTVQIL

SEQ ID NO: 172708 - protein, 10 aa, Homo Sapiens
KYVGSRPIKL

SEQ ID NO: 172709 - protein, 10 aa, Homo Sapiens
LRANGLLKII

SEQ ID NO: 172710 - protein, 10 aa, Homo Sapiens
PFADVAPLQL

SEQ ID NO: 172711 - protein, 10 aa, Homo Sapiens
PLSMAPPLSL

SEQ ID NO: 172712 - protein, 10 aa, Homo Sapiens
PPSKPPPVEL

SEQ ID NO: 172713 - protein, 10 aa, Homo Sapiens
PSFPVSTLKL

SEQ ID NO: 172714 - protein, 10 aa, Homo Sapiens
QSYPHHATQL

SEQ ID NO: 172715 - protein, 10 aa, Homo Sapiens
RFPNFTNQLL

SEQ ID NO: 172716 - protein, 10 aa, Homo Sapiens
RHPQPGAVEL

SEQ ID NO: 172717 - protein, 10 aa, Homo Sapiens
RIINLGPVML

SEQ ID NO: 172718 - protein, 10 aa, Homo Sapiens
RIPAEGRVAL

SEQ ID NO: 172719 - protein, 10 aa, Homo Sapiens
RLPYKAGLSL

SEQ ID NO: 172720 - protein, 10 aa, Homo Sapiens
RMDPLEAIQL

SEQ ID NO: 172721 - protein, 10 aa, Homo Sapiens
RRPKNVVLRL

SEQ ID NO: 172722 - protein, 10 aa, Homo Sapiens
RYPERPIIFL

SEQ ID NO: 172723 - protein, 10 aa, Homo Sapiens
RYPPFPSDYL

SEQ ID NO: 172724 - protein, 10 aa, Homo Sapiens
RYPVNSVNIL

SEQ ID NO: 172725 - protein, 10 aa, Homo Sapiens
THPPGPAVQL

SEQ ID NO: 172726 - protein, 10 aa, Homo Sapiens
TLDGLPPLRL

SEQ ID NO: 172727 - protein, 10 aa, Homo Sapiens
TYPGQPHPAL

SEQ ID NO: 172728 - protein, 10 aa, Homo Sapiens
TYPKGAGEML

SEQ ID NO: 172729 - protein, 11 aa, Homo Sapiens
KFPGPLENQRL

SEQ ID NO: 172730 - protein, 11 aa, Homo Sapiens
KFPSEYVPTVF

SEQ ID NO: 172731 - protein, 11 aa, Homo Sapiens
KIVPAKDLVLL

SEQ ID NO: 172732 - protein, 11 aa, Homo Sapiens
KLPATEKPVLL

SEQ ID NO: 172733 - protein, 11 aa, Homo Sapiens
KLPPTDAYYKL

SEQ ID NO: 172734 - protein, 11 aa, Homo Sapiens
KLPSGKLQVHL

SEQ ID NO: 172735 - protein, 11 aa, Homo Sapiens
KLPVANEYLLL

SEQ ID NO: 172736 - protein, 11 aa, Homo Sapiens
KMPQSMPEYAL

SEQ ID NO: 172737 - protein, 11 aa, Homo Sapiens
KSPASDTYIVF

SEQ ID NO: 172738 - protein, 11 aa, Homo Sapiens
KVPTYKDYVDL

SEQ ID NO: 172739 - protein, 11 aa, Homo Sapiens
PGSLIPEALRL

SEQ ID NO: 172740 - protein, 11 aa, Homo Sapiens
RIPHNNFYRKL

SEQ ID NO: 172741 - protein, 11 aa, Homo Sapiens
RPPSKPPPVEL

SEQ ID NO: 172742 - protein, 11 aa, Homo Sapiens
SSTISSNVASK

SEQ ID NO: 172743 - protein, 8 aa, Homo Sapiens
APISKVIR

SEQ ID NO: 172744 - protein, 8 aa, Homo Sapiens
APLSKVRL

SEQ ID NO: 172745 - protein, 8 aa, Homo Sapiens
EIADPIVL

SEQ ID NO: 172746 - protein, 8 aa, Homo Sapiens
GLPEPLML

SEQ ID NO: 172747 - protein, 8 aa, Homo Sapiens
GLPEPVTL

SEQ ID NO: 172748 - protein, 8 aa, Homo Sapiens
HRPPPIKL

SEQ ID NO: 172749 - protein, 8 aa, Homo Sapiens
IIAKKIVL

SEQ ID NO: 172750 - protein, 8 aa, Homo Sapiens
IIPRHLQL

SEQ ID NO: 172751 - protein, 8 aa, Homo Sapiens
IVKEKVHL

SEQ ID NO: 172752 - protein, 8 aa, Homo Sapiens
KFIEGVVL

SEQ ID NO: 172753 - protein, 8 aa, Homo Sapiens
KIADPFVL

SEQ ID NO: 172754 - protein, 8 aa, Homo Sapiens
KIPSPVKL

SEQ ID NO: 172755 - protein, 8 aa, Homo Sapiens
KKIGKPEI

SEQ ID NO: 172756 - protein, 8 aa, Homo Sapiens
KLPPVLVL

SEQ ID NO: 172757 - protein, 8 aa, Homo Sapiens
KVPFPLTL

SEQ ID NO: 172758 - protein, 8 aa, Homo Sapiens
LLPGPLEL

SEQ ID NO: 172759 - protein, 8 aa, Homo Sapiens
LLPGPVTL

SEQ ID NO: 172760 - protein, 8 aa, Homo Sapiens
LPKLYVKL

SEQ ID NO: 172761 - protein, 8 aa, Homo Sapiens
LPKSRVEL

SEQ ID NO: 172762 - protein, 8 aa, Homo Sapiens
LVKNKITL

SEQ ID NO: 172763 - protein, 8 aa, Homo Sapiens
PLPPAVFL

SEQ ID NO: 172764 - protein, 8 aa, Homo Sapiens
PQRKPLVL

SEQ ID NO: 172765 - protein, 8 aa, Homo Sapiens
PVPDPILL

SEQ ID NO: 172766 - protein, 8 aa, Homo Sapiens
QFPGAITL

SEQ ID NO: 172767 - protein, 8 aa, Homo Sapiens
QIPAAVKL

SEQ ID NO: 172768 - protein, 8 aa, Homo Sapiens
RFPEALRL

SEQ ID NO: 172769 - protein, 8 aa, Homo Sapiens
RIAKGLRL

SEQ ID NO: 172770 - protein, 8 aa, Homo Sapiens
RIIIPVLL

SEQ ID NO: 172771 - protein, 8 aa, Homo Sapiens
RIIPRHLQ

SEQ ID NO: 172772 - protein, 8 aa, Homo Sapiens
RIPEPVHL

SEQ ID NO: 172773 - protein, 8 aa, Homo Sapiens
RIRLPHLE

SEQ ID NO: 172774 - protein, 8 aa, Homo Sapiens
RLPPPTIL

SEQ ID NO: 172775 - protein, 8 aa, Homo Sapiens
RVPEAVEL

SEQ ID NO: 172776 - protein, 8 aa, Homo Sapiens
SIAGPVLL

SEQ ID NO: 172777 - protein, 8 aa, Homo Sapiens
SIAPPVPL

SEQ ID NO: 172778 - protein, 8 aa, Homo Sapiens
SLAPPLCL

SEQ ID NO: 172779 - protein, 8 aa, Homo Sapiens
SVKVKIKL

SEQ ID NO: 172780 - protein, 8 aa, Homo Sapiens
TGPPPLLL

SEQ ID NO: 172781 - protein, 8 aa, Homo Sapiens
TLPTPMVL

SEQ ID NO: 172782 - protein, 8 aa, Homo Sapiens
TVEQHLRL

SEQ ID NO: 172783 - protein, 8 aa, Homo Sapiens
VIDRKVEL

SEQ ID NO: 172784 - protein, 8 aa, Homo Sapiens
VIGPPVVL

SEQ ID NO: 172785 - protein, 8 aa, Homo Sapiens
VVPQAIEL

SEQ ID NO: 172786 - protein, 9 aa, Homo Sapiens
AGPAQFIEL

SEQ ID NO: 172787 - protein, 9 aa, Homo Sapiens
AGPPDTISL

SEQ ID NO: 172788 - protein, 9 aa, Homo Sapiens
AHPLETLIL

SEQ ID NO: 172789 - protein, 9 aa, Homo Sapiens
AIIDKYIKL

SEQ ID NO: 172790 - protein, 9 aa, Homo Sapiens
AIIKEPIDI

SEQ ID NO: 172791 - protein, 9 aa, Homo Sapiens
AIIRDRAAL

SEQ ID NO: 172792 - protein, 9 aa, Homo Sapiens
AIPKKKMNL

SEQ ID NO: 172793 - protein, 9 aa, Homo Sapiens
AITPAGINL

SEQ ID NO: 172794 - protein, 9 aa, Homo Sapiens
AIVAKQVLL

SEQ ID NO: 172795 - protein, 9 aa, Homo Sapiens
AIVNSALKL

SEQ ID NO: 172796 - protein, 9 aa, Homo Sapiens
ALPKLPISL

SEQ ID NO: 172797 - protein, 9 aa, Homo Sapiens
ALVKEKLRL

SEQ ID NO: 172798 - protein, 9 aa, Homo Sapiens
ASPTQPIQL

SEQ ID NO: 172799 - protein, 9 aa, Homo Sapiens
ATPLKKVIL

SEQ ID NO: 172800 - protein, 9 aa, Homo Sapiens
AVPEVAVYL

SEQ ID NO: 172801 - protein, 9 aa, Homo Sapiens
AVVARKLEL

SEQ ID NO: 172802 - protein, 9 aa, Homo Sapiens
DPFPAAIIL

SEQ ID NO: 172803 - protein, 9 aa, Homo Sapiens
EIIKQKLTL

SEQ ID NO: 172804 - protein, 9 aa, Homo Sapiens
EIISKGIKL

SEQ ID NO: 172805 - protein, 9 aa, Homo Sapiens
EIPELAIKL

SEQ ID NO: 172806 - protein, 9 aa, Homo Sapiens
ELLSKAVKL

SEQ ID NO: 172807 - protein, 9 aa, Homo Sapiens
ENRSLTIKL

SEQ ID NO: 172808 - protein, 9 aa, Homo Sapiens
GFPEGSVEL

SEQ ID NO: 172809 - protein, 9 aa, Homo Sapiens
GFPKVSILL

SEQ ID NO: 172810 - protein, 9 aa, Homo Sapiens
GKLPKGILL

SEQ ID NO: 172811 - protein, 9 aa, Homo Sapiens
GVPKTHLEL

SEQ ID NO: 172812 - protein, 9 aa, Homo Sapiens
HCVSAFVKL

SEQ ID NO: 172813 - protein, 9 aa, Homo Sapiens
HGPNHPLVL

SEQ ID NO: 172814 - protein, 9 aa, Homo Sapiens
HGPPEPVLL

SEQ ID NO: 172815 - protein, 9 aa, Homo Sapiens
HGVKDKPVL

SEQ ID NO: 172816 - protein, 9 aa, Homo Sapiens
HHPDYNNEL

SEQ ID NO: 172817 - protein, 9 aa, Homo Sapiens
HIEPLKIQL

SEQ ID NO: 172818 - protein, 9 aa, Homo Sapiens
HIIPRSLDL

SEQ ID NO: 172819 - protein, 9 aa, Homo Sapiens
HINIGALEL

SEQ ID NO: 172820 - protein, 9 aa, Homo Sapiens
HITPDNFEL

SEQ ID NO: 172821 - protein, 9 aa, Homo Sapiens
HIVVNKAEL

SEQ ID NO: 172822 - protein, 9 aa, Homo Sapiens
HLIEESVKL

SEQ ID NO: 172823 - protein, 9 aa, Homo Sapiens
HLPDVCVNL

SEQ ID NO: 172824 - protein, 9 aa, Homo Sapiens
HQIDNHIHL

SEQ ID NO: 172825 - protein, 9 aa, Homo Sapiens
HQPTTWVSF

SEQ ID NO: 172826 - protein, 9 aa, Homo Sapiens
HSPGDYILL

SEQ ID NO: 172827 - protein, 9 aa, Homo Sapiens
HSPPNKPKL

SEQ ID NO: 172828 - protein, 9 aa, Homo Sapiens
HTPHQFLLL

SEQ ID NO: 172829 - protein, 9 aa, Homo Sapiens
HTPHSNVIL

SEQ ID NO: 172830 - protein, 9 aa, Homo Sapiens
HVIHGGIVL

SEQ ID NO: 172831 - protein, 9 aa, Homo Sapiens
HVPCLKILL

SEQ ID NO: 172832 - protein, 9 aa, Homo Sapiens
HVPEHAVVL

SEQ ID NO: 172833 - protein, 9 aa, Homo Sapiens
IGFPCGILL

SEQ ID NO: 172834 - protein, 9 aa, Homo Sapiens
IHPPNYIVL

SEQ ID NO: 172835 - protein, 9 aa, Homo Sapiens
ILIETKLVL

SEQ ID NO: 172836 - protein, 9 aa, Homo Sapiens
ILPEDHLLL

SEQ ID NO: 172837 - protein, 9 aa, Homo Sapiens
IPSRVALIL

SEQ ID NO: 172838 - protein, 9 aa, Homo Sapiens
IQRTPKIQV

SEQ ID NO: 172839 - protein, 9 aa, Homo Sapiens
ISPKEFVHL

SEQ ID NO: 172840 - protein, 9 aa, Homo Sapiens
ISPKHFVHL

SEQ ID NO: 172841 - protein, 9 aa, Homo Sapiens
ITPPEKFFL

SEQ ID NO: 172842 - protein, 9 aa, Homo Sapiens
KAIDEYMKL

SEQ ID NO: 172843 - protein, 9 aa, Homo Sapiens
KAPAPPLVL

SEQ ID NO: 172844 - protein, 9 aa, Homo Sapiens
KAPASYTKI

SEQ ID NO: 172845 - protein, 9 aa, Homo Sapiens
KAPLSKVRL

SEQ ID NO: 172846 - protein, 9 aa, Homo Sapiens
KAPPDGWEL

SEQ ID NO: 172847 - protein, 9 aa, Homo Sapiens
KAPPIPLKL

SEQ ID NO: 172848 - protein, 9 aa, Homo Sapiens
KAPVNTAEL

SEQ ID NO: 172849 - protein, 9 aa, Homo Sapiens
KAVGDGIVL

SEQ ID NO: 172850 - protein, 9 aa, Homo Sapiens
KEIEEKLRL

SEQ ID NO: 172851 - protein, 9 aa, Homo Sapiens
KEVQDGIEL

SEQ ID NO: 172852 - protein, 9 aa, Homo Sapiens
KFIDKQLEL

SEQ ID NO: 172853 - protein, 9 aa, Homo Sapiens
KFPAYERVL

SEQ ID NO: 172854 - protein, 9 aa, Homo Sapiens
KFPDREFLL

SEQ ID NO: 172855 - protein, 9 aa, Homo Sapiens
KFPELNYQL

SEQ ID NO: 172856 - protein, 9 aa, Homo Sapiens
KFPGIRPYL

SEQ ID NO: 172857 - protein, 9 aa, Homo Sapiens
KFPHESARL

SEQ ID NO: 172858 - protein, 9 aa, Homo Sapiens
KFPIMNLQL

SEQ ID NO: 172859 - protein, 9 aa, Homo Sapiens
KFPIVNAEL

SEQ ID NO: 172860 - protein, 9 aa, Homo Sapiens
KFPLMTLQL

SEQ ID NO: 172861 - protein, 9 aa, Homo Sapiens
KFPLTRPSL

SEQ ID NO: 172862 - protein, 9 aa, Homo Sapiens
KFPPKFVQL

SEQ ID NO: 172863 - protein, 9 aa, Homo Sapiens
KFPSEPNRL

SEQ ID NO: 172864 - protein, 9 aa, Homo Sapiens
KFPTPASRL

SEQ ID NO: 172865 - protein, 9 aa, Homo Sapiens
KFPTTKLEM

SEQ ID NO: 172866 - protein, 9 aa, Homo Sapiens
KFPVKPADL

SEQ ID NO: 172867 - protein, 9 aa, Homo Sapiens
KFVNKSYLL

SEQ ID NO: 172868 - protein, 9 aa, Homo Sapiens
KFVVKKPEL

SEQ ID NO: 172869 - protein, 9 aa, Homo Sapiens
KGIADRLVL

SEQ ID NO: 172870 - protein, 9 aa, Homo Sapiens
KGIGEFFRL

SEQ ID NO: 172871 - protein, 9 aa, Homo Sapiens
KGPAVGIDL

SEQ ID NO: 172872 - protein, 9 aa, Homo Sapiens
KGPPAALTL

SEQ ID NO: 172873 - protein, 9 aa, Homo Sapiens
KGPYEYLTL

SEQ ID NO: 172874 - protein, 9 aa, Homo Sapiens
KHPKYCIEL

SEQ ID NO: 172875 - protein, 9 aa, Homo Sapiens
KIAGYVTHL

SEQ ID NO: 172876 - protein, 9 aa, Homo Sapiens
KIAKLGLKL

SEQ ID NO: 172877 - protein, 9 aa, Homo Sapiens
KIAKPLSSL

SEQ ID NO: 172878 - protein, 9 aa, Homo Sapiens
KIAPNTPQL

SEQ ID NO: 172879 - protein, 9 aa, Homo Sapiens
KIAPYSVEI

SEQ ID NO: 172880 - protein, 9 aa, Homo Sapiens
KIAQKALDL

SEQ ID NO: 172881 - protein, 9 aa, Homo Sapiens
KIDRLIVEL

SEQ ID NO: 172882 - protein, 9 aa, Homo Sapiens
KIFPAALQL

SEQ ID NO: 172883 - protein, 9 aa, Homo Sapiens
KIIAGSVAL

SEQ ID NO: 172884 - protein, 9 aa, Homo Sapiens
KIIAKGEEL

SEQ ID NO: 172885 - protein, 9 aa, Homo Sapiens
KIIDGLLVM

SEQ ID NO: 172886 - protein, 9 aa, Homo Sapiens
KIIEARLKM

SEQ ID NO: 172887 - protein, 9 aa, Homo Sapiens
KIIEMMPEF

SEQ ID NO: 172888 - protein, 9 aa, Homo Sapiens
KIIGDLLQF

SEQ ID NO: 172889 - protein, 9 aa, Homo Sapiens
KIIKDFYLL

SEQ ID NO: 172890 - protein, 9 aa, Homo Sapiens
KIIKEKQAF

SEQ ID NO: 172891 - protein, 9 aa, Homo Sapiens
KIIKETVRF

SEQ ID NO: 172892 - protein, 9 aa, Homo Sapiens
KIIKKPMDL

SEQ ID NO: 172893 - protein, 9 aa, Homo Sapiens
KIIKNPMDL

SEQ ID NO: 172894 - protein, 9 aa, Homo Sapiens
KIINFAPSL

SEQ ID NO: 172895 - protein, 9 aa, Homo Sapiens
KIINGYIFL

SEQ ID NO: 172896 - protein, 9 aa, Homo Sapiens
KIINQRLIL

SEQ ID NO: 172897 - protein, 9 aa, Homo Sapiens
KIIPLVVKF

SEQ ID NO: 172898 - protein, 9 aa, Homo Sapiens
KIIQLGLTF

SEQ ID NO: 172899 - protein, 9 aa, Homo Sapiens
KIITEGTKL

SEQ ID NO: 172900 - protein, 9 aa, Homo Sapiens
KIITRPMDL

SEQ ID NO: 172901 - protein, 9 aa, Homo Sapiens
KIIYKLIRL

SEQ ID NO: 172902 - protein, 9 aa, Homo Sapiens
KILAAILHL

SEQ ID NO: 172903 - protein, 9 aa, Homo Sapiens
KILAEAAKL

SEQ ID NO: 172904 - protein, 9 aa, Homo Sapiens
KILQERAVL

SEQ ID NO: 172905 - protein, 9 aa, Homo Sapiens
KINKKRIAL

SEQ ID NO: 172906 - protein, 9 aa, Homo Sapiens
KINSSAIKL

SEQ ID NO: 172907 - protein, 9 aa, Homo Sapiens
KIPAHRVVL

SEQ ID NO: 172908 - protein, 9 aa, Homo Sapiens
KIPALAVEM

SEQ ID NO: 172909 - protein, 9 aa, Homo Sapiens
KIPEYQQLL

SEQ ID NO: 172910 - protein, 9 aa, Homo Sapiens
KIPILGVHL

SEQ ID NO: 172911 - protein, 9 aa, Homo Sapiens
KIPKAYIRF

SEQ ID NO: 172912 - protein, 9 aa, Homo Sapiens
KIPKDEHIL

SEQ ID NO: 172913 - protein, 9 aa, Homo Sapiens
KIPKKNILL

SEQ ID NO: 172914 - protein, 9 aa, Homo Sapiens
KIPTAKPEL

SEQ ID NO: 172915 - protein, 9 aa, Homo Sapiens
KIPTCKITL

SEQ ID NO: 172916 - protein, 9 aa, Homo Sapiens
KISKEKSFL

SEQ ID NO: 172917 - protein, 9 aa, Homo Sapiens
KITAYVIIL

SEQ ID NO: 172918 - protein, 9 aa, Homo Sapiens
KITDEVLKL

SEQ ID NO: 172919 - protein, 9 aa, Homo Sapiens
KIVKETVRF

SEQ ID NO: 172920 - protein, 9 aa, Homo Sapiens
KIVKPGMKL

SEQ ID NO: 172921 - protein, 9 aa, Homo Sapiens
KIVQFIVTL

SEQ ID NO: 172922 - protein, 9 aa, Homo Sapiens
KIVSGKVRF

SEQ ID NO: 172923 - protein, 9 aa, Homo Sapiens
KKIPSPVKL

SEQ ID NO: 172924 - protein, 9 aa, Homo Sapiens
KKPEKPLIL

SEQ ID NO: 172925 - protein, 9 aa, Homo Sapiens
KKTKEAVLL

SEQ ID NO: 172926 - protein, 9 aa, Homo Sapiens
KLAPIPVEL

SEQ ID NO: 172927 - protein, 9 aa, Homo Sapiens
KLAPPLVTL

SEQ ID NO: 172928 - protein, 9 aa, Homo Sapiens
KLGISPLML

SEQ ID NO: 172929 - protein, 9 aa, Homo Sapiens
KLIAWKVCL

SEQ ID NO: 172930 - protein, 9 aa, Homo Sapiens
KLIEKNYFL

SEQ ID NO: 172931 - protein, 9 aa, Homo Sapiens
KLIFPYVEL

SEQ ID NO: 172932 - protein, 9 aa, Homo Sapiens
KLIHEKHLL

SEQ ID NO: 172933 - protein, 9 aa, Homo Sapiens
KLIIWKIAL

SEQ ID NO: 172934 - protein, 9 aa, Homo Sapiens
KLIKDGLII

SEQ ID NO: 172935 - protein, 9 aa, Homo Sapiens
KLIKTSPEL

SEQ ID NO: 172936 - protein, 9 aa, Homo Sapiens
KLILKGVIL

SEQ ID NO: 172937 - protein, 9 aa, Homo Sapiens
KLIPNAIQI

SEQ ID NO: 172938 - protein, 9 aa, Homo Sapiens
KLIQQRAVL

SEQ ID NO: 172939 - protein, 9 aa, Homo Sapiens
KLITSFLEL

SEQ ID NO: 172940 - protein, 9 aa, Homo Sapiens
KLLKEAVVL

SEQ ID NO: 172941 - protein, 9 aa, Homo Sapiens
KLLRDRIVL

SEQ ID NO: 172942 - protein, 9 aa, Homo Sapiens
KLLSEALEL

SEQ ID NO: 172943 - protein, 9 aa, Homo Sapiens
KLPAIALDL

SEQ ID NO: 172944 - protein, 9 aa, Homo Sapiens
KLPAPLPGL

SEQ ID NO: 172945 - protein, 9 aa, Homo Sapiens
KLPDCSLRL

SEQ ID NO: 172946 - protein, 9 aa, Homo Sapiens
KLPDKTVEF

SEQ ID NO: 172947 - protein, 9 aa, Homo Sapiens
KLPELWALL

SEQ ID NO: 172948 - protein, 9 aa, Homo Sapiens
KLPGIALEL

SEQ ID NO: 172949 - protein, 9 aa, Homo Sapiens
KLPKDTALL

SEQ ID NO: 172950 - protein, 9 aa, Homo Sapiens
KLPKEREEL

SEQ ID NO: 172951 - protein, 9 aa, Homo Sapiens
KLPKGTVSF

SEQ ID NO: 172952 - protein, 9 aa, Homo Sapiens
KLPLMKINF

SEQ ID NO: 172953 - protein, 9 aa, Homo Sapiens
KLPPKRPEL

SEQ ID NO: 172954 - protein, 9 aa, Homo Sapiens
KLPPLPLTL

SEQ ID NO: 172955 - protein, 9 aa, Homo Sapiens
KLPQFCAHL

SEQ ID NO: 172956 - protein, 9 aa, Homo Sapiens
KLPQQREKL

SEQ ID NO: 172957 - protein, 9 aa, Homo Sapiens
KLPQRTAKL

SEQ ID NO: 172958 - protein, 9 aa, Homo Sapiens
KLPSVPTKL

SEQ ID NO: 172959 - protein, 9 aa, Homo Sapiens
KLPYELIQL

SEQ ID NO: 172960 - protein, 9 aa, Homo Sapiens
KLSVTKPVL

SEQ ID NO: 172961 - protein, 9 aa, Homo Sapiens
KLTRDAIEL

SEQ ID NO: 172962 - protein, 9 aa, Homo Sapiens
KLVFDKVGL

SEQ ID NO: 172963 - protein, 9 aa, Homo Sapiens
KLVKKKWNL

SEQ ID NO: 172964 - protein, 9 aa, Homo Sapiens
KLVRDAFAL

SEQ ID NO: 172965 - protein, 9 aa, Homo Sapiens
KLVRKLIRL

SEQ ID NO: 172966 - protein, 9 aa, Homo Sapiens
KLVTEPLVL

SEQ ID NO: 172967 - protein, 9 aa, Homo Sapiens
KMAGRAVLL

SEQ ID NO: 172968 - protein, 9 aa, Homo Sapiens
KMIGLKAKL

SEQ ID NO: 172969 - protein, 9 aa, Homo Sapiens
KMPACNIML

SEQ ID NO: 172970 - protein, 9 aa, Homo Sapiens
KMPDMHVNM

SEQ ID NO: 172971 - protein, 9 aa, Homo Sapiens
KMVRQILEL

SEQ ID NO: 172972 - protein, 9 aa, Homo Sapiens
KNILTLIEL

SEQ ID NO: 172973 - protein, 9 aa, Homo Sapiens
KNIPMTLEL

SEQ ID NO: 172974 - protein, 9 aa, Homo Sapiens
KNPAFKPVL

SEQ ID NO: 172975 - protein, 9 aa, Homo Sapiens
KNPQKFTIL

SEQ ID NO: 172976 - protein, 9 aa, Homo Sapiens
KNTLNKVVL

SEQ ID NO: 172977 - protein, 9 aa, Homo Sapiens
KNVTEHLKL

SEQ ID NO: 172978 - protein, 9 aa, Homo Sapiens
KQALDKLKL

SEQ ID NO: 172979 - protein, 9 aa, Homo Sapiens
KQAQEKFEL

SEQ ID NO: 172980 - protein, 9 aa, Homo Sapiens
KQIGEHLLL

SEQ ID NO: 172981 - protein, 9 aa, Homo Sapiens
KQPAEHLQL

SEQ ID NO: 172982 - protein, 9 aa, Homo Sapiens
KQPEEGLRL

SEQ ID NO: 172983 - protein, 9 aa, Homo Sapiens
KQPEEYHYL

SEQ ID NO: 172984 - protein, 9 aa, Homo Sapiens
KQPPPSIRL

SEQ ID NO: 172985 - protein, 9 aa, Homo Sapiens
KQPRQDYQL

SEQ ID NO: 172986 - protein, 9 aa, Homo Sapiens
KRIRDAIRM

SEQ ID NO: 172987 - protein, 9 aa, Homo Sapiens
KRPAGPLVL

SEQ ID NO: 172988 - protein, 9 aa, Homo Sapiens
KRPALPVQL

SEQ ID NO: 172989 - protein, 9 aa, Homo Sapiens
KRPELGVTL

SEQ ID NO: 172990 - protein, 9 aa, Homo Sapiens
KRPFGVSLL

SEQ ID NO: 172991 - protein, 9 aa, Homo Sapiens
KRPNAILKL

SEQ ID NO: 172992 - protein, 9 aa, Homo Sapiens
KRPTAEICL

SEQ ID NO: 172993 - protein, 9 aa, Homo Sapiens
KRPVGGFLL

SEQ ID NO: 172994 - protein, 9 aa, Homo Sapiens
KRPYPFVLF

SEQ ID NO: 172995 - protein, 9 aa, Homo Sapiens
KRVEGALNL

SEQ ID NO: 172996 - protein, 9 aa, Homo Sapiens
KSIKNVTEL

SEQ ID NO: 172997 - protein, 9 aa, Homo Sapiens
KSPAIFGVL

SEQ ID NO: 172998 - protein, 9 aa, Homo Sapiens
KSPAITATL

SEQ ID NO: 172999 - protein, 9 aa, Homo Sapiens
KSPASTFAL

SEQ ID NO: 173000 - protein, 9 aa, Homo Sapiens
KSPERFLQL

SEQ ID NO: 173001 - protein, 9 aa, Homo Sapiens
KSPGFGLSL

SEQ ID NO: 173002 - protein, 9 aa, Homo Sapiens
KSPGHMVIL

SEQ ID NO: 173003 - protein, 9 aa, Homo Sapiens
KSPGTANVL

SEQ ID NO: 173004 - protein, 9 aa, Homo Sapiens
KSPNQSLRL

SEQ ID NO: 173005 - protein, 9 aa, Homo Sapiens
KSPQKSTVL

SEQ ID NO: 173006 - protein, 9 aa, Homo Sapiens
KSPSSKPSL

SEQ ID NO: 173007 - protein, 9 aa, Homo Sapiens
KSPVQVILL

SEQ ID NO: 173008 - protein, 9 aa, Homo Sapiens
KSSVKAVIL

SEQ ID NO: 173009 - protein, 9 aa, Homo Sapiens
KSVDDGITL

SEQ ID NO: 173010 - protein, 9 aa, Homo Sapiens
KSVEEKLSL

SEQ ID NO: 173011 - protein, 9 aa, Homo Sapiens
KSVENFVNL

SEQ ID NO: 173012 - protein, 9 aa, Homo Sapiens
KSVKVKIKL

SEQ ID NO: 173013 - protein, 9 aa, Homo Sapiens
KSVVLYVIL

SEQ ID NO: 173014 - protein, 9 aa, Homo Sapiens
KTADKKLLL

SEQ ID NO: 173015 - protein, 9 aa, Homo Sapiens
KTIDGHINL

SEQ ID NO: 173016 - protein, 9 aa, Homo Sapiens
KTIHKYVHL

SEQ ID NO: 173017 - protein, 9 aa, Homo Sapiens
KTILDKVKL

SEQ ID NO: 173018 - protein, 9 aa, Homo Sapiens
KTILDPLTL

SEQ ID NO: 173019 - protein, 9 aa, Homo Sapiens
KTPDSRPSL

SEQ ID NO: 173020 - protein, 9 aa, Homo Sapiens
KTPERYLKI

SEQ ID NO: 173021 - protein, 9 aa, Homo Sapiens
KTPESNIKM

SEQ ID NO: 173022 - protein, 9 aa, Homo Sapiens
KTPLKKFLL

SEQ ID NO: 173023 - protein, 9 aa, Homo Sapiens
KTPMENIGL

SEQ ID NO: 173024 - protein, 9 aa, Homo Sapiens
KTPNFSTLL

SEQ ID NO: 173025 - protein, 9 aa, Homo Sapiens
KTPQYKASL

SEQ ID NO: 173026 - protein, 9 aa, Homo Sapiens
KTPVKFWLL

SEQ ID NO: 173027 - protein, 9 aa, Homo Sapiens
KTSTQKFFL

SEQ ID NO: 173028 - protein, 9 aa, Homo Sapiens
KTVDQHMKL

SEQ ID NO: 173029 - protein, 9 aa, Homo Sapiens
KTVEQHLRL

SEQ ID NO: 173030 - protein, 9 aa, Homo Sapiens
KTVIGKARL

SEQ ID NO: 173031 - protein, 9 aa, Homo Sapiens
KTVNERITL

SEQ ID NO: 173032 - protein, 9 aa, Homo Sapiens
KTVQCKVTL

SEQ ID NO: 173033 - protein, 9 aa, Homo Sapiens
KVIDRKVEL

SEQ ID NO: 173034 - protein, 9 aa, Homo Sapiens
KVIEEAVYF

SEQ ID NO: 173035 - protein, 9 aa, Homo Sapiens
KVIEKRYFL

SEQ ID NO: 173036 - protein, 9 aa, Homo Sapiens
KVIKEAAIL

SEQ ID NO: 173037 - protein, 9 aa, Homo Sapiens
KVISSNTSL

SEQ ID NO: 173038 - protein, 9 aa, Homo Sapiens
KVPAESPTL

SEQ ID NO: 173039 - protein, 9 aa, Homo Sapiens
KVPEKKLKL

SEQ ID NO: 173040 - protein, 9 aa, Homo Sapiens
KVPHDPVAL

SEQ ID NO: 173041 - protein, 9 aa, Homo Sapiens
KVPKERLAL

SEQ ID NO: 173042 - protein, 9 aa, Homo Sapiens
KVPLQYNEL

SEQ ID NO: 173043 - protein, 9 aa, Homo Sapiens
KVPNQYTHL

SEQ ID NO: 173044 - protein, 9 aa, Homo Sapiens
KVPQRALEL

SEQ ID NO: 173045 - protein, 9 aa, Homo Sapiens
KVPVHVIRM

SEQ ID NO: 173046 - protein, 9 aa, Homo Sapiens
KVVITRLKL

SEQ ID NO: 173047 - protein, 9 aa, Homo Sapiens
KVVSQYHEL

SEQ ID NO: 173048 - protein, 9 aa, Homo Sapiens
KVVVHPLVL

SEQ ID NO: 173049 - protein, 9 aa, Homo Sapiens
KWPETPLLL

SEQ ID NO: 173050 - protein, 9 aa, Homo Sapiens
KYIHSANVL

SEQ ID NO: 173051 - protein, 9 aa, Homo Sapiens
KYPDNQVKL

SEQ ID NO: 173052 - protein, 9 aa, Homo Sapiens
KYPENFFLL

SEQ ID NO: 173053 - protein, 9 aa, Homo Sapiens
KYPFIPLLL

SEQ ID NO: 173054 - protein, 9 aa, Homo Sapiens
KYPHYFPLL

SEQ ID NO: 173055 - protein, 9 aa, Homo Sapiens
KYPHYFPVM

SEQ ID NO: 173056 - protein, 9 aa, Homo Sapiens
KYPQAIYTL

SEQ ID NO: 173057 - protein, 9 aa, Homo Sapiens
KYPVHIYRL

SEQ ID NO: 173058 - protein, 9 aa, Homo Sapiens
KYPYVAVML

SEQ ID NO: 173059 - protein, 9 aa, Homo Sapiens
KYVIGTLEL

SEQ ID NO: 173060 - protein, 9 aa, Homo Sapiens
LFPPEPLVL

SEQ ID NO: 173061 - protein, 9 aa, Homo Sapiens
LIIGKKFKL

SEQ ID NO: 173062 - protein, 9 aa, Homo Sapiens
LIVDRPVTL

SEQ ID NO: 173063 - protein, 9 aa, Homo Sapiens
LLPNGKLIL

SEQ ID NO: 173064 - protein, 9 aa, Homo Sapiens
LLVKNKITL

SEQ ID NO: 173065 - protein, 9 aa, Homo Sapiens
LQPATPVTL

SEQ ID NO: 173066 - protein, 9 aa, Homo Sapiens
LRRPLLHEL

SEQ ID NO: 173067 - protein, 9 aa, Homo Sapiens
LRVKDSLLR

SEQ ID NO: 173068 - protein, 9 aa, Homo Sapiens
LSPHKYYFL

SEQ ID NO: 173069 - protein, 9 aa, Homo Sapiens
LSPKEFYEL

SEQ ID NO: 173070 - protein, 9 aa, Homo Sapiens
LSPKSYYEL

SEQ ID NO: 173071 - protein, 9 aa, Homo Sapiens
LTPKFYVAL

SEQ ID NO: 173072 - protein, 9 aa, Homo Sapiens
LVIKGKIEL

SEQ ID NO: 173073 - protein, 9 aa, Homo Sapiens
MAPRTLFLL

SEQ ID NO: 173074 - protein, 9 aa, Homo Sapiens
MFPEMSIHL

SEQ ID NO: 173075 - protein, 9 aa, Homo Sapiens
MLPGLALLL

SEQ ID NO: 173076 - protein, 9 aa, Homo Sapiens
MLPPKKFVL

SEQ ID NO: 173077 - protein, 9 aa, Homo Sapiens
MLPSEPVLL

SEQ ID NO: 173078 - protein, 9 aa, Homo Sapiens
MQIVHKITL

SEQ ID NO: 173079 - protein, 9 aa, Homo Sapiens
MQPTHPIRL

SEQ ID NO: 173080 - protein, 9 aa, Homo Sapiens
MRPRKAFLL

SEQ ID NO: 173081 - protein, 9 aa, Homo Sapiens
MSPNSYIKL

SEQ ID NO: 173082 - protein, 9 aa, Homo Sapiens
NIIAKKIVL

SEQ ID NO: 173083 - protein, 9 aa, Homo Sapiens
NIPAGKPSL

SEQ ID NO: 173084 - protein, 9 aa, Homo Sapiens
NIPPNKIIL

SEQ ID NO: 173085 - protein, 9 aa, Homo Sapiens
NIVANTVLL

SEQ ID NO: 173086 - protein, 9 aa, Homo Sapiens
PLAPAPVFI

SEQ ID NO: 173087 - protein, 9 aa, Homo Sapiens
QAPKDSFAL

SEQ ID NO: 173088 - protein, 9 aa, Homo Sapiens
QFPAEPLEL

SEQ ID NO: 173089 - protein, 9 aa, Homo Sapiens
QFPGGSIDL

SEQ ID NO: 173090 - protein, 9 aa, Homo Sapiens
QFVKDSIRL

SEQ ID NO: 173091 - protein, 9 aa, Homo Sapiens
QIPENGLTL

SEQ ID NO: 173092 - protein, 9 aa, Homo Sapiens
QIVKEKVHL

SEQ ID NO: 173093 - protein, 9 aa, Homo Sapiens
QLIAKKIKL

SEQ ID NO: 173094 - protein, 9 aa, Homo Sapiens
QLIEKRLNL

SEQ ID NO: 173095 - protein, 9 aa, Homo Sapiens
QLPYNGVVL

SEQ ID NO: 173096 - protein, 9 aa, Homo Sapiens
QMPKVHIEF

SEQ ID NO: 173097 - protein, 9 aa, Homo Sapiens
QVIKEKLRL

SEQ ID NO: 173098 - protein, 9 aa, Homo Sapiens
RAIQKKIDL

SEQ ID NO: 173099 - protein, 9 aa, Homo Sapiens
RAPAQNPEL

SEQ ID NO: 173100 - protein, 9 aa, Homo Sapiens
RAPPPPPLL

SEQ ID NO: 173101 - protein, 9 aa, Homo Sapiens
RAVLEKLKL

SEQ ID NO: 173102 - protein, 9 aa, Homo Sapiens
RCIKETLRL

SEQ ID NO: 173103 - protein, 9 aa, Homo Sapiens
RCIQEFISL

SEQ ID NO: 173104 - protein, 9 aa, Homo Sapiens
RFPDENFKL

SEQ ID NO: 173105 - protein, 9 aa, Homo Sapiens
RFPDENFTL

SEQ ID NO: 173106 - protein, 9 aa, Homo Sapiens
RFPDLTVEL

SEQ ID NO: 173107 - protein, 9 aa, Homo Sapiens
RFPFSRPEL

SEQ ID NO: 173108 - protein, 9 aa, Homo Sapiens
RFPHDKLLL

SEQ ID NO: 173109 - protein, 9 aa, Homo Sapiens
RFPHHDNEL

SEQ ID NO: 173110 - protein, 9 aa, Homo Sapiens
RFPKAPSKL

SEQ ID NO: 173111 - protein, 9 aa, Homo Sapiens
RFPSTAIKI

SEQ ID NO: 173112 - protein, 9 aa, Homo Sapiens
RFPTQHQRL

SEQ ID NO: 173113 - protein, 9 aa, Homo Sapiens
RGISEFIVM

SEQ ID NO: 173114 - protein, 9 aa, Homo Sapiens
RGPAHKLAL

SEQ ID NO: 173115 - protein, 9 aa, Homo Sapiens
RGPLAKIWL

SEQ ID NO: 173116 - protein, 9 aa, Homo Sapiens
RGPLKCVKL

SEQ ID NO: 173117 - protein, 9 aa, Homo Sapiens
RGPPARVTL

SEQ ID NO: 173118 - protein, 9 aa, Homo Sapiens
RGPPKGILL

SEQ ID NO: 173119 - protein, 9 aa, Homo Sapiens
RGPPQRPKL

SEQ ID NO: 173120 - protein, 9 aa, Homo Sapiens
RGPSHPLDL

SEQ ID NO: 173121 - protein, 9 aa, Homo Sapiens
RGVDNKIRL

SEQ ID NO: 173122 - protein, 9 aa, Homo Sapiens
RHPASSVAL

SEQ ID NO: 173123 - protein, 9 aa, Homo Sapiens
RHPKYKTEL

SEQ ID NO: 173124 - protein, 9 aa, Homo Sapiens
RHPQRNFIL

SEQ ID NO: 173125 - protein, 9 aa, Homo Sapiens
RHPREVVIL

SEQ ID NO: 173126 - protein, 9 aa, Homo Sapiens
RHPSQTVEL

SEQ ID NO: 173127 - protein, 9 aa, Homo Sapiens
RHPSTNSLL

SEQ ID NO: 173128 - protein, 9 aa, Homo Sapiens
RIAEFTTNL

SEQ ID NO: 173129 - protein, 9 aa, Homo Sapiens
RIAEYAFKL

SEQ ID NO: 173130 - protein, 9 aa, Homo Sapiens
RIAIEKIRL

SEQ ID NO: 173131 - protein, 9 aa, Homo Sapiens
RIAKESINF

SEQ ID NO: 173132 - protein, 9 aa, Homo Sapiens
RIAPRPYRL

SEQ ID NO: 173133 - protein, 9 aa, Homo Sapiens
RIAQLRFLL

SEQ ID NO: 173134 - protein, 9 aa, Homo Sapiens
RIIDCAFTV

SEQ ID NO: 173135 - protein, 9 aa, Homo Sapiens
RIIHDSLQL

SEQ ID NO: 173136 - protein, 9 aa, Homo Sapiens
RIIKETQRL

SEQ ID NO: 173137 - protein, 9 aa, Homo Sapiens
RIIPRHLQL

SEQ ID NO: 173138 - protein, 9 aa, Homo Sapiens
RIIPYLLRL

SEQ ID NO: 173139 - protein, 9 aa, Homo Sapiens
RIIQDRVSL

SEQ ID NO: 173140 - protein, 9 aa, Homo Sapiens
RIIRKVVKL

SEQ ID NO: 173141 - protein, 9 aa, Homo Sapiens
RIISGHIDL

SEQ ID NO: 173142 - protein, 9 aa, Homo Sapiens
RILASPVEL

SEQ ID NO: 173143 - protein, 9 aa, Homo Sapiens
RIPAEVLIL

SEQ ID NO: 173144 - protein, 9 aa, Homo Sapiens
RIPAHRLVL

SEQ ID NO: 173145 - protein, 9 aa, Homo Sapiens
RIPATPVVI

SEQ ID NO: 173146 - protein, 9 aa, Homo Sapiens
RIPAVRTVL

SEQ ID NO: 173147 - protein, 9 aa, Homo Sapiens
RIPAYFVTV

SEQ ID NO: 173148 - protein, 9 aa, Homo Sapiens
RIPKEQGVL

SEQ ID NO: 173149 - protein, 9 aa, Homo Sapiens
RIPNRGIDL

SEQ ID NO: 173150 - protein, 9 aa, Homo Sapiens
RIPPIAARL

SEQ ID NO: 173151 - protein, 9 aa, Homo Sapiens
RIPPSYVKM

SEQ ID NO: 173152 - protein, 9 aa, Homo Sapiens
RIPPVAVRL

SEQ ID NO: 173153 - protein, 9 aa, Homo Sapiens
RIPRVFSWL

SEQ ID NO: 173154 - protein, 9 aa, Homo Sapiens
RIPSFVTEL

SEQ ID NO: 173155 - protein, 9 aa, Homo Sapiens
RIPTISTQL

SEQ ID NO: 173156 - protein, 9 aa, Homo Sapiens
RISELRLIL

SEQ ID NO: 173157 - protein, 9 aa, Homo Sapiens
RISLNTLTL

SEQ ID NO: 173158 - protein, 9 aa, Homo Sapiens
RISNPPILL

SEQ ID NO: 173159 - protein, 9 aa, Homo Sapiens
RISVLPAYL

SEQ ID NO: 173160 - protein, 9 aa, Homo Sapiens
RITDKGLEL

SEQ ID NO: 173161 - protein, 9 aa, Homo Sapiens
RITPRHLQL

SEQ ID NO: 173162 - protein, 9 aa, Homo Sapiens
RIVAHAVEV

SEQ ID NO: 173163 - protein, 9 aa, Homo Sapiens
RIVDVRPTL

SEQ ID NO: 173164 - protein, 9 aa, Homo Sapiens
RIVLHSLDL

SEQ ID NO: 173165 - protein, 9 aa, Homo Sapiens
RIVPEPVQF

SEQ ID NO: 173166 - protein, 9 aa, Homo Sapiens
RIVQATTLL

SEQ ID NO: 173167 - protein, 9 aa, Homo Sapiens
RIVSQLLTL

SEQ ID NO: 173168 - protein, 9 aa, Homo Sapiens
RIVTGNFIL

SEQ ID NO: 173169 - protein, 9 aa, Homo Sapiens
RIVVEHIIM

SEQ ID NO: 173170 - protein, 9 aa, Homo Sapiens
RIYPHGLVL

SEQ ID NO: 173171 - protein, 9 aa, Homo Sapiens
RKIKGVIEL

SEQ ID NO: 173172 - protein, 9 aa, Homo Sapiens
RKPDSKIVL

SEQ ID NO: 173173 - protein, 9 aa, Homo Sapiens
RKPPTSIRL

SEQ ID NO: 173174 - protein, 9 aa, Homo Sapiens
RLAQEAVTL

SEQ ID NO: 173175 - protein, 9 aa, Homo Sapiens
RLHLPPVRL

SEQ ID NO: 173176 - protein, 9 aa, Homo Sapiens
RLIAQRYLL

SEQ ID NO: 173177 - protein, 9 aa, Homo Sapiens
RLIERKSDL

SEQ ID NO: 173178 - protein, 9 aa, Homo Sapiens
RLINQVLEL

SEQ ID NO: 173179 - protein, 9 aa, Homo Sapiens
RLIPNAIQV

SEQ ID NO: 173180 - protein, 9 aa, Homo Sapiens
RLIQEAAVL

SEQ ID NO: 173181 - protein, 9 aa, Homo Sapiens
RLLKSKLYL

SEQ ID NO: 173182 - protein, 9 aa, Homo Sapiens
RLLLLPLLL

SEQ ID NO: 173183 - protein, 9 aa, Homo Sapiens
RLPAWQPIL

SEQ ID NO: 173184 - protein, 9 aa, Homo Sapiens
RLPDEKVEL

SEQ ID NO: 173185 - protein, 9 aa, Homo Sapiens
RLPDGRVVL

SEQ ID NO: 173186 - protein, 9 aa, Homo Sapiens
RLPDQFSKL

SEQ ID NO: 173187 - protein, 9 aa, Homo Sapiens
RLPDVQLWL

SEQ ID NO: 173188 - protein, 9 aa, Homo Sapiens
RLPEIYIQL

SEQ ID NO: 173189 - protein, 9 aa, Homo Sapiens
RLPFKRLNL

SEQ ID NO: 173190 - protein, 9 aa, Homo Sapiens
RLPGDCFLL

SEQ ID NO: 173191 - protein, 9 aa, Homo Sapiens
RLPHHSAIL

SEQ ID NO: 173192 - protein, 9 aa, Homo Sapiens
RLPKDFVDL

SEQ ID NO: 173193 - protein, 9 aa, Homo Sapiens
RLPLISVAL

SEQ ID NO: 173194 - protein, 9 aa, Homo Sapiens
RLPPATLTL

SEQ ID NO: 173195 - protein, 9 aa, Homo Sapiens
RLPPPFPGL

SEQ ID NO: 173196 - protein, 9 aa, Homo Sapiens
RLPPTPLLL

SEQ ID NO: 173197 - protein, 9 aa, Homo Sapiens
RLPPYSSQL

SEQ ID NO: 173198 - protein, 9 aa, Homo Sapiens
RLPQYQTDL

SEQ ID NO: 173199 - protein, 9 aa, Homo Sapiens
RLPQYYIVV

SEQ ID NO: 173200 - protein, 9 aa, Homo Sapiens
RLPSGKVGF

SEQ ID NO: 173201 - protein, 9 aa, Homo Sapiens
RLPSVALLL

SEQ ID NO: 173202 - protein, 9 aa, Homo Sapiens
RLPTVLLKL

SEQ ID NO: 173203 - protein, 9 aa, Homo Sapiens
RLPVEKIEI

SEQ ID NO: 173204 - protein, 9 aa, Homo Sapiens
RLVADKLIF

SEQ ID NO: 173205 - protein, 9 aa, Homo Sapiens
RLVESKVEL

SEQ ID NO: 173206 - protein, 9 aa, Homo Sapiens
RLVHVAVEM

SEQ ID NO: 173207 - protein, 9 aa, Homo Sapiens
RLVINRLKL

SEQ ID NO: 173208 - protein, 9 aa, Homo Sapiens
RLVKEYTVL

SEQ ID NO: 173209 - protein, 9 aa, Homo Sapiens
RLVKVKVLL

SEQ ID NO: 173210 - protein, 9 aa, Homo Sapiens
RLVLDSVKL

SEQ ID NO: 173211 - protein, 9 aa, Homo Sapiens
RLVPFLVEL

SEQ ID NO: 173212 - protein, 9 aa, Homo Sapiens
RMIKPRIVL

SEQ ID NO: 173213 - protein, 9 aa, Homo Sapiens
RMPAEIVVL

SEQ ID NO: 173214 - protein, 9 aa, Homo Sapiens
RMPCHKPYL

SEQ ID NO: 173215 - protein, 9 aa, Homo Sapiens
RMPDGPVAL

SEQ ID NO: 173216 - protein, 9 aa, Homo Sapiens
RMPPRSVLL

SEQ ID NO: 173217 - protein, 9 aa, Homo Sapiens
RMPRCGIRL

SEQ ID NO: 173218 - protein, 9 aa, Homo Sapiens
RMPRWAERL

SEQ ID NO: 173219 - protein, 9 aa, Homo Sapiens
RMVASKMEL

SEQ ID NO: 173220 - protein, 9 aa, Homo Sapiens
RNIPETLEL

SEQ ID NO: 173221 - protein, 9 aa, Homo Sapiens
RNIVKKFLM

SEQ ID NO: 173222 - protein, 9 aa, Homo Sapiens
RNPKNYLSL

SEQ ID NO: 173223 - protein, 9 aa, Homo Sapiens
RNPQSYLYL

SEQ ID NO: 173224 - protein, 9 aa, Homo Sapiens
RPRGLGPLR

SEQ ID NO: 173225 - protein, 9 aa, Homo Sapiens
RQIPWKLGL

SEQ ID NO: 173226 - protein, 9 aa, Homo Sapiens
RQPEFRAVL

SEQ ID NO: 173227 - protein, 9 aa, Homo Sapiens
RQPGHTIYL

SEQ ID NO: 173228 - protein, 9 aa, Homo Sapiens
RQPIQMIVL

SEQ ID NO: 173229 - protein, 9 aa, Homo Sapiens
RQPNPPLIL

SEQ ID NO: 173230 - protein, 9 aa, Homo Sapiens
RQPPESLKL

SEQ ID NO: 173231 - protein, 9 aa, Homo Sapiens
RQPSLFYHL

SEQ ID NO: 173232 - protein, 9 aa, Homo Sapiens
RQPVDAVKL

SEQ ID NO: 173233 - protein, 9 aa, Homo Sapiens
RQPYAVSEL

SEQ ID NO: 173234 - protein, 9 aa, Homo Sapiens
RQPYSRFLL

SEQ ID NO: 173235 - protein, 9 aa, Homo Sapiens
RQVASHVGL

SEQ ID NO: 173236 - protein, 9 aa, Homo Sapiens
RQVDSHVEL

SEQ ID NO: 173237 - protein, 9 aa, Homo Sapiens
RRPLFALLL

SEQ ID NO: 173238 - protein, 9 aa, Homo Sapiens
RRPLHTVVL

SEQ ID NO: 173239 - protein, 9 aa, Homo Sapiens
RRPNCGIRL

SEQ ID NO: 173240 - protein, 9 aa, Homo Sapiens
RRPYKPIAL

SEQ ID NO: 173241 - protein, 9 aa, Homo Sapiens
RRPYVRVEL

SEQ ID NO: 173242 - protein, 9 aa, Homo Sapiens
RRVEEALVL

SEQ ID NO: 173243 - protein, 9 aa, Homo Sapiens
RSIFDHIKL

SEQ ID NO: 173244 - protein, 9 aa, Homo Sapiens
RSPAGSPEL

SEQ ID NO: 173245 - protein, 9 aa, Homo Sapiens
RSPALQILL

SEQ ID NO: 173246 - protein, 9 aa, Homo Sapiens
RSPDRNLLL

SEQ ID NO: 173247 - protein, 9 aa, Homo Sapiens
RSPEEVTEL

SEQ ID NO: 173248 - protein, 9 aa, Homo Sapiens
RSPFSFVYL

SEQ ID NO: 173249 - protein, 9 aa, Homo Sapiens
RSPGRAYAL

SEQ ID NO: 173250 - protein, 9 aa, Homo Sapiens
RSPKLFVVF

SEQ ID NO: 173251 - protein, 9 aa, Homo Sapiens
RSPMHRVTL

SEQ ID NO: 173252 - protein, 9 aa, Homo Sapiens
RSPPIKPLL

SEQ ID NO: 173253 - protein, 9 aa, Homo Sapiens
RSPPRALVL

SEQ ID NO: 173254 - protein, 9 aa, Homo Sapiens
RSPRTLVTL

SEQ ID NO: 173255 - protein, 9 aa, Homo Sapiens
RSPSKNIYL

SEQ ID NO: 173256 - protein, 9 aa, Homo Sapiens
RSPTAWHRL

SEQ ID NO: 173257 - protein, 9 aa, Homo Sapiens
RSPTKAPHL

SEQ ID NO: 173258 - protein, 9 aa, Homo Sapiens
RSPVTKIML

SEQ ID NO: 173259 - protein, 9 aa, Homo Sapiens
RSPVYLTVL

SEQ ID NO: 173260 - protein, 9 aa, Homo Sapiens
RSVKVKIKL

SEQ ID NO: 173261 - protein, 9 aa, Homo Sapiens
RTAKGKPVL

SEQ ID NO: 173262 - protein, 9 aa, Homo Sapiens
RTIAKRLVL

SEQ ID NO: 173263 - protein, 9 aa, Homo Sapiens
RTIARTIVL

SEQ ID NO: 173264 - protein, 9 aa, Homo Sapiens
RTPPEAIAL

SEQ ID NO: 173265 - protein, 9 aa, Homo Sapiens
RTPSGKLRL

SEQ ID NO: 173266 - protein, 9 aa, Homo Sapiens
RTPYHVNLL

SEQ ID NO: 173267 - protein, 9 aa, Homo Sapiens
RTVDARLKL

SEQ ID NO: 173268 - protein, 9 aa, Homo Sapiens
RTVRQHLNL

SEQ ID NO: 173269 - protein, 9 aa, Homo Sapiens
RVAIKKIVL

SEQ ID NO: 173270 - protein, 9 aa, Homo Sapiens
RVIDYILDL

SEQ ID NO: 173271 - protein, 9 aa, Homo Sapiens
RVIGPPVVL

SEQ ID NO: 173272 - protein, 9 aa, Homo Sapiens
RVIKNSIRL

SEQ ID NO: 173273 - protein, 9 aa, Homo Sapiens
RVPAHAVVV

SEQ ID NO: 173274 - protein, 9 aa, Homo Sapiens
RVPAHRNLL

SEQ ID NO: 173275 - protein, 9 aa, Homo Sapiens
RVPATNLIL

SEQ ID NO: 173276 - protein, 9 aa, Homo Sapiens
RVPKDRPSL

SEQ ID NO: 173277 - protein, 9 aa, Homo Sapiens
RVPKSKLEV

SEQ ID NO: 173278 - protein, 9 aa, Homo Sapiens
RVPKWIIAL

SEQ ID NO: 173279 - protein, 9 aa, Homo Sapiens
RVPMEVVLL

SEQ ID NO: 173280 - protein, 9 aa, Homo Sapiens
RVPNISVHL

SEQ ID NO: 173281 - protein, 9 aa, Homo Sapiens
RVPNSVLWL

SEQ ID NO: 173282 - protein, 9 aa, Homo Sapiens
RVPNVRVLL

SEQ ID NO: 173283 - protein, 9 aa, Homo Sapiens
RVPQEAVKL

SEQ ID NO: 173284 - protein, 9 aa, Homo Sapiens
RVPSALVTL

SEQ ID NO: 173285 - protein, 9 aa, Homo Sapiens
RVPTASYDL

SEQ ID NO: 173286 - protein, 9 aa, Homo Sapiens
RVSKKNIFL

SEQ ID NO: 173287 - protein, 9 aa, Homo Sapiens
RVTRSTLVL

SEQ ID NO: 173288 - protein, 9 aa, Homo Sapiens
RVVAQVLTL

SEQ ID NO: 173289 - protein, 9 aa, Homo Sapiens
RVVDNPIYL

SEQ ID NO: 173290 - protein, 9 aa, Homo Sapiens
RVVDQPLKL

SEQ ID NO: 173291 - protein, 9 aa, Homo Sapiens
RVVLKRVLL

SEQ ID NO: 173292 - protein, 9 aa, Homo Sapiens
RYIANTVEL

SEQ ID NO: 173293 - protein, 9 aa, Homo Sapiens
RYPCFFNTL

SEQ ID NO: 173294 - protein, 9 aa, Homo Sapiens
RYPDPLIKV

SEQ ID NO: 173295 - protein, 9 aa, Homo Sapiens
RYPEETLSL

SEQ ID NO: 173296 - protein, 9 aa, Homo Sapiens
RYPPAANEL

SEQ ID NO: 173297 - protein, 9 aa, Homo Sapiens
RYPPDSVRL

SEQ ID NO: 173298 - protein, 9 aa, Homo Sapiens
RYPRESNKL

SEQ ID NO: 173299 - protein, 9 aa, Homo Sapiens
RYPTSIASL

SEQ ID NO: 173300 - protein, 9 aa, Homo Sapiens
RYPTTFVMV

SEQ ID NO: 173301 - protein, 9 aa, Homo Sapiens
SAPAKKIKL

SEQ ID NO: 173302 - protein, 9 aa, Homo Sapiens
SFPCHQTKL

SEQ ID NO: 173303 - protein, 9 aa, Homo Sapiens
SFPIYKVLF

SEQ ID NO: 173304 - protein, 9 aa, Homo Sapiens
SFPLVTVHL

SEQ ID NO: 173305 - protein, 9 aa, Homo Sapiens
SFPSEPVKL

SEQ ID NO: 173306 - protein, 9 aa, Homo Sapiens
SFPTQPVNL

SEQ ID NO: 173307 - protein, 9 aa, Homo Sapiens
SIIADRIAL

SEQ ID NO: 173308 - protein, 9 aa, Homo Sapiens
SIIAMGNTL

SEQ ID NO: 173309 - protein, 9 aa, Homo Sapiens
SIIDDRVIL

SEQ ID NO: 173310 - protein, 9 aa, Homo Sapiens
SIPKDKQML

SEQ ID NO: 173311 - protein, 9 aa, Homo Sapiens
SIPKDSLRM

SEQ ID NO: 173312 - protein, 9 aa, Homo Sapiens
SIPKISIDL

SEQ ID NO: 173313 - protein, 9 aa, Homo Sapiens
SIPTKALEL

SEQ ID NO: 173314 - protein, 9 aa, Homo Sapiens
SITERALKL

SEQ ID NO: 173315 - protein, 9 aa, Homo Sapiens
SITKNTAKL

SEQ ID NO: 173316 - protein, 9 aa, Homo Sapiens
SLIGEKVCL

SEQ ID NO: 173317 - protein, 9 aa, Homo Sapiens
SLIKHKIML

SEQ ID NO: 173318 - protein, 9 aa, Homo Sapiens
SLIVGGVDL

SEQ ID NO: 173319 - protein, 9 aa, Homo Sapiens
SLPDIKVYL

SEQ ID NO: 173320 - protein, 9 aa, Homo Sapiens
SLPGVALTL

SEQ ID NO: 173321 - protein, 9 aa, Homo Sapiens
SLPKPTIIL

SEQ ID NO: 173322 - protein, 9 aa, Homo Sapiens
SLPKTKLSL

SEQ ID NO: 173323 - protein, 9 aa, Homo Sapiens
SLPPGTVKL

SEQ ID NO: 173324 - protein, 9 aa, Homo Sapiens
SLPRFQVTL

SEQ ID NO: 173325 - protein, 9 aa, Homo Sapiens
SLPSTKPQL

SEQ ID NO: 173326 - protein, 9 aa, Homo Sapiens
SLPSWKSLL

SEQ ID NO: 173327 - protein, 9 aa, Homo Sapiens
SLRLPGLLL

SEQ ID NO: 173328 - protein, 9 aa, Homo Sapiens
SLTIDKLLL

SEQ ID NO: 173329 - protein, 9 aa, Homo Sapiens
SMAPGALLL

SEQ ID NO: 173330 - protein, 9 aa, Homo Sapiens
SMPDHSIHL

SEQ ID NO: 173331 - protein, 9 aa, Homo Sapiens
SMPKLFLHL

SEQ ID NO: 173332 - protein, 9 aa, Homo Sapiens
SNIYSKFLL

SEQ ID NO: 173333 - protein, 9 aa, Homo Sapiens
SRPGKNVQL

SEQ ID NO: 173334 - protein, 9 aa, Homo Sapiens
SRPKSNIVL

SEQ ID NO: 173335 - protein, 9 aa, Homo Sapiens
SRPLSAVVL

SEQ ID NO: 173336 - protein, 9 aa, Homo Sapiens
SRPRSSLSL

SEQ ID NO: 173337 - protein, 9 aa, Homo Sapiens
SSAPGPLEL

SEQ ID NO: 173338 - protein, 9 aa, Homo Sapiens
SSIKDKIVL

SEQ ID NO: 173339 - protein, 9 aa, Homo Sapiens
SSPGQAVEL

SEQ ID NO: 173340 - protein, 9 aa, Homo Sapiens
STPKHYIRF

SEQ ID NO: 173341 - protein, 9 aa, Homo Sapiens
STPTEKPKL

SEQ ID NO: 173342 - protein, 9 aa, Homo Sapiens
STVTTKVTL

SEQ ID NO: 173343 - protein, 9 aa, Homo Sapiens
SVIPDKPSL

SEQ ID NO: 173344 - protein, 9 aa, Homo Sapiens
SVIYKKFQL

SEQ ID NO: 173345 - protein, 9 aa, Homo Sapiens
SVPKHKLTL

SEQ ID NO: 173346 - protein, 9 aa, Homo Sapiens
SVPLAYFLL

SEQ ID NO: 173347 - protein, 9 aa, Homo Sapiens
SVVKGRLHL

SEQ ID NO: 173348 - protein, 9 aa, Homo Sapiens
SYPHHATQL

SEQ ID NO: 173349 - protein, 9 aa, Homo Sapiens
TAIRGAIIL

SEQ ID NO: 173350 - protein, 9 aa, Homo Sapiens
TFPNNPVEL

SEQ ID NO: 173351 - protein, 9 aa, Homo Sapiens
TFPQNPVEL

SEQ ID NO: 173352 - protein, 9 aa, Homo Sapiens
TFPVHRQKL

SEQ ID NO: 173353 - protein, 9 aa, Homo Sapiens
TIIANCIVL

SEQ ID NO: 173354 - protein, 9 aa, Homo Sapiens
TIIKDCLYL

SEQ ID NO: 173355 - protein, 9 aa, Homo Sapiens
TIIKEQFAL

SEQ ID NO: 173356 - protein, 9 aa, Homo Sapiens
TIILSKMML

SEQ ID NO: 173357 - protein, 9 aa, Homo Sapiens
TLIGSKFRL

SEQ ID NO: 173358 - protein, 9 aa, Homo Sapiens
TLPAITLKL

SEQ ID NO: 173359 - protein, 9 aa, Homo Sapiens
TLPPQKPEL

SEQ ID NO: 173360 - protein, 9 aa, Homo Sapiens
TLVKNCIVL

SEQ ID NO: 173361 - protein, 9 aa, Homo Sapiens
TMPPTTVIL

SEQ ID NO: 173362 - protein, 9 aa, Homo Sapiens
TMVKKKVVF

SEQ ID NO: 173363 - protein, 9 aa, Homo Sapiens
TNVINKIIL

SEQ ID NO: 173364 - protein, 9 aa, Homo Sapiens
TQPERYIHL

SEQ ID NO: 173365 - protein, 9 aa, Homo Sapiens
TRPEKALIL

SEQ ID NO: 173366 - protein, 9 aa, Homo Sapiens
TSPKQSVYL

SEQ ID NO: 173367 - protein, 9 aa, Homo Sapiens
TTPKHYIRF

SEQ ID NO: 173368 - protein, 9 aa, Homo Sapiens
TYPGPAVVL

SEQ ID NO: 173369 - protein, 9 aa, Homo Sapiens
VFPHLTVVL

SEQ ID NO: 173370 - protein, 9 aa, Homo Sapiens
VFPKEPVEL

SEQ ID NO: 173371 - protein, 9 aa, Homo Sapiens
VFPSMPIKL

SEQ ID NO: 173372 - protein, 9 aa, Homo Sapiens
VIAPNPAQL

SEQ ID NO: 173373 - protein, 9 aa, Homo Sapiens
VIAPPLIKF

SEQ ID NO: 173374 - protein, 9 aa, Homo Sapiens
VIIKQGCLL

SEQ ID NO: 173375 - protein, 9 aa, Homo Sapiens
VIPKSKFVL

SEQ ID NO: 173376 - protein, 9 aa, Homo Sapiens
VIPPFCNLL

SEQ ID NO: 173377 - protein, 9 aa, Homo Sapiens
VIPPGSVLL

SEQ ID NO: 173378 - protein, 9 aa, Homo Sapiens
VIPSTGIKL

SEQ ID NO: 173379 - protein, 9 aa, Homo Sapiens
VIVAGGVEL

SEQ ID NO: 173380 - protein, 9 aa, Homo Sapiens
VLPKLYVKL

SEQ ID NO: 173381 - protein, 9 aa, Homo Sapiens
VLPKSRVEL

SEQ ID NO: 173382 - protein, 9 aa, Homo Sapiens
VLPNTALHL

SEQ ID NO: 173383 - protein, 9 aa, Homo Sapiens
VLPPEPVQL

SEQ ID NO: 173384 - protein, 9 aa, Homo Sapiens
VLPPTCIQL

SEQ ID NO: 173385 - protein, 9 aa, Homo Sapiens
VMAPRTLFL

SEQ ID NO: 173386 - protein, 9 aa, Homo Sapiens
VMPPQPVVL

SEQ ID NO: 173387 - protein, 9 aa, Homo Sapiens
VQPSKYHFL

SEQ ID NO: 173388 - protein, 9 aa, Homo Sapiens
VSPKKSTVL

SEQ ID NO: 173389 - protein, 9 aa, Homo Sapiens
VSPRQTLEL

SEQ ID NO: 173390 - protein, 9 aa, Homo Sapiens
VTIKKALTL

SEQ ID NO: 173391 - protein, 9 aa, Homo Sapiens
VVAKDGLKL

SEQ ID NO: 173392 - protein, 9 aa, Homo Sapiens
VVAPAGITL

SEQ ID NO: 173393 - protein, 9 aa, Homo Sapiens
VVPKDRVAL

SEQ ID NO: 173394 - protein, 10 aa, Homo Sapiens
ALAQAHLPRL

SEQ ID NO: 173395 - protein, 10 aa, Homo Sapiens
ALRGLERLLL

SEQ ID NO: 173396 - protein, 10 aa, Homo Sapiens
EGFPKVSILL

SEQ ID NO: 173397 - protein, 10 aa, Homo Sapiens
FSFPCHQTKL

SEQ ID NO: 173398 - protein, 10 aa, Homo Sapiens
GGIKLHKNLL

SEQ ID NO: 173399 - protein, 10 aa, Homo Sapiens
ISLPRGKGIR

SEQ ID NO: 173400 - protein, 10 aa, Homo Sapiens
KAPKPGGLSL

SEQ ID NO: 173401 - protein, 10 aa, Homo Sapiens
KFPAYERVLL

SEQ ID NO: 173402 - protein, 10 aa, Homo Sapiens
KFPEIVAPLL

SEQ ID NO: 173403 - protein, 10 aa, Homo Sapiens
KFPQIGELIL

SEQ ID NO: 173404 - protein, 10 aa, Homo Sapiens
KFPSPPAFIF

SEQ ID NO: 173405 - protein, 10 aa, Homo Sapiens
KIGPITPLEF

SEQ ID NO: 173406 - protein, 10 aa, Homo Sapiens
KIIAENKIRL

SEQ ID NO: 173407 - protein, 10 aa, Homo Sapiens
KIIDRAITSL

SEQ ID NO: 173408 - protein, 10 aa, Homo Sapiens
KIIEARLKMY

SEQ ID NO: 173409 - protein, 10 aa, Homo Sapiens
KIIEDLGVHF

SEQ ID NO: 173410 - protein, 10 aa, Homo Sapiens
KIIKNKKAFL

SEQ ID NO: 173411 - protein, 10 aa, Homo Sapiens
KIPSSHPVSL

SEQ ID NO: 173412 - protein, 10 aa, Homo Sapiens
KIPTLKISLI

SEQ ID NO: 173413 - protein, 10 aa, Homo Sapiens
KISSVQPICL

SEQ ID NO: 173414 - protein, 10 aa, Homo Sapiens
KLAPPLVTLL

SEQ ID NO: 173415 - protein, 10 aa, Homo Sapiens
KLLKCSRLVL

SEQ ID NO: 173416 - protein, 10 aa, Homo Sapiens
KLPAEPPALL

SEQ ID NO: 173417 - protein, 10 aa, Homo Sapiens
KLPATEKPVL

SEQ ID NO: 173418 - protein, 10 aa, Homo Sapiens
KLPGDKGLVL

SEQ ID NO: 173419 - protein, 10 aa, Homo Sapiens
KLPKDTALLL

SEQ ID NO: 173420 - protein, 10 aa, Homo Sapiens
KLPPGFPVKL

SEQ ID NO: 173421 - protein, 10 aa, Homo Sapiens
KLPRHHPLVL

SEQ ID NO: 173422 - protein, 10 aa, Homo Sapiens
KLWPLPKALL

SEQ ID NO: 173423 - protein, 10 aa, Homo Sapiens
KTLDQAKAVL

SEQ ID NO: 173424 - protein, 10 aa, Homo Sapiens
KVPKERLALL

SEQ ID NO: 173425 - protein, 10 aa, Homo Sapiens
KVPPPWLIAM

SEQ ID NO: 173426 - protein, 10 aa, Homo Sapiens
KYFSGPAITL

SEQ ID NO: 173427 - protein, 10 aa, Homo Sapiens
KYVGSRPIKL

SEQ ID NO: 173428 - protein, 10 aa, Homo Sapiens
LRANGLLKII

SEQ ID NO: 173429 - protein, 10 aa, Homo Sapiens
NSSRLEPLVL

SEQ ID NO: 173430 - protein, 10 aa, Homo Sapiens
PLSMAPPLSL

SEQ ID NO: 173431 - protein, 10 aa, Homo Sapiens
PSFPVSTLKL

SEQ ID NO: 173432 - protein, 10 aa, Homo Sapiens
QSYPHHATQL

SEQ ID NO: 173433 - protein, 10 aa, Homo Sapiens
RFPGQLNADL

SEQ ID NO: 173434 - protein, 10 aa, Homo Sapiens
RFPNFTNQLL

SEQ ID NO: 173435 - protein, 10 aa, Homo Sapiens
RHPQPGAVEL

SEQ ID NO: 173436 - protein, 10 aa, Homo Sapiens
RIINLGPVML

SEQ ID NO: 173437 - protein, 10 aa, Homo Sapiens
RIPAEGRVAL

SEQ ID NO: 173438 - protein, 10 aa, Homo Sapiens
RISQLDALEL

SEQ ID NO: 173439 - protein, 10 aa, Homo Sapiens
RLGNIARLEL

SEQ ID NO: 173440 - protein, 10 aa, Homo Sapiens
RLPYKAGLSL

SEQ ID NO: 173441 - protein, 10 aa, Homo Sapiens
RLYPLRKYAV

SEQ ID NO: 173442 - protein, 10 aa, Homo Sapiens
RMDPLEAIQL

SEQ ID NO: 173443 - protein, 10 aa, Homo Sapiens
RRPKNVVLRL

SEQ ID NO: 173444 - protein, 10 aa, Homo Sapiens
RTLGLPALLL

SEQ ID NO: 173445 - protein, 10 aa, Homo Sapiens
RTPGNRIVYL

SEQ ID NO: 173446 - protein, 10 aa, Homo Sapiens
RVAGLQPVLL

SEQ ID NO: 173447 - protein, 10 aa, Homo Sapiens
RVPHTQAVVL

SEQ ID NO: 173448 - protein, 10 aa, Homo Sapiens
RYPVNSVNIL

SEQ ID NO: 173449 - protein, 10 aa, Homo Sapiens
SLKTVKPLSL

SEQ ID NO: 173450 - protein, 10 aa, Homo Sapiens
SLQHLTWLGL

SEQ ID NO: 173451 - protein, 10 aa, Homo Sapiens
SLQYLTPLIL

SEQ ID NO: 173452 - protein, 10 aa, Homo Sapiens
SLRDLPAQLL

SEQ ID NO: 173453 - protein, 10 aa, Homo Sapiens
SSIIADRIAL

SEQ ID NO: 173454 - protein, 10 aa, Homo Sapiens
SVAQVAPVDL

SEQ ID NO: 173455 - protein, 10 aa, Homo Sapiens
SVASVRPAVL

SEQ ID NO: 173456 - protein, 10 aa, Homo Sapiens
SVVGLKYLLL

SEQ ID NO: 173457 - protein, 10 aa, Homo Sapiens
SYRVVFPLEL

SEQ ID NO: 173458 - protein, 10 aa, Homo Sapiens
THPPGPAVQL

SEQ ID NO: 173459 - protein, 10 aa, Homo Sapiens
TLDGLPPLRL

SEQ ID NO: 173460 - protein, 11 aa, Homo Sapiens
KFPGPLENQRL

SEQ ID NO: 173461 - protein, 11 aa, Homo Sapiens
KFPSEYVPTVF

SEQ ID NO: 173462 - protein, 11 aa, Homo Sapiens
KIATPKVKNQL

SEQ ID NO: 173463 - protein, 11 aa, Homo Sapiens
KIIAGSVALFL

SEQ ID NO: 173464 - protein, 11 aa, Homo Sapiens
KIIEDLGVHFL

SEQ ID NO: 173465 - protein, 11 aa, Homo Sapiens
KIPSKELRVRL

SEQ ID NO: 173466 - protein, 11 aa, Homo Sapiens
KLGRHVRALVL

SEQ ID NO: 173467 - protein, 11 aa, Homo Sapiens
KLPATEKPVLL

SEQ ID NO: 173468 - protein, 11 aa, Homo Sapiens
KLPPTDAYYKL

SEQ ID NO: 173469 - protein, 11 aa, Homo Sapiens
KLPSGKLQVHL

SEQ ID NO: 173470 - protein, 11 aa, Homo Sapiens
KLPVANEYLLL

SEQ ID NO: 173471 - protein, 11 aa, Homo Sapiens
KMPQSMPEYAL

SEQ ID NO: 173472 - protein, 11 aa, Homo Sapiens
KSPASDTYIVF

SEQ ID NO: 173473 - protein, 11 aa, Homo Sapiens
PGSLIPEALRL

SEQ ID NO: 173474 - protein, 11 aa, Homo Sapiens
RIPHNNFYRKL

SEQ ID NO: 173475 - protein, 11 aa, Homo Sapiens
RPPSKPPPVEL

SEQ ID NO: 173476 - protein, 11 aa, Homo Sapiens
RSPGRAYALLL

SEQ ID NO: 173477 - protein, 11 aa, Homo Sapiens
TFSFPCHQTKL

SEQ ID NO: 173478 - protein, 107 aa, Homo sapiens
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 173479 - protein, 9 aa, Homo sapiens
IEVMYPPPY

SEQ ID NO: 173480 - protein, 8 aa, Artificial Sequence
  Synthetic Peptide
DELNHASI

SEQ ID NO: 173481 - protein, 8 aa, Artificial Sequence
  Synthetic Peptide
LQRIHAEI

SEQ ID NO: 173482 - protein, 8 aa, Artificial Sequence
  Synthetic Peptide
LQVAHEEI

SEQ ID NO: 173483 - protein, 8 aa, Artificial Sequence
  Synthetic Peptide
NEVLHQEL

SEQ ID NO: 173484 - protein, 8 aa, Artificial Sequence
  Synthetic Peptide
NQIIHRDL

SEQ ID NO: 173485 - protein, 8 aa, Artificial Sequence
  Synthetic Peptide
VSPLHRVL

SEQ ID NO: 173486 - protein, 8 aa, Artificial Sequence
  Synthetic Peptide
AGPTAHEL

SEQ ID NO: 173487 - protein, 8 aa, Artificial Sequence
  Synthetic Peptide
LTPTHGEM

SEQ ID NO: 173488 - protein, 8 aa, Artificial Sequence
  Synthetic Peptide
NSPMSPAL

SEQ ID NO: 173489 - protein, 8 aa, Artificial Sequence
  Synthetic Peptide
NSPVGNQL

SEQ ID NO: 173490 - protein, 8 aa, Artificial Sequence
  Synthetic Peptide
SGPLGTEM

SEQ ID NO: 173491 - protein, 8 aa, Artificial Sequence
  Synthetic Peptide
TAPLAHDL

SEQ ID NO: 173492 - protein, 10 aa, Artificial Sequence
  Synthetic Peptide
CGPSGLVREL

SEQ ID NO: 173493 - protein, 10 aa, Artificial Sequence
  Synthetic Peptide
ELHDHGVSSL

SEQ ID NO: 173494 - protein, 10 aa, Artificial Sequence
  Synthetic Peptide
HLSSSQLQSL

SEQ ID NO: 173495 - protein, 10 aa, Artificial Sequence
  Synthetic Peptide
PLPDRSLPAL

SEQ ID NO: 173496 - protein, 8 aa, Artificial Sequence
  Synthetic Peptide
AKAPHYVL

SEQ ID NO: 173497 - protein, 8 aa, Artificial Sequence
  Synthetic Peptide
NKGPSYGL
